United States Patent 8,781,750 (CELL-TYPE-SPECIFIC PATTERNS OF GENE EXPRESSION) - sequence listing, part 5

SEQ ID NO: 35821 - DNA, 108364 bp, Homo sapiens
ctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtgaggcgggcgggcctgcggtctggggagccgccgcccccggcctgccctgactcctggcgcccgctcctccaagctctcccagcctgtttcctccttttcctggtgtcctggggttgagcttgtgagaatggcttcagtaatttgaagcgcggattggatgtcagcttattccgctgaggtgttcgctccggacgtcctgaggtttcagaagtagtaagccgactgttaagagccctactcagcacccgccagcgcgtacccctcacggtgctgggggccgctagtcagggagcgaaatccatgcaggccagacagaaggaaggacatttacagcaacagaaacgtgcatgccccagaactaccaaagacttgagctggcggggatgacggaggcattgtgttgatcaatgggtgtggtcgcttgtttgaaatgtgacttcccaggtcaaagactgtcaatgtagtgcttattaaaatttctatttgagcttaattccgtaccctccaggttaagtttattgtatgttggaaacgctgtcaatactcattcagtgaagttgactgggcacttttgaatgtagtggtaagcaaccttttgctgaatgtagtttacactcttagttgccgcaggtgagggtgatacgggtgtttaagtaatggtttctctctccttgtgacacagttaaagagagaaaacccagaaagtaatagaaaactttttaagggcaattatttgatggagcccattgtaaagaaaggaaatagaaatgatggttgagaagtgaagtttttataagagaggtgggacttctgatgagattaaaagaaactattcagccaagtattaagcctatttgtagaaacccaagaagatagaaatgctgatgatacctccctcagttctctagatgttacagtttataaaatgcttcagatgtttcctcctgaagtcttaatgcatgctgcaggttggtaagatgttactttcctcagcagaagccaaagctttgaatgtcttggtagctaccagggtaatagggccaaacgaggaatggggttccattaggattcaatttcagaacttaaggctattcctcgtccttgtcagtggcataagtgccatcttagtgatgagagagctgttggaggtggcctttagcaggatcttatggcaggttaatgaagtcttgccatttgatcttcagtgtctctgtgaaacagataagtttcaagtttacgtaccaattcagcaaggttaagtgatttgaccaagaacacacagccagttcaccgtagagctgaaactaaaaatttcattttgtggattccaaatcttcctgttctgttgtttaaccattccatagtaggatgagaacacttttgtctagattgattgtagtttgcagaaagatgtggaggagaaaggagtatatactgagtaatatgtatagtatcagatgttttatattctggggtcgttatcttatttaacccttaatataacctgagaggttggtctttgtttcacagatgaactgacagagcactcattaacctggtaactcatttacctggtaacacctcttacaagacacttccataggttaggatttggtgaccagtctaatgaagtagtggagatggggagcagggatggaggaaggggagggatgggtcaaagatgatccaaggtttcaacttgggtgactggaatagtgataatgcgttaactgaactgtcacctgggtttaggggaaaaagttcagttttagacaggttgaacttgaagttgcaggtaggagtccctgcccataggctattggaattactggactagatcttttgggagctagagcaactggagtggtccgagggagagagaagagccaaaggtgaagaacaggccttggggaataatcttggtggagagcaataagtttcacagaaaccaaggggacaacagtctccagcagatgcttaagagaggtgtcatgttttctggaagtggttctcaaccatcagcatcgcttaaggaacttttttctttctttttttttttttttttttcctggagatggagtctcactctgtcgcccaggctggagtgcagtggcatgatctcagctcactgcaacctccgcctcctgggttcaagcaattctcctgcctcagcctctcgagtagctgggactgcaggtgtgcgccaccacgcccggctgatttttgtatttttagtagagatggggtttcatcatgttggcgagactggtctcaaactcctgaccttgtgttctgcctgcctcggcctcctaaagtgctaggattacaggtgtgagccactgcgcctggccaaggaacttttaaaagcacatattcctggatattttggttgggtagatcagggtgaatcctgggaacctgttcttttttttatttttttattttttatttttgagatggagtctcattctgttgtccaggctggagtgcagtggcgcaatcttggctcactgcacctcctcctcccaggttcaagtgattctcctgcctcagcctcccgagtagctgggtttacaggcatgtaccaccatgcctagagaatttttgtatttttagtagtagaaatggggtttcaccgtgttggccaggctggtcttgaactcctgacctcaggtgatcacccgcctcagcctcccaaagtgctgggattacagacatgagctactgcacctggctggaacctgttcttttatccacaaaagctcatttgacaggaggtttgtaaaggtgatttcagtattgacaagggttttattgtggggtgggacaacactgaatgagactgagtgacttggtaccagcataacattatttcttcgtggtagtaggtgatctcctgacctccccactcctactcatctgcctcttagggtttttttttttttctgtccctaacttgatggcataagactccttcctggggtctgcctctccacccccaccagatgtgggatgcttggtgtctctgctgaatataggcagagaagaatttggatgggagtgctgggctgcatcattgtggaacttcaaagcgttcccttaatattttggggagtacagtgttggtgtagagttaggcagctcatacgtttccttttaaaagtttgcatagcctggatacacagcttgaagaacctcagcaggaatgatgtatgtgaaaattgcattccattttataatacattagtatgttttaagacaaaaatcgtttagactgacaagccattcattataatcgataatgctgttttttttggagtccactttgagaagtgctcctttgtagaagtccttgaaactagaatcaggaaagctagctacatcctgttccttacataaattgttgagaaatcttgggagagtcacttcacctcttgtcagctgagaagattgattggaggttacagattagagttctcttccagccctatgttctgtgactctagaatgagtactgagaacatgtgatagttgggaggttggcagtggtagcacttcctggtggtgtgaatgggtaggtcagagaaggctggatgtactgagtgagcagaggcagctgcatggtgaggactatcaagtctgggggttctgtgttcgaagtctcaggtgttaggagagagagatcttgttgctttgcttttgtggagttaagatgaagatctggagtatcagcaggatgagcaactctgaaagcatggactcaaagcggtagagaccctaatgttagaatgaagtcagggcttcaggttatctgcagaagtaaaaatggttctggtgttgtttccagtttttaaccttttaggattttattgatttttttttttcccctctgcctacatcatcatctccccacactgtttggtgtgtgctgcgtagttttttacttcttttgccagcaggagctggggcaagttacgtaacctttccaagccttatttttttctcatttttgaaatgttgatgctgtcttcttcacagtatttttgtgagggttttgagagaatgtttgtaaaataatttgacacagttagtctgttagcacccttttgactgcccgcgcagtgcacagaacattgttatttaatacctgtccgcattctagccctttggaatctgactcccacccatgtcccaggttgctgtctcagcctttccttcctccagttattgcaagagcttttgcccttccttgacaagcctattcttagagctgtggcatttcctccagtggttccctgtggaagatgtgcctctcattcagggtctaactgggatcctccttgttccaagaagtctccctagatttctttcgccagacatgctcattcccacccataccctgacagggaattgagggccttgtcatgccccctcttgtatcagagttttcatgtgtgggtatgtcttgactgtacttttttggtagagaggtcccagcaccttcatgggtgtgactgtttcccagaaaatgttaagaacttgtttacacaccagaattttgagttcttaggaggcagcagaaatcattttgatgttttttgtgcgtgcgtgtttcttgcacactgtaggcgcatagtagatgtttgttgaattgaatgtccatgcagtgtggtgaaaaacagcagcagtcctgtaaacctggttccattttgggaattgaagttcagccatattttcatgtttcatttgtgagtctgaattttggtgcctttataacccacagttgtaccaggaccgtgtattctttgcattgtgaacaagactggggtctgtaaaataatgacaacaaagaccatctaactgtacatcttttaggtatgtaaatattgttagccttggcttataagtttctgattttgttgattttggaatcctcctgttaaacactgtttacctgtcagcttttggtgaagtggcagtgcatttccattttgccagtgggaaaacttgtcagtttctgacttttagttctctccttcacagattttacgacatttctacaagatatgtggtacagtattgggcagatgaactgattgctggattggtgtttgattttaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggtgggaatttctactttgcagcttccttctttcttgcgtaacatctggtgtttgggtttctccataatttattcttactttgtaacacattaattcttgatctcagtatttatttagctcttcatgtttgtaaactgctgcattacagtctttcagttatgtaggatgggaggtcagttggcttaaggtcagttccctcatttggtaaggtcagtagtcatacaaccatttgagatccagagccaaaattagagcacttgactcctctcacaaagacctaactttatctgtgtttagaggcttagcctcagcagctcgattgtttgtgtttttctctctgcaggagcactgctaggatttgctcatgatgcctgaggtataatggacacctgaaatgacagtctgttttaggtgactggattcacatcctcgctatgccgcttcctgaatgtattaccttgaacaagcagtataacctttctgtgtctcagttttcttctctataaaatgtaggtgataataatagtacctgtctcatagagctgttgtgaattttaaatgagccgatagtcaagcagctaatgagcagtagagcttgaatatgacatgaggtttccctgaatcaagcctcttgctttatgtacttgtactcactttttaggagttatgttttgtgggtgctctaaacttagttatacagtccttccttacagtctgagtgagaggagctgatcccttcttgtgtgggagttgtagtagtgtctgcaagacagccacgagcctcctggcctgctttgtttttttggaaaattcactctcttccctccttgataggatgggtcacctgtgtgcccccaaatccctgccaccttgagttctcttctgtttttctcactcctttactctctttctgacgtgttttgggggagattgtgtgtgtgcgtgcacactttttaatagagaccggatcttactctgttggccaggctggagtgcagtggtgtgatcatagcgcaatatatgaattgaactcttgggctccagcaatcctctcgcctcagcctcctgagtagctgggaccataggcatgcaccaccacatctggttaattttgtaattttttgtagagatgtctgccactatacctggctaaattttaaaaatattttcttgctgtattgcctaggctgtgggggagtttttgtttttttttctagttaatgaagcaaagtgaacaacttggaatggcttataaaatatggagtaagagaaaataagttttgtaaagacaggaggggcaagattgcagagtcttaaagtccaggctaactaatggagttcgaagaaaacaattgtttgatggcagaaccaagctgatggagaaggggagcagctcttgaatatggagctctggatgagaaggggtgaaataaggatttagagattggaagtggggagtatagggtggaaggcagacatctgatatttccttgcagatctttttaaaatattttttatagtgcagatctgctgatagtgaattctttcagcttttttgtctgaaaatgcctttatttcatcttccatttctgaggatatttttgctggatatagaattgcaggttgacactttttttttgtttttgtttttcttcaaacattttaaagactatcattccattgtcttctagcttgcactgtctctgatgagaagtgagtagacattctttgttcccctgtgtgtgaaatatccccattctcttgttatatcagttccttgaagttattatcattagtttgagcaatttgattaagatttactcatgcatgatagtccttgtgtttatactattgggagacttttgagcacacacacacatacacacacacacacacacacttaggaggtctgttttctctttgtccttcctttggaatattttctgttgacctgtcttcaactttactgtcttttctcctttggtgtctaatctgtagttaaactcatctagtaacttcttaatttcagatagtttattttttagccctgcaggttccccttgattgttttttatggcttcaatttctaccttggttttcctttaaatccttcaatatacttacaatagtttaaagtctttatctgctaattccattatctctgtgatttcttggtttgtttctagggattgagttttctcctgattttgggttacattttctttttctttcaaatgtctgataattttttattggatgctagacattaatggatgttatgctgtcgagtctctgggttttgatttcttctgttgagtgttgagttttgttcttgcaggcaattaatttatttgctgatcagaatgatctttttgaagcttgttttttatttgtattgattgatcaattgattgtagagatggagtcttaatatgttacccaggctaatctcgaactcctggtcccaaatgatcttcccacctttgcttaccaaagtgctgggattataggtgtgcaccaatgtgtctggccttgtttttcagctttgttaagctgtatctagggtacttttattttaaagctagcttagtcttctaagacatgcctttttggggcttctgagtgctccagctgttagtgaggtctttccattctgactggttgaggcttgaacgtctcccagctctagggattgtccatgtcagttacccaggtttcctacttgtctcatggagttgcactttacacatgtgcagttttgtattcagccaaagactcaaggggatcctatgaggttttttggagttctttctatgcgcagcctccttactagtagtctttctgtaaaataatcagatgtaagaatgaagatttaatatacaaagttgtttgtcatagtccacttaggctgctataacaaaataatatagcctgggtggcttatagactacataaatttattgctcacagttctggatactggaagtctaaggtcaaggtactggcagattcagtgtctggtgagggcccacattctgattcgtagttaccttgctgtgtcctcaaatggtggaagaggtgagagaactctctcaaatcttttatgagggcactaattccagtcatgaaggcagagccctgatcacctcccaaagtactcatcccaatatcttgggattaagatttaccgtaggaattttgggacacaaacattcagtctatagcattgttcacttcagttctatttattccaacattacttatattagcaaaattttggaagaatgctgaatttctgtagtaagggaatggagaaatacatttataaaatgcttttaaagactactgacatggttattgtgatggtcagtttcatttgtcagtttggctaagttacagtcctggttattcagtcaaacactcatcttggcatggctgtcaaggtattttgtggatgtgatgcaagttaataattggttgactttaagtaagggtgattgtcctaggtgatctgagtgggcctgatctatcagctgaaagcctgaagagcgcagcagagctcccctgaagtagaagaaatttctccgatggacagcagctgcactcagtttctggagagttccacattggcctgctatgtggatttcagactggcctagccagcccccacaatcatgtaagccaatttcttgcagtaactctcttaataaatacacttatcccttggtatctgcaggggattggttcctggtccctcgtggataccaaaattcatggatgtctaggtctcttatataaaacagtataatatttgtgtataacctatgcacattctcccatagactttaaattatgtctagattacttacaatccctaatacaatgtaaatgctatgtaaatagttgttacactgtattatttggggaataatgacaagaagtttgtacatgttcagcacagacaaaacaatccattttttttttttttcaaatttttggattttttttttttttttttttttttttgatactgggtcttgctctgttgcccatactggaatgcagtgacatgatcttggctcactgcagcctctgccttctgagctcaagcgagcctcccacctcagcctcccaagtagctgggactacaggcgtgcaccaccttgcccagctgatttttgtattttttgtagagatagggtcttaccatgttgcccaggctggtgtcgaactggtgagctcaagtgatccactcgcctcagcctcgtaaagtgctgggattataggtgtgaggcaccatgcctggccattttttgggaatatttttgatcctcagcaaatattttggtaaatattttttgggaatattttgatttgggctatggaacccatggatagcgagggctgactatatctgctgcttctgtttctttggtggaaccttgacttatacagatattttcatgatataatgttaagtgagaaggggagaattcaaactatatagtctaatatcaaatttgaaaactttaaaaattatgtatgtagaaaaaaagctggaagaaaatagtagtagtaatcacagagtggtggaattgtgagtgttcttcatttttatctttgtcccttactatattttctaatttttctgtaatgaccatttattttgttttattaatttttttgtattccttttatgatctctaaaaaatgaaaggagggtattggttttgatttctgagtaatagactagaatagctactttgttgttttgtagagaccctattttaaaattcttgaaccagtgaattttgttctgggttagaattagagttagttttgtgagttctaccttaaaaataagtatagagtgaagacttggatatgtttcaggaaagctaacctttctacttggtagctctttgttcagaatagactggtaccgcaagaatcctaatcaaacctttccaaggactggaacattctcagcttcagttacttgttttccttgaacaaaacaggaagttgtggcaccgatctctagttatacctgaaatgtagtgttttagcagatttgaaaatagaatgtgaaagaccatccttttccttgttctacctttagctgcaccccaagtcctcccaccagtgttcaggatggtttatcctataaattatagatctgcagttcttttaattgagtaatttaaggtagttattctgtagaagaccacacagaagcaccatcttttgtgagcactctgtctaaaatctgagaatctaagtcttagattgctgatatctgatgactcttacttgacatgtttttcggttctaaccagtattaggcaaaaactccctttttgtatactacagtaaagtcacatcacatgcttatttaatttaaataaattcagtgtaagtgctgggaaagaaagaaacaagattaaaaataatgtatttatattttgtatatatgtattttgaattttatttttttagagacaggatcttgctgtgtttttcaggctgaactcgaacttctgggctcaagtactcctcctgcctctatatatgcatttttgttgtaaggtgttcattactgtatacagacaattgttttgtgttttagtaaagtataatttatgtaacaatacaattcattccttttagaatacagtttatgactttggacaaatgtagtcttgtaaccaccacagtcaagatagatgaccagtatggtttggctgtgtccccacccaaatctcatcttgaattgcagttcccataatcctcacatgtcatgggagggacccggtgggaggcagtgaatcatgggggcagttatatccatgtggttctcgtgatagtgagttctcatagacggttttataagggacttttcccgctttgcttggcacgtcttcctgctggtatgtgaagaaggatgtgtttacttccccttctgtcatgattgtaagttttctgaggcctccccagccatgctgaactgcgagtcaattaaacctcttttctttataaattaccccatcttgggtatgtccttatagcagcatgagaatggactaatacaatgacatttccattggtgccagactcccagatcctggcaaccttgtgcctgtgttctgccctaaagctgttgcagcatacattgttatttatacataataatgtacaggtttcatttatagtatttttggggtgatttgggggaaattttattttgacctaattttaccatcactctgattttagcatctccctgactaataacctacaattggtctgaatttcattcttgtttctgccctactgttgctgccagggcatgtcaaatgaagatcagaaatgcccccaccccagggcttaaaggaacctatctttttctttttttagacggagttttgctcttgttgcccaggctggagtgcaatggcatgatctcggcttactgcaacttccacctcccaggttcaagcgattctcctgccttagccttgcaagtagctgggagtgcaggtgcctgccaccatgcctggctaatttttgtatttttttagtagagacagggtttcaccatgttggccatactggtctgaaactcctgaccttgggtgatccacccatctcggtctcccaaagtgctggaattacaggcgtgagccaccgcgcccggcccaaagtaaataacccatcttattcctcagagaagagagagaatttgcacacagatatttccctatttgcacaagatagcatcagagaatgtgcttatattctgtaaggatgctttacaattttaatagttgttcaggctgggtgtggtggctcatgcctgtaatctcagcactgttagaggccgaggccggctgatcatttgaagtcaggagtttgagacaagcctcaccaacatggtgaaactctgtctctataaaaatacaaaaaattaaccaggtgtggtggtgcgtgcctgtaatctcagctacacaggaggctgaggcagcagaattgcatgaacccgggaggtggaggttgcagtgagttgagattgtgccactgcactccagcctgggcgacagagcagagcgagactccatctaaaaaaaaaaaaaaaaaaaaaaaaagaattgttcatagtaaagactttgtaaaaagtgaaaaagtgccatttgagcctcagtgtttatgtaatactagactgggtgaccagtgcctgcagacatgattagcactgtggaagagaggggcgcaaagtctgcagcatcttatgacgtagtcactaatcaggcatttctcaagagctgcctgttagggtttgcctcttggatgacctcacggtagggtttggtgttggtttcctgggcatgggccgtcagtgtcaactttcatagcacctgcagttcaggctcttgacctgcaggtgttgctgtagacagtgggatggtgactttgcctttgcttgtgctgggatgctgacaaaaatctctgaaaggctgtgtcagtcctgggcttttccttttaaaaatcacgagcagaattctttaacagagaagaaggaaaatatggtagcactaagaatgtcagttactgcctagaaactgttgtctttgtcctttgtgcttggactggttatctttttgtcctttggatgaggaacagagtgctccaacactgttggtgtgcattgggcagtgacagggccctgggtccaactaggccattcctcctgccctgggcagggaagcagagtagtgacagtgtacaaagagggtgtcatggaacaatctaacatattaaccccttctaggacaagcccgttagaacataatacctgagaaaactgttcagtactttctcttgctttgggtagtgtggcctttgtgcgcagttacagggacctcggtgcttcttgggaagggaatggcatcatttggaagataaatttcaggtttcctaatagtgtccttggcagatacttcatcatcatcatcaggctgctccctcctgacttggtctccgtaggtatgggcactcttcacttttctcatcagcaaagtcttttccagtagttcatccctccgctttccccagcaggtaaccatgcctccttggagtttgcacttcattttacgttattcctttatggctggctgtgcccacattttcagtgattaggggcagagacttactcagcctttctcacttcctggtgctgtgtgagatgacccccccagtgcatgccgaattccatttcttagtacctcttctttggttttgcttactgttttcgctcagtctgttataacaaaaatactgtagcctgggtggcttataaacaacagacatttattgctgacagcctctataggaggctagaagtccaagatcaaggtgccagcaggttcagtggtgagggcccacttcctggttcatagacctctgtcttctcatcgagctgtcacatggtgaaaggggcaaatgaactcccttaggcctgttttataaggccactactcatattcacgagggatctgcccttatgacctaatcgtctcccaaaggccccacctccaaataacattactttggaggttaggtctttaacatgaattttggagggacacaaacattccttctatagcactcacacacctatcatgacatctgtggctcttgatgtccctcgggtgggctgtcaggagaatagaaaggtgcctgtgcttcaggcctgagacttctttccgtgtgtaggctcacactgcctgagaaatttgggttccttgtttcgtctttaaacagcttcttcctttactagtcgaggctttttcaggtgcccattgcaggagacccctttgtagagtcacgggggcttaatcagaatccccttctctccatatacccaaccccgtagactgtggtgaggattgaatgagacctacttagcatgattcctgacagagtgtgcactcaagtagatactagctattatcgttactattatttctcttaaaaaagaaaaagcttttcatttttctttctgattatactcaatgtacaatatttggaaaatacagatgagtatataaagaaaatcccttcacttcctattaactttttgggatattttctatggcttttcttttctttccttctttcttttcctcttcccttttcttttttgagacatagtcttactctgttgcccaggctggaatatagtggagcacggtgcaattgtagctcagtgcaacctcgacttcctgggctcaagctgtcttcctacctcagcctcctgagtagctgagatcacggatgtgtaccaccatgcctggctaatttttaaaaaattttttgtagagacgagactccctgtgttgcccaggctggtctcaaactcctgggcttaagagatcctcctgcctcagcctctcaaagtgctggaattacaggcatgagtgtctgtatccagcctgtttttttcttatgcatgtaaacatatacataaatacatgtatgtatatttataaaattttattacactttatcttcttttatgctgaacagagtatccttagcatttcctgcatgccttttgctgattttgaatttgtgatgtagaccagcctggccagtatggtgacagcctgtctctactaaaaatacaaaaattagctgagtgtggtggtgcatgcctgtagtcccagctactcgggaagctgaggcagaagaattgcttgaacctaggaggcgggggttgcagtgagctgagatcatgccactgcactccagctggagtgacagagcgagacttcgtctcaaaaaaaaaaaaaaaaagaaatgaatttgtgatgtacactgttgagtgttgtctacctgaagtggctcttgtccttggatgagggcatatgctgcatagtatgcactgagagagaataatgaatagaaagccaggggttgagggatgtctgtctgtttcccctcagattcagctatctgtggaccccacctggggattgagccttaggccacctggctcagtgtcatcttgtgtcatagctgctatttcacctttccagtgattcaccctgaaactgcaccttctttaagaaagctcaggcataagaagcctccaagcgatttgacttaaatcacaagtcaggaaaacctgatttaagttgttaggaggacttttaaaaaattctcacaagaaacattgcatttttattttttattttgcagtttatttttattttgcagtgaaggttatatgcttcatttttagaaagcagtgttgagtttgctggatattgaagttatatcagaaaataacctggtatcttaacgttttcagagttggatgggttcagggagcatgtggtcagggaggaggaagaggagtgttagaatcatctgtggagtttttcccctggaaaaatgtgtatttccaaaaattgagaaccagtgatctgcttcctttttacaggtgaagaaattgagatgtacaatggtcaagtgctttgcttaaaatcatacatttagaaggtagggccagagagttattgggaattgaagcagaactacctcgtggactaactgaggatttatttgcattgatgtgttagaaaaaagcaactaattaccctactatctgagagatactttttaaaaactagccaatttcttttaaaataaccaacttctatttgaatatttttctataataatagttcttctttttatgctagcttggttttttttttttttgatgttggaaaggtaatatatgtacttcacaaaatgtttattaggtagaatttgaaatacaaaagacagtagacagaagaacatgactcctcatgtgctcattgcccagttccaacagcagcctgcttttctccctcctggtttattttgaaacaaattctgccttgtatcatttcatctgtaaatattttcagccactgtttaaacttccagttttcttatagtgtcctaattaaaagaaagttttgtttgaatcaggctactaataaggctccaaacaccaatgcctcatagtcaaccctccatttttctctcttttttttccctcaaaatttatttggtaaagtaaatcaagttgtttgtttgtatttcccactagctggattttgctgattattacccacatgtggtttagcatgtcctttgtcctatttcctataagttggagttggatttagggtaacatttttgaaagttaggagagtatgtaatagaagcaggttcttcctaaagatgactgttgttcaatatcatcttttgcaaaattttaatattttatatgtatgtatatattttccctactatatatagtacacatgcacagacaaaagcacatcagtgaatgttgcctttgtcatatccctggaatgtgctgtgaacccttgcactagataagcagctgacactgactgaatacttcctgttgccaggtagcttctccttagtgtacacataggtttttcactgtcctcacaactctttgaggccgttctgttgccttcccattttgtagtttaggaaactgacccaggctcatgttgttgagcagtggaacctagtttgcctttgggtggtttgccctgagattctccgctacgttaaaatgctgatgttcatattgtttggtccataaaacataaaataaaataaaatgcttgggtccttgctctagagatctgatttaattggtctgagtgtggcctcttctgtgtcatgtctggattttcagaaactttccaggtgactctgatgtgtggccaagatgtttactaactgccatgtagtattctgctgtgtagatcttattatttaatgagtccccaaggggtgtgtacttaagttgtttcccgtgtgccagcatcacaaatgatgttgcagtgaatatgcgtttaagtgtctcttggaacatgtgtatgaatatcagctaaatgaattcccagaacaggaattactgggtcaaagggtatggcgtttgtaattttgatggatgttgctaaattggcctcagggagtttgtgtctgttctctcactgctaggttgctaggttgtctcagagtacccgaccccatcctaggtgttagccagagtccctaactcctttctgggctactgttaccttttcttctttggttttctttgaaatgtcgttcacttttgaaatatcttggatttaactttgtatatgtttctgtatttttttccattctttgtatctacaaatactaaaccatttgttcattttgtttgttagcacaacgctattttgtttcatagctttataatacattttagcacttggtagaactagtgtttaatctttttacccccagacttttctcaaatattcccgtaaattaatttttgtgtatgaaaattctgttgaaatattcattgagaatacattaaatttatgttttggattagggagaattgacatctttacattattgagtcttttggtctaagaaaaggttatgtcttatttactcaagtcttgctttatgttcttttgtagaattttaatctttttattcagtaagtcctatacaccaatatcgaattctcttactggtttctaatagtttctcagttgattttcttggattttctaggagtgcagactatttcttatttatagtagtattttagtaacaactatatttagtaatacatcatttatgtatttgtcacatttagaattctaaatgtaattgtatttttttcctcctcctcaaaatttgttgctgagcaactggaaggatggaactggcagccactaaagcactggaggggaagtttctcagggttgattggggttggtcacggcttccatcaatctgagaagctgaccagtggttgaggtggcattactaattaggcaatagacacacgagtctggagttctgagaagagtagggactgggatgggcatttggaaaacattagcatttagatgcatttaaccatagactgggtaagatcaccaaggcagtgagggtggatggaggagacaaacctgagagcattccaggagcccttgtgaccggtgcagtaacccctcgattagacctgttgcttcatctctggtttgttcatggagtccggatgagcacctaaaatcctgtgtcattttgtgagtctttgtcaccccttgcttctaagaggtatatctaaggtctgtgtgtcacttctactctgtagtggcctcagtgtgtccctgagtaggtgattctgtgttctctatcctatgagtggtggctgtaaacacttctatgtgtttacacactcctatgtgtttacaaaaaacctctatgtgcctttcctgtgcaaactgtcctttgtgtgtcttttcttgtggccactcatgcttgccctgctcattctgtcagcagagaagtcaggaggaggggagtgggactgacctagatcacctagccctgagctggttgttaccatgtacagttggccctctgtatccttcggttccacatctgcagatccaaccaaccttggattgaaaatactaaaaaagccaaaaccataaaaaataacaatacaacaataaagataatacaaataaaaaatatttaacaactatttacatagcattttcattgtattaactattataaagctaaagatgatttaaagtatacatgaggacgtgcatatgcaaatactataccatttgatatcaggatatcagggacttgagcatcgttggattttggtatccttagggttcttggaaccagcactctgtgaataccaagggacaactgcatatctacttgttgggtaccatttgtcgtcaccatgcaaggcaggaactttgttcattgtggattctactgcctggcacgtagttggtactcagtaaacagctgaacaaataatgattgaagttaaaagtcacattgaagatgatcaacctttgaattttaacatatctcatgaatgccactcttcagtaacatttagtttttctcatattttcacatttgtgtatgttctctgtcttcttagggcaactcagagttgtactttgaacttggtagtagtttgaactcttgttttggtttggtcaaagtaaagataaataaaaatagttaaaagttaaacttgctagtagagtcctgaggccacttctctgtcttccagacattgtgctgagccgtcaggctgtcagctgccccttctggttttgttgtttgtgctcttgcccttctttcccttccctcatgggttgcttcccttgcagcccctgagttacagatgcccaggactatgcagagcccggtccacgcaggccttgtgctctctgagccacgctgtgaggtagttggagtgacctgagtttttgtatctcctttaattaagccaaggaatttgctgtggaagcagcatctgagtgagaggctaacattggggggaccttaaaccgagcctgggcgtgtaggcagctctgtcctataggatttgctttgagaccctctggaataagtcatctcaaatgacttggctgtgagttctgtgagctgagaaatcagatttggagcctgttatctggtctttaaaatagcagctgtgggattctgaagagtgagggtcagatctgtggtctggctgctggctgctgtggtatggagtcagtgttcttagctaaccaaagactagcatattctctctctcatataactgttaatgtctgtttattttttggtcttttaaaaaaatctttgaattttagataattcatatctaccaaaaaaaattgcagaagtcatgcgaagaattctcacatatgctcttcacccagcttcaccaaatgttagagtcttttataatgagggattaccattagctcatctgtagaccttgtttaaattctgcctgttgaatcatgtcctttatccttggctcagggttcaatttgttattgtcattgtattcgtggttgtgtctctcttcagtctcctttatctgggacagtgacagtttcttagtcttttcatgaccttgacagttaaagagaactggtccttttttttttccttcattgccatttttttttttcgtggaatgtccctcattatagttttgtctgatgcttccttatgactgtattcgtgttatatgtttttggcaagaatgccacagaagaataccatggtgggcccttagtgtgtcatgccaggatttgtcccattccttctgatgttaattgtgatcataactgtgatcatttggctgaatggatggctgcacatttcttccactgtggagttactgtgttcctttttgtaattaataagtatcttgtggggagataactttgagactagataaatatcttgtttctcagcatacctttaccattaatcttagcaaccactgattattcttgcctgaaacaattattactgtactgtttgctaaatgattttctatttttatcattctctctccatttattatttagaattatacttgtcaaaagacaaaattataacaaatttagtttaaagatctagttggcatttgtgtttctagaattgggcaacatctcattctgtaaaatagaatgagtattcccatgagctgaccaaaggaggtaggttttataggcagaaaagggctgagaaaagcagacacagagaacaaaaagcagatgggtcgtttcaaagtcacttcctcatagggttgaaacaggtaaggggtcttccttacctgctgactcaagttgactgaaatctcctgttttttttttttttttttttttttttggtttgtttgtttgaaaactggccctttttaaagttcattttgattgtctctattctggtttggtctggtgtgctggggccttatgcaggagctcagtccaaaacaaatggactgtaaggactgtaagtttcacatgctgtaaggaagagcttttctttctcctctacttatttattagttcttggtgtatgtcagtgtgtattcatggatagttattccataggttatggtccattactattgtttaattgctcaagtggcctcttgcagttgacttttcctgttaacatgtttgcatcatttttcgagcacttctttattttcttgtacactacaggaagttccaggtttgaattcttctcctgccctggctgtggaatggaccctttctccaagaagtccttgggttttgataagagattgagattacaagccaagagctgggcctgctgtgttagttggtgctgtggtgtcaggcttctagactctcccagtggatgagcaaggaggatacctgtctcttgccttgtggtttgctcctttaatctctgaaactgttacatttatctttttacttcctgattctagtctttttcccccttttaaaaaaattatgttatggaataagagtatgaatcttggagtctagagaccgggcattcagttgctagctctgacactgataagctgtctggcattgaacaaacaaattctttcgtctccctgggccttagttttcttttctttttttttttttttttttttgcagtttttacatttatttaaacagaaaacgtgcacacgagctgtctactcattttcttcgctgcgcagcctggcattggggttggtgactctgatggccagttgggcagctgtttccacgatggctttgcggttcttggaggaaacattgtgagcgatctcggcacagtaagatttgttgcacatcagcagcacttccagctccttgatgttgtggaccaggaacttccggaagccactgggcagcatgtgctttgtttttttgttgctcccataaccaatgttgggcatcaagatctggcccttgaatcttctacgaaccctgttgtcagtgcctctgggtttccgccagttacgcttaattttgacatattggtctgactggtgctggatgaacttcttggttctctttttgacgatcttgggcttcacaaggggtctgagggcggccatgatgccgaggaggagatggctgccacctccgtaggcagcgccgaggaagagagccttttcttttcttttttttttttttactgaggtcttagtttttttcttatatacaatagggtgataacaattaaagggctgttgtaaggattaaatgagatagtataattaaagctttcagtataagctaagtactaggtttggttcttggattcagcaagtatttatggaatactttttttttttaggggcttggggcaaatggggtttaagattgccagcctgccccagtcttttgcctcgtccctgccgggcctcaatggggaccttgatctctgacctgccccttgatcaaagagctccacctctgacttgtcccttgatctgggagcttgggttctaacttggcagcctggatcagggtgattggcctctggctgatgcagaggaacctctggcttctttttcttcctttgagcagttgtacaatttgagtcaggaagggagagaggatggcttctttctggccacccactagcagaagtcttggagtgggcgcttcgccgttcccatgttaaatgagcagttctgattctgtctgggcacattctacttctgaaagcaaaatttcacaccgatctctgtgggtggtattattgtgaggaccattggaagggactctccttccttccctccttttctgtcataacttttctatctttattgacccattcttcagtaggggtgagatgctggttcagcaggccctgtaatagcagcacactctgccctgcagaggttggaggaagtgacacccaaccttcttcaccacggggggctggtgagggtgaatgtggggaaagaaaccagtcagtgcccctcaatcttcactgctgatagctgagccacaccatagatttggaccagaatcttctcccaaggagggccagtgctctcttcccatgaccctcatagcagagtctgaaacagcagtctgagtgggtcacacgttccctcacccggtggggctttgtgacctagtgattcatgggaagcgggggtgtttgcacactttctccctcctgcccactagcatgcctcctgctttgcaggctcacccagagctttctattctgctgctgctagagcttcccaataagtgggtaggtaggactagctgtgacctagaaaacacttagcattatccaagtgtccctagtgaaaagctgaataaagcaggagaaatgtcactttggatgctcaagttctcctaggagaacaaacttccagaccttttgtttcccctaatttttgaaggcagcatggctgagcccagaaccacatggctgagcctggtaccagagtggctggcaggatgagcacttcacagattggtgtggtgactagcagcctccttcctgaggcctttggggccctgctgactgtactgggtcttaagtaagaaaaacagaaaactgtttctctctccaaggaaaacaagcaataaaccccatgtacatacctccctgagttctgagtaagaaaggaaaccaggcatggtggccccagaagtgttcagggcatatgggtatgatcccttgcccgagtgggttggcagtgtcctcttgagaggctttttgtgtctgctgagtattttccaatttagggtggctcaggggatgggatgaggattcttcaactttttccttgttttttagcttttttccttctcaagttggccctgggtggctgtccctgcttctaggggccattgtgagctttacattggtgcagtgctggctcctggcagcaagcatctggcttataccactgagatgtctcatgttgggtggctgtgccacccaggcttccatggtcctgggttcactggtcatttctttcccaaaagtatgcattcacgaggtcagctttgtatctttggggccaagcatctgtgattttgctgctctagcttttatttagatttgactctcttgcaccccttttaccctggaacttcctatttttccgtaaaagtttttctttattttttttaactggtgttttgaaaaatgctgtatgcatatatcaaaaacaatttgagaagtacggtggggtgtatagtagaactttggtggtcttctcactcacggccctgtctgtggctctgttctgctctacacagtgaggtgactgtgtttatccactctaccctaagtggctgctgttaccagtgtctggtgtaccggtcaggagatagtctatgaaaatacaagcatacttatctatgcctgtcttcttacttttttcttttttggttaatacagtttatttttagactgactttaggttcacagcaaaattgagcaggaagtgcagagagttctccctgtgcccatggcctccacgattaatgtcccacattctctactttttcagttttaacctttccacagatgatagtggctgtatacactgctcatccacatcagtctcagtgggtgtctgctgtgttctctaacggctgttcagaagtttcccacttcatgtggacaggccttaaggtgttgatgttttactgtgtgaactgtgctgtggctgtctgtattctctcagcctcatttctggtggaattacgggagaatgatgtgagatgactgtgagatttttaaaatcactaaaagtttctttatagtaatatagaggaaaattagaaaatacatgtaaaaaacattaagattaaggaaatttaaaatgctctctggaaatgtcctggggatgtcccatgctcgtgtggggtctagggcacagggcggagagcaaagcataggtgtttgaactggtgctgctgaggtggagcagagcacatgtgtcagcttctgtttacaccttcgtttgggcccttctgctcccctgccacttccctgagccctgccctcggctcggcccctgggatggatgtgggttattgtttttggcactgtaagaggagggaatttagaataaggaaaagagggttgagattctgtactaaatgccagtattgttgggtgtcttaatctaaaagctggaatggggataacgctccttctaaaagggtattggtccatagaataagaaaaaattgaagcttatgtaaagatttggtgggccgggcatggtgtctcacacctgtaatcctagccctttgggaggccaaggcgggcagattacttgaggccaagagctcgagaccagcctggccaatgtggtgaaaccctgtctctactaaaaatacaaaaattagctgggtttggtggtacatgcctgtaatcccagttactcaggaggctgaggtgggaggattgcttgagtctgagaggtggaggttgcaatgagccgagattgtgccattgcactgggtgacacagcaagactccaccaaaaaaaaaaaattgttgatctagtcaaggtacatttctctgcctgatgttttctgagacatgggtgtatgatttgtctgtgctatattgtgttctaacccagaggccgtgaaatgaaaaaaacgtaatttaactcaaattaatgggactgtggcgctctttttctttctagttggcctgctgtcactttgagggactgttatttggaggaagttaatttgggaaacgattcttgcttcgttttctttttcttttttttttttttttgagatggggtcttgctctttaacccaggctggagtgcagtggcatgatcttggctcactgcaacctcttcctctcgggttcaagcaattctcctgtctcagcctcccaagtagctgggactacaggcgtgcaccaccacgcctggctaatttttgtatttttagtagagacggggtttcaccatattggtcaggctggtctcgaactcctaacctcagatgatccacctgccgcagcctcccaaagtgctgggatcacaggcgtgagccactgtgcccggccaggaaatgattcttttggtccctcatactgcttgtgaagttgtagaagtactaaattcccatttcatccagaaaatatatttctttgaaaatgtccgttgattttttttttatttagtaaaaatacattccttttgtaaatagataaaactcaagacccctttgatcatccctcaagcccagtattctcccagagataacaattgttcttgggctcaccttttatttatttattttaatttagtgattccagtttttaatgtttaagattgctggttgattcttatgagtgtaatatcctctcacaccacttggaggctgttgattgtgcctgtttttaagtcttgtgtctttactaactctgtgttctgcagcatcacttctttaggtgtagaatttgttgcccttttctcagggtttggggatactcagctgtgtattaacttttaaatttgaggttcctgttagcctgtctggatgctgcatcagttttccaaagttggtctctagacattgttggtggcttggctgggcatggactatgtcagctgctagttctcagggatggcaggctccgtgccctctgtgggtgtcaccagcttgtcctcccaaaccaagtgtccaactctccttctctctgggttcaatgccacttaggttcaagtgagtggagttacatatgtgtttttggggaggggcaggaggtcattccattgttataccctaaccacattgtcccttgatactcacaaagacaaactagagcgggctagggtttctgggcatctctgcctcctgaccctatcggggtcaagacacacccaggctgcatgtgtagccttcgcttagtgtcatatattcagtgccagcagctatctcatgagggccatgggcactcatacaatgcaaaagatactataaatcttttgtatctttgtgtatacacacacacacacacacacacacacacacacacacacacacacagcctggttgtgtcttgattggtaacccagaatacacaggcagtgttgctttggtgatgagtattttcaaaaaggcaattacattttagtaaaggccagaatcagacatgttgtattcctggaaaattcatgatataataaaagcatgcaaaaaattatttgggtttttatctaaaattgagttaggttacaggctcagaagaatgttaaacagcttctgtctacctgcatgtctaatgggatgtgtgaaggtaatgcagggcaggggacagtgcccattgactgccccaaggacacctaacgctgcccacacactcccaaactcccaggaggcagggcctaccctccctttgagagctgctgatcaagtaggagttttctgttttcattcatatttgaaaagttggaataatctgctttatgatgtctttattccctgaaaagttaagctaataatattggtcagtgttttcctatttaggaacattttctgaacatgtggtcattaggggattttagagtataagttatgtatctgttaattttttctgggtaattatgtggttgagatgctagtggcacacattatggttacatttgttcagtaactgtaactcgagccctggaaattaggcttctataaaatttcatagcaattcatgaaatgttgtttgtaagcaaaatgtacccagctccttgactaaagttaccttaaatattcttaaagatagagaggtaatacgcatttctttttctctttctgtatgtgtgtatatatgagagagagagagagagtgtgtgtgtacatgtccctgataattcctatctcagagcagtggaagtcctctgagtttgataatatgctttgcatgtgctatatttgtggactgcctcagaacatctcttggggagactacctgggttcagggaccacctgcctatgcacctgaatcatgtgagccctgattttatttaccacggagccaggcacttgaacactgtcccatcccaactgtgtccatcccaactgtggacagcttttacacggtccacctccttgccttccaggaccccttcctcccttctccttggcttctgtggccctgcacccatgaaggccagcacaggcaccaccttctctaggaagcatttctggcatttgagaaaatgagctttcacacagtctgggttagggcccggatcccaaactttctgtttctttgtttcctccccctttcaaccattatggctgaggtgtggccattctgcatgtcacatggctggtgaaagactcctttctctctctctttggtgcttcttcaaaggctccttcactttcaatggtataggtcagattgtaccatgtgtctgcggctgactcaatcatggtagcttttctgtccttcccatagcatccctaacaggcaggaaatgatttagtctttatgagtgtgcctccccccacagggagacagccttttcctgttgcagatcacactgattttaagagaagacttctcttcatatgcagcttgcccttctatcctcccatcccatgtatatgtggcataccttctatgatgtttcaggctctgttctagcagtcagacatatagagtgggagatgctcaaggggctcacagtttagggggagcttggacaaactgttgcaatcccatgtgatgaatgcagaggaagggtccagacccattttctggaatgtcagaaatacttcctggagaaggtgatgcctgtgctggccttcatgggtgcagggccgaagaagccaggagaagggaggaagggattcctggaaggcaaggagatagaagaaagcatttgagttgtgtccagagaatccccttgggaggggtatagtcttgaaggagcgttttgagataagcagagttgaacccgtcgggtttttaggcctgttgtctaggactacctaggatatgtggtaggagaaaagaattatcacaccgttcaaatacatttttaaaaataatgaaagattttccaatggaggaaaactaaaatcctttaatgcagattttgcaaaaaagcgtttttgccaagtgttgactagtgtagagttaattcatttggagtaatgttttatagtatttgtgaaatttagtataggttagagttagtactggatccagggtttaaacttttgttttctctttctttccccccaaattaaagcatcctatccttttcatcttaatttcattcatatcttcatattacgtttttgagatagctgtttatttttttgagggggaaatagtgacataaataggtttagaacctcaggtggcttaaaaccccagatgtagtcagtggtaaattttttttttcttggttagtctagttttggtgttggtaagtattatatatgctggtgggtttttaaaaagggcacgtggtagagtctggcatactatttggagtcttgtggtagctgcccacttcctgctaatgcagtagagcatgttcataatggccttatatgctttccttcctagggcaggccgtacttagtcataccaggtaagaaatatgttttaaaattttagttaaacagttatgatgatagcttatagtttactttgcatttctttatttatagaaagattacattttctacacagtgatttactgttgttatttcctactttgttaactcattaactccacttactcattgatgggagtctggatattatccttctgtagttttacaaatcctcacattttcttattcactgcttttcttctatcagttgattcactgaatttagtgtggggattttaccacatcgatactgccttcagtgattttctttatgttagattttagaaatttctctctgctttaatgttgtaggctaaatataccattccattgtctactaaagggctcaagactgttctttaatattgtttgatttctttaaaatgaattccactgtgacttgatcaagttttgtattataccacttggggactttaattgatattatgttaaaactccatattaacttgaagagtatgatcagttttgttctcgttaaattttcctgttaaaaggaagcatatcattctattgttggtggcttccttttttctgtcattaaattcagttacagaaagttgccctcaagaattatatacaaatctcatgtgtcctcagatccattagtagccatacagttaatgtttgtgttgcttttagcaatggtatcttcttctccaccatatgttatagatgtgtgacagttaggaaagcagttgtttaattaattacaaaagtaatttggaaaatttggaaaatagaattatccagttctatcactattattaccttgttcaattttcttctgattaaaacaattatatttgctagttctttattagacaattataatattagaaaatacatgaccacaggtctaggcatggtggcttattcctgtaatcccaacacttcaagaggccgaggcagaaggattgcatgagcccaggagttccagaccagcctgggcaacatagtgagatcccgtcttgaaaaattagccaggcatggtggtgcatgcctatagtcccagctattcagggggccgagatgggagaattgcttgagccctgtaggtcaaggctacagtgggccatgatcgtgccactgcactcagcctgggcaaccaagtgaggccctgtctcaaaaaaaaaaaaaagaaaaaattaagaaaaatccatctacaatagaatatatataaaaaaatacttaggaataaatttttaaaactccaaaactaataatactcccaaaacaacacaacattgttgaaaggaatttcttctttataatcctgcagccattgtcaatatactgtgagatgtccttgcacacctttctccaggctcatacacatgcttgtatgtatgcatacacatcaccacacacacacacacacacacacacacacacacacacacacacagcactccccgtctaatcctgcagccagtgtcagtatactgagatgtgtccttgcacacctttctccaggctcatacacatgcttgtatgcatgcacacacatcacaccaagtgcacatggcacaccataccagacacatgtacggttttaaaaacttgagatatagttcacgtatcttaaaatttgtactttaacatgtacaattcagtgcttttcacatatttacaaggttgtataactaccactattatctaattccagaactttttttttcccccgagacagagtttcgctcttgttgcgcaggctggagtgcaatttcacaatctcagctcactgcaacctccgcctcccaggttcaagtgattctcctgcctcagcctcccaagtagctggaattacaggcatgctcaccatgcctggctaattttttgtatttaatagagacggggtttcaccatgttggtcaggctagtcacaaacttctgacctcaggtgatccacctgcctcagcctcccaaagtgctgagtttacaggtgtgagccaccatgtctggccccagaacatttttattacctgaaaaagaactttgtatgcattagcattcactcctcattttctctcaaacctcccagccctaggcaattaccagtctactttgcctttgtagatttgccaattctgacatttcatataaatggaataatacattatgtggcctttgtgtctggcttttctcacttaatggagtgttttcaggattcatccatgttgtagcatttatcagtacttcattccttttactgacagaataatattttattgtatggacatacttcattttgtttattcatcggttggtggacagttggattgctattatgaggaatagtgctatgaacatttgtatacaagcttttgtgtagacatatatgttcatttgtcttaggtatatacctaggagtataaatgctgggtcctgttaaactgtatgtttaaccttttgaggaagtgccaggctgttttccaaagcagttccaccattgtacaccagcaatctatggggattccaattccttcacatccttgccaaaacttatctattttttttgattgtggctattctagtgggcatgaagtgggatctcattgtagtttccatgtgcattttctagtaactaaaaatgtgtattttttcatgtgcgttattggctatttgtatatctttggagaaataactattcaaactctttaaccatctttatgtagtctacatacaagtcctgtattacatatataatttacaaatatgttttcccattagtttcgtagtttaaaacatgtattcctaagtattttattcttttttgagtctattgtagatggaatatttcttaatttcattttcagattgttcattgctagtttataggaatacaatagatttttgtatagtgatcttgtaacctgcagctttgctaaatttgtttattaatgcatagtttttagtggattccttaggattttctatatacaagatcttttcatttgcaaacagataattttacttttttcttctcatctggatactatttattttcttgcttaactcccctggctagaacttctagtacaaagttgaatagaaatagtgagagtaggcacccttgtcttattccattcatcggggaaaatgtctagtgtttcaccattgaggatgatgtgagctacagtccttactttttgttaaatctcatgattcagttgacagaatcctctagtaacctcgctagaaagtgaccatgacacagaaagtttttgagacctcatcaggggtcaccaacttccttgatttgcctgggattgagagattattgggacatgtgaattttaggtttttttttttttaaccaggttatatctgggtaaatagtttacctaggactgagggaattcccaggatgtgagactaatgctgctgaagccaggaaaatcctggacaaaccaggatgagcttgttaccctgccacatgcctgaaaatgctttttttctatctttatgtttgatcgatagtttgaatctgtagaacttaaggttggaaatattccctgcattcctccattttcttctagcttacagtttgacccttaggaagttgatgtaaatttttttttttttttaagattggtcttgctctatcacgcaggctgtattgcagtggtgcaatcatggctcactgtagcctcgacctcctgggctcaagcaatcctctcacctcagtcccctgaggagctgggaccataggcatgtgccaccatgcctagctaaagtagagatgaggccttgatatgttgcctaggctggtcttgaactcctgggttcaagccgtcctcccatcttggcctcttaaagtgttcagattatagatgtgggcaccatgcctgaccctgattgtgcttttgatatgacaagtcgagtgcaatagtgagaagtggggaaagagtagaacaaggagtttgctcgagtttaaccttgtgctggtacttgctcggcctttaaagctgaagattcatgtctttcatatcagaatttaagaaatttccttaaattctttctggttatctgctttcctttattttctttgttctctagttcttcagttattcagatatttgatcactagtttcatttttctaattttttttttcctatatcctgtgtctctgactttttattctttttgtggggaaaacccacacatgacttcctcggctatgttctctaatcctagtgttgaggttttttttctttgctatcattattagtttctaaaagctcttttcttgttttctggaagtgattgttattgttgtttgtttttttgtttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgtattgttgttttttaagcaatattctttacttgtttcaaggctgcaaagttgtgtcattgttctgagcaggtagacacatgctcttatgtgctcttacacgtgttcttacactcacatttacctgcactaatgcacactcacatgcactcacacacacacttgcgctgtcatgcacactcccaatgcatactcacatgagctgtcacacatatgtacacacacaatttctcacacacatgcctgaaggattgggcttggagggaaagagggaaaggttttgtgtgaggagcttgtggaagaggtagcagtcctgggccagactggctgggaggatgcagtgagctgggagatgtgcagtgatgggaagaagtgaggactacaggccttgcaggaaaacaagcctgatccccaataagacatggtgacagatgagtgtgtgaactgtggatgagaaaggaccccgtgcagtgccatacacacgccaagtattgttgctctttatgcacataagaagcatgtgattgacttcagctacgagataactgagatgtaagtgcaagtgaccagcagacagttggaaatgtagtctgaaatttggggaagagaagcagaagttggaacttgatttgggagtcagcatcttacaagtggtagttactgtctctgaagggagaaggatagaagtcaatgctcagatgggagaggtccataattatggggcaattaagaagaggagcttgtaaagaaggacaagataaagaagaaagcaagtctgagtattccaaatcaaagatttaaaagaaagggtgtgtgtgtgtgtgtgtgtgtgtgtgtgtgttttgagacagggtcctgttctgtcacccaggctagagtgcaatggcatgatcttggctcactgcagcctcgacctcctgggcttaagcaatcctcctacccatagcctctggagtagttgggatcacaggtgcatgccagtgtgcctggctaattaaaaaaaaattttttttggtagagatagggtctcattatgttgcccaggctggttttgaactcctgggctcaagtgatcctcccgccttggcctcccaaagtgctgggattataggcatgagccactgtgcccagcctaaaagaaagttttgagaaggactcagtctaacctgagctgaaaaacagttgaaaggatcagtttgccagttcacagttgccaggtcacagaggcagctggcatagctcacggaggtggttgaggttagcctcagtggttatatgctatgaatgaagagcagatgaaaggattttaattcagtcatttaacaataatttgaccaaacttgatactggtaggaaggtagaccaggagatcattctattcttgtgctctttgccaactattttgacatgggagtttttatttttttatttttatttttgagacagagtctcactccgtcacccaggctggagtgcagtggctcgatctcagctcactgcaagctccgcctcacgggttcatgccattctcctgcctcagcctccccagtagctgggactacaggtgcccgccaccatgcccagctaattttttgtatttttagtagagacagcgtttcaccgtgttagccaggatggtcttgatctcctgacctcgtgatctgcctgcctcggcctcccaaagttctgggattacaggcgtgagccaccatgcccggcctttattattttttttgaaacaaggccttgctctgtcgcccaggttggagcgcaatggcacaaccacagctcactgcagccttgacttcccaggctcaagccgtcctcccatcttagcctcccaagtagctggaagcacagacatgcaccaccaccctcagctaatgtttttatttttgtcgagatggggcctccctatgttgctcaggctggtcttgaactcctgggctcaagcaatcctactcccttggcctcccaaagtactgggattacaggtgtgagccaccacgcctggccaagcttttattatttacatttaaagatgttttaaaatcccagcattttggcttgtgacgttcacctttcctgtgtgcctacctttcctgcagcttactgtgttgtttgtgtcagatattacctggatctgtgattgctgagtagaagtgctgctattcaaagccatggaggtcctgccaagtcttaacaccgttttaaccttcatcttggggttagatgtacagagttataggagcaggaaattaaagtccagaaaaaaattcttaaaaatgatttagtgctttctcctttgggttggaatcctgtttctagcaatagtgagcttatcttccaaagaaaccactatgggattctatggacattgtttatttattattatttatttatttatttatttatttatttttttgagatgaagtctcactctgtcgcctaggctggagtgcagtggcacaatcttggctcactgcaacctctgcttcccgagttcaagtgattctcctgcctcagcctcctgagtagccgggattacaggcgcacgccaccatgccccgctaatttttgtatttttagtagagatggggtttcaccatgttggccaggctcgtctcaaactcctgacctcaggtgatccgcccccctcagcttcccaaagtgctgggattacaggcgtgagccaccgcacccggccaacattgtttatttttaaagtcacttcttcccagccgtctgagctgttatgtggaactgtcctgtgcctccataacagtaattgggtttttgggctgggaacagaatgtccctgaaatccaatgctgacttttcctcagaattgcccagaacagcaaagatggaggaagtcaatgtgcaaaggacttttaaagcataatagcaaaggagctacagtttagtgaatttacatttatggcccaagtgatatcaaccttttgtgtgtgtgagttctgtcttaattgagtcacagagcagccacatggctggttcttgtcacctggcgaggccagtccctcactccgatggcctttcctggcttctgacttgattatattttaaatcaaaccactcatcacaaatgagtgatcttatgaccattttttcctctcccaaaaacatttagaaggaggtacggagtcagaatcctgagcccctgtttgcctgcagccagctcctgtgctttgtcggcttcctgggattcatgcccatcccaggaagaagctcctgtgagatagtcctggtggagggcctgtgtcttcagcgtgtccacaccctggccttgcctgcttaaatgagtaaaggagtcccttctcttttgtctctgagactcttgggctctgttgccaggctggagtgcaatggcacgatctcagctcactgaagcctgctggcctcaagcagtcctcttacctcagcctcccaagtagctgggggcgtgcgcccccatccccagctaacttttatatttttgtagaggtgggttttcgccatgttggctagactggttttgaacttctgagctcaagcgatcatcctgccttggcctcccaaagtgctgggattacaggtgtgagccactgtgtctggccatccctgggactctaactcctgttggcttgtccctgggacttgggatgggctgtctccctcctgggctgcccttgactctggtttgtatttagttttgaatcaaggcagccaccatcctcgtagcacagggaggacatttttgccctcatcagtggtactttctcttgactgtgcttttttttccttctctatagatgacttttctccacaaatggcctttgattttattcatgagatcattcccaacatagtgaatactttgttttgttttttctctcaggtgactctgtcaaccaccaaatactaactctggcttcctttcctctttttatccttcctctttgcccaccttcttttcaacttagtccattttgttttcttgtgtactaaactgcatgtatttaaagtacacagtttaataagttttgatgtatgtacacccctatgaaaccatcaccacaatcaagctaatgaacagtcatcacccccagaagtttcttcggaccccctcctgctgcccatccttccacctccattcccatccttaggcaaccacggctctgttttctgtcacgatagattatatttcctagaattgtataaatggaatcatatagtatgtacattaaaaatttatttagtttctgaaaattgcagtacaatacatataaaatttaccatcgtaaccattttcaagcgtgcagctatgtgacattaagtacgttcacattgtcatgcaaccatcatcgccattgagatcgaggacttttaaaagtctgttctcaaactgaaactctgtacccatgaaacagtgactccccttccccgtgctcccagtctttggaaaccaccattctactttctgtctctatgaatctgactctctgggtacctcatgtaaatggaatcatatagtaatttttgtttgtgtgcctggcttatttcacttagcataatgccttcaaggttcatccatgttgtagcatgtgtagaatgtccttcctttttaagtctgaataatccatcgtatggatatactacattttgtttatccattcatccattgatggacatttgagttccttccacctttcagctattgtaaacagtgctgctgtgaacatgaatgtacaaatattcagagtatatactctttttagtctgatttctttcaggataattatttttaggttcaaccgtgttatgtatatgaataatcaatttcttttttattttttgtctattcatctattgattaatattgggttgtgtctgccttttggcagaacacaaatggtcaacaaatatgaccatttgtgctatgaccatttgtgtacaagtctttgtgtggatggacacttcatttctctgggtgaataacctaggagtagaatagctattccatatgtcaggtgccagattgttttccagagtactgtatgctttacatccccactagcatgtgtcagttccagttgatcttcatcctaacatttagtgttttatttttttttttaattaacatttttgttttaagatggggtcttgctattttgcccaggctggtctcaaactcctgggctcaagtgatcctcctgcctcagcctcccagagtgctaggattacaggtgtgagccagtatgcatggccagcatttggtgttttaaatttagacatttcttggccgggcgcagtggctcacacctgtcatcccagcactttgggaggccgagttaggtggatcatgtgaggtcaggagtttgagaccagtcttgccaacatggtgaaaccccacctctactaaacatacaaaaattagctgggtgtggtagcacattgcctatgagcctgctactggggaggctgaggcacgagaatctcttgaccccaggaggtagaggttgcagtgagctgagatcgcatcactgcactccagcctgggcgataaagcgagactctgtgtcaaaaaaaaaaaaaaaattagacattcttataggttcagtgtggtatttcactgtggtttgaatttgcagttccctaataagcaataatgttgccctttatattttctttgatgaagtgtcagtggaaatattttgtccatttaaaaaaattgggttgttttcttattattgaattttgagagctttctgcatattctggatctgagtactttatcagatatataatttgcaaatattttctcccagtctttggattgtcttcattttcttcacattgcattttgagtagcagaagttctttattttgatgaagtgcagtgtatcagtttttttttttttttttatggatcatgtttttggtgtcatatctaggaaatcttggcctaactcaaagtcacaaagattttctcatatgttttctattaaaagttatatagttttaggttttatatttaggtctgtgattcattttaagttatttttagtatatgatgcaagatacggcttgaagttccttttttgtgtgtgtatggatgtctggttacaccagcatcatttgttgaaagtactatactttcttcactaaacttttatatgtttctgcccctttccttctgcttctttgcatagtaagcctcctgtatccaataatcttctcctgctttgttacctgtcaagcacattattcccttttattttgccctgtgccttccttctttgtcttcagttccacccagtccttgtcttctactcttgagctgacatcagcagtttgatttctgcctttatgaatacagtggctttctcacaagctatggacaacttccttggggttagagtgagtggtttgtctttaggtttccctttattgatctcctctgatatttgatgccatcaactgtcccttttcgttgaaacacatgtgtttggcttctgtactttcctgattctcttcctccccaacgattagtctttcagcctctttcttaggctcgtcttgtttccaccccttaaacgtgggtgttctcaagattatatctataatcagccctttcttctttctgcagttttctcccttggagagctcatccattcccagagcctgaagccatacatctgtgattcactctgacctctgttccatgctctctaccactccctgtgtttggtcctagtttaatttggagtttagttgtcctaatgttctgtagatctaccagcttcctgacctcctttctctaggaagagttctaccattttcctcattgcccaagctcagggcaccttcttcccttcttgcttgtccaacatgctctaaatcatgctatcactgtgatttcccttgatattctgaacaaaatgagcacatccttaggaagcaagacctatgaagtagtttttttttctctctctctctttctgtattcttttggagtgggagtgggagagtggaggcggcaggtggtccatgtccaacttcctgcctgagctggagcaggggtctggaggtaggttcttgtggctactgatgcagaacagcgactcaggaaggtgtcactcagcttagactaaatcattctttggagacagttcccacatctaagtggagttttatttcaccctgatgttaacattaactgtggctctgggtgatgatcaggaaagctgaagaagcttctgtcagtgccagcaacattgagaagtataccatcatcatttgtgaattaagtgtaagacagaattacatcacagttactatctctccggcgcctcgggcaggtgttctgggggctctgtggaaagcctctagttgggtcagtagtcactctccacatctcctctgtggtcctcaggagtgaccacagacagactgatgaaaaggctgccctggctcttagaggacttgccactgttcgtgttcactgtgtgctgcacagaccaggaattaatttcaccttctgcctcctagactgttgaaattgggacaggcaggcagccgtgcagcaaaggaaatgagagaagcctattaaggccaaggagagtggaggctgaaggcacatgggagtagactacagtcatgccagtgagtatcaggaagctgagtactctgtggggaagcctatgttcagctaccaagtgtggtgggtgcaggcggcggcctgacaggtgcattacagcctgaagaactggggtgaggccagaatttggctcagccacttagggtatgtgactatagaccattcctttagcctctgggagcctccatttcccagagatgacaatttccaagggtgtggtcaattctgtgtgcaatcctgtgtggccagacagaggtgccccttgctgatggcctgtccctttttcttattcccttctaattgatgtcatatgtctcttgtcttcatgtgaacttgatatcacctaagatccatggctttgaggaaggctaatgcaaggatggtgtttcagttcatttgggctgctgtaacagaatacttgagagcaggtgtttatacaaaattttattttcctacagttctggaggctggaaaatccaagatcaaggctctggcaggttcagttgtcaagtgagggctctctgcttctaagatgggcctgatgctgtgtcctttggaggggtggaatgctgtgtcctcacgtggtgacagggacagaaggggaagagagctggatgctgcgtgaagcctgtttaataaatgccttaatctagtcataggggaggagccctcataacctaatcacttcttaataccgtcacattggccattaagtttccacacctgaattttggaggagacacattcaaaccatagtagatgggaaacatacggaaactttctacagaagaccttcgttacagtgtttgttggcctggggcaggctactcaggctcgtcacttaaagaattatttttattgtcttcctctggagacttttggttttgtcaggtgaacgttgtggctgtcaaacttgcacggaccatcccatgctgagatgggacttcaataagtgcgttaacagataggtatcaggtcttcttctcctaccaggcctgcccctagggaatgaaatggcctcatggcgaagcatctcttggttaaggctcttctaaggcaagaactaattgcttttccttggcagcccaagtaaatgttctctgtgagaaatgactttctgacatttgtttcattgtggctgtacttaccaaaaaacttttatataattcactacagagaattctcaaatgaatgtaatgaacattgccagaaactgggctggatttctgaggcattgttttacttacttattttttggattttcagtcaaatcatataatcatgtttgatggagtatctagttctgccagttaaaagggtaatagtatggggattgctaatttacacattagtcaaaaatactcctttgaaacactttttaagggaggcaataagaagtgactattatggcttgaagtgagatacgcagacagccccctacccaaatgtcagatgtaaactaacaaagcatggtcacaccctgggcattggaaggacctggttggccagcctggggcctaggttttggggcatccctgccagccatccagccaccctcagagcaggcgtgcctggaggatcttggcccatttatatgcagaagaggatcaaattggctaacaccaaggctttataaatagtaggactgtttctccagcctgtcttcattctgttcacagctaaaatttcctggcagcttgtaactaatgagaacggaaaagtactgtttgcagagatttcagctagctgacttgaatgctcccatgatgctttgtcactgattgttgtacttactgctctctggggtggccattcccttccaagttgagctgggtctcaggtaatgaaaacagcaactctttgaccaagaccctaagatggtcacaaggaaagcccattttgtcctcatgagagtatgactacacacaggctctctggctgagaactgtgacacccagaggtcacaggcttggctaaggatgtctataggacttgaatagtccagcctcatgtgtcaattggggataatgtttggactggcatagacccataggtaagtgtgcagtaatgtcagctacagctaataggttgtcttacctgagctctgcactacttctgcaatggaagtgttgtttccctgactttactgatgagcaaagcggaggcttagagacacaaggttgtatcaccaactagtggctgggcagggatttttgactccagagtctgtgtccttaagtactggtttcggttctcctttatctggaattcttgaaagatgtaccttgcattaatcaaatcagacacgtaaaacctctttgccttggtttttcactttctcattagagaactcattgcttcatagagctttacatcagctgaaagttgtcgtaacggatttccatgcagtgtgtgtgactgtttgtgttgtgttcatttctgtctagatacaccttccactgtgcacacctgtgtgcacacacacaacccacccctcctcccctccaaaaacaaaacaaacaggaaaaagaccaaaaacagtcattgcggatgtggagcaacctgcagagaccttgtgaggcagatgacattggaggtcagcagttgagaaggggcaagcacctggtcagagggaggaacctgtgcaaagaaatgataccattaaagggatgctgatattcctgtgttcctaggggaagggagtgaacagggatggggctggcagggaccacactgtgcatgtctctgccctgccaagaccctgattcatgctaaagaattggggcttatctttagaaactggggcaacttatctaactcaagagtgtttgctcagatttgtcagaaagttaataggcagcagtcagtcagggtggacaaggtaggggatgtagaaaggatacataccaggcagctgttgcagttcaggggtgcatgtgcggaagatatagagatagcactgtgttctttggagtgtaaggggcaggcagcaggaagggtcagccaaaggaaaccagtgagttggaggagagggagaacaggtggaggtggagcagagggagagcctgggtagtccaagggtgggacattcatgtcagatgttgtggaggtatcagatggacagaaattcagaaaggcaagtttggttatgatacttggaagtcatttgtgattggcagagatttcacagtggggcatattggaaggtaaggtgggaagaaactgactcaagatgtttcgctgggaataaaaggaagaaggcagcagcctgaacagaaggctggttgaaagaagagttgtgagtccttgtgtttgactgattttaaggaagagtgaggcatgaggcaaggtatcagtgggtaagaagggcttggggatccaagagaccaagtgatacttacggcacagggtctcacagaggggagtgggagcttctcccaggcctacaggactcagcattactgatagtgggtgcgtgctaattaacgttaaagttggggtgttatgtaagtattcaatttgtagaggagttttgctctgtcaaagtaattctttgctttaccaaaaggacttagtgtaagattctattaaatagcaaactcgagtttgttgaggttttctctttgtgaatgtatataaatgctgcacttgtgtgaggcttctcagggattgggccctgtctcccagccagaaaagctttctgttctttacatccaccttcccctgtccccaggcctgggacacctcggacaggtcttggagggagcaaacctttgtgattatctggatgctttctcagaaagaagaggggcagaggggctgctttactttttctggctttctctttttagatttacaggccaaggaacaggtgataggatgcctcctatcctatcatctgttgataacctgtgagatgagaaggttaaagtggcgggcagggaccctgagtctgtagccctccttgcactggcctgagccttctcattccagaaattctgttctcaatacagcaaaccttcggttttgctcatagaaaaagctctagccttttcacatgatagcgtcttttgaagctgagaggtatccaaatgcattagtcttagatgaacacacctggaatctcacttttatgagaatttcatagactatactcttgaattccagttgtacatttttgcttgcaaacacaggcatttcagagtataatgagaggaggctggtgctcataaagaagactgactttacagtaaaccacctcccaggagaactgaagatggggcttgagctgaggtggggtctcttctccactatcccgagcagcacctgggccccaggtcttcacctagacagtcaaggacctcagcctaaacagcatccagctcttagaagtcctgtgaaattgggccaggcactgtgggtcacgcctgtaatcccagcatttagaaggaggctgcggcaggtggatcacttgaggccaggagttcgagaccagcctggccaacatggcgaaaccccgtctctactaaaaatacaaaaattagctgggtgtgatggtgcatgcccgtaatcccagctattgaggagactgaggcaggagaattgcttgaacccgggaggtggaggtagcagtgagccaagatggcgccactgcactccagcctgggcgacagagcgagaccccatctcaaaaaaagaaaagaaaaaagaaaagaaaaaaaaagatttcttgtaaaattgaaaacaaaattcagactttggctacttgaatcttgtttaatgtaataggaaagctgataatttaaaggtaacaagttgtggaatgtcttctttaagattagcatgcagtctcattgtacctgttacctgttctttttttttttatattgaatgtgttcaaagctcatcccacctgtatgcagagtgtgttagaaactgtgctggatgtggttgttctctttctagaaggtagggctcccatgacagccatataggttctcttggttgcataagtaaacataaataaaccagtaaacaaaatgcctgctttctgtgtgaatacgttgtcatttgatgtcatggtgttaagtatgaaggtgctataaagaaaaggggaggccaggtgcggtggctcacccctgtaatcccagcactttgggaggccaaggtgggtggatcacgaggtcaggagatcgagaccatcctggctaatacggtgaaaccccttctctactaaaaatagaaagaaaaaaaatttagccaggcgcagtggtgggcgcctgtagtcccagctactcgggaggctgaggcaggagaatggcgtgaacccgggaggcggagcttgcagtgagccgcgatagcgccactgcagtccggcctgggccaaagagtgagactctgtctcaaaaaaaaaaaaaaaaaaaagaaaaggggagagtccgcccctcttgtagttagggaggaagttcaattttgttaaagacttgagggtaagaggaaagtaattcaatgagtgagctgagacagaagatgaatgaggcgaggtgagcctccatcttgtcacttgtcccctcccatcttcagccctcgtggggctgaagtgattcagcctgagtgtccttggccctgccctgggtcccccaggtgcatactctcctgcatgtgcttacaccctcaggcttgcctgcagtctccatgctggtgcccccaaacagcccctggaactacttcttttggcattctgcagtctactctccatgtggcagctgtgcattgaccttttaaaacaaccaaataacattgttccctgtcccaaccttgcagtgatttgcaatcactttttaattaaattctgaactctgttttaaaaagccctatgctgatcttggctagtaagatagcttctcctctttgatgataacaatattatttgtattaataatctacatcagtaaaaatattaatgatggtgacagtgatgactgcagctaacacttactctgagtcgtacactgttctgagcattgtatctattcactcattaaccccaggaacatctttgaggaaggtactcatgtgctcccattttgtaagttttataaatgtgaaaatggagatatgaacccaagggcacagtgagttggaggcaaagatgagccctgagccagtgctgtggctgtggatcaaggagtttgtgtgggacactgtctaggctgctcatctctgtggtcttcatagctggccctgtcttgccatttatcagagttctgtgtgaatgtccagctcctcccaggggccttctctgttgaccagaggctctgagagccacttaatcacttttgattaactccaagtttgtaagtcccacgttgttcccatctgtgtcctgggacctacaacagtaaggttacctgggccagtactctttgagtggcaggtggggccggctctgatgtgtgggctagctatggagccctgacctgaagcctgggatccaagtgtgggtagtcctagctgcgagggtggcacagagagtccagagactgaacagaggctgggcagggcgggtagacatggcgagtctttgactgggctgtatgtagggtttctgatgcttccatactccaggcagaataaattggtgctattgttggcgggagcaaaattggacaatgtggaattcatttctccctggaagactgggtggttcttggtactgaaagtcctcccaggatataatatcttcaagaaaacaaaagataacctcactagtcatatcaaagtagtttagtctaagaatccctaaaaatccagtgttgtcatgctatgagtaaagctaagaaaccaacatgacagtgccctccacatactgactgttgtgaaaacacgtcttgttatttttggaaagtcctcttggtagaccactaacattttcgcccccaaaacagcaggagcagtaaataacaaccttctagataaatcaaatgggaaagcattgccagaatttgctatatcaagtgctgtgaatagtggcacccagcagggaaattatggagagaaaagtgcttttatttgcttttcaaagttggtgggactgtgggaatatgggagatgggaagaaaaggaggaaaaagagaaaaatactgtcatcttgagttgaaaatgggtgctaaacctttttgcttaggactgtgattcagtatcaagggaaggaaactgttaactcaggtattactaatagcctcatgttggtgagagagagagctcacatgcaagaagactaggtaagagcttatgagtctcacaacaggctaagaattgggatcattattgttcccattttatagatgaggaaattgaggctttaatgagatagaggaatttgctcagataacacacctagtatgagctgaagcccaggattcaaactatgggctggcttcaaccccatggtctgaattgtcacagctgcagacttaaacctcctcccctttccctctctttgagtgttagttggcatgatatatttgtgaaaactaactaaaaccagaaaaatcgaaaaaaaaaaatcctgtgtcaagttagtaataatgatcacaggcttttttttttttttttttttcaatttttctggttttctcactagttagtgtcccttttctattccagaattaggtccaggagtcaccttgcatttaggcattatgttctcgtcaccttcagtctgtggcaatttccatcttcttttgattttcatggacgttcacacttttgaagaggccaggtatgttgtagaatgttcccaatttgggtctatgtagtgttttcttatgattagactcagggctatggatttggagaggaataccacagaggtgtcttgtctttctcatcatgtcacattggaggtacatgatgttaacatgaattattactgtgacgtttgcttggatcatgtggctgaggctggttggccaggttcctccaatgtcatgtgcccgttgtcccctctctgtaccctgttcatgagagccactaagtccagccccactgaagggcggggcattaatcctgcttcctaggaggatggaggagtttcaaattatttgttaaattcttagcatatgttaaaaccactacaaggaattgataaatattttgggggaagatactgacttagagattatgcaaatatcctgtttccttaaggtcctactgatgttagttagcatcatcagtggctcttggcaattatgttttaatggcaatttcctatttccctcattccttctacatttttaattggacttccattaggaagatttgtccccttccctcatttgttcattataatttattcagttacttatatcagtatggactcatgggtggttcatttattctttgctactgtattatttattttgccccccacactgttccagctctggccattgtggcttctgagttctttgacatctttgcatccccctaccccctccccaactgttttttttttttttaagcacttccttactttttggcactacaggattctctgggtttatcttgtattttctctgttccagtcctagaatcagccattgtccaaaggaattgtccagggagcccaattccctttattgaatggtatttagaaaccaagatctgggcactcagagggcacgtggctcctgcttctaggccctgtcagcagaccaagccaggacatggatgtgtgtttactaccccactgtgacacatacctcttttttacctctctacctggatgtataggaactaaacatgagctgtcacctgcatttaacaacctcttttaataggtgagttctttgtcatggagtagatgtgtccctgacaaattgttggccaacagaatcctgtgtcctcacttctgttgttgctgtggttatgagcccccagtttttcaccttcttccaatgatgattggtatgtccttctttcccccaggccacccgctctcactgctcagtgctcactcgctactcctcctcctgctgtatgtttttgagttagtcatcctcatgcactgcttgtaattgctgttgtgggcccctctgttagttcattgcctcactggcctcctcttcaccgaggtgtagcaagaacttctgttcttacctccttttctatgaatgtgataggtttttatggccagtggcttttaaactttggctgcaacctgtagttatagtgagaaatacatgttaacaaggcttccaggtatgcacgtacctgcatagtggcagtttcacaaaacagagcttgctctttttctggcagtgtatcttgcgtatttcattccattttattctgttctgctctgctaaggagattttatacctcccctttgaaaaatactgttctggggactaaatcctccagctgtgtatagaagtctacagtccccttctcttagcactctcttgatatgagggtggggtgtggattagcactgggtatagggtggggtcagaattagcactgggtgtggggtggggtgggggggtcttgattagggctggttgaggacagtctaggattggtgcaacgtctacaaggccatgattttgaggaaagggattcagaatctagggtgtaagctgtggatgaattagaaagcttccaagttttctctacttctgaaaaggacatttttgagaaataattgtgtcattggtatgcatcttttttgatactataggtactataggtttgagtgttaggagttttctttggcctaattttttctcacatgggaagtcttttgagaatttaaatagtaaagctggtcttaatttttctgattttgaatgaacaggaaaataaaattgggtaaagactaaggtaagatacttacataattctgaatttttttttaagagatgggggggtctctcactatgttgcttaggctgatctcgaactcctgccctcaagcagtcctcctgcctcagcctcctgagtagctgggattgcaggcgtaagtcactacacccagcttagttcagaattcttatattgacatatttatggcgtagattatctaattttgttttaaaatatatatttcacacttaaatactgctaaaaaattaggaagcctctttccctcattaaaataacacaatttaagaaaaaactcactgtacaaacttccatttttactaagttaaagtagttttatagtaaatatactgatttttgttgatgttggctgaccatctgtcacagattgtcaaaagtattccctaaatttgcatttaaatctatcagagtattagtgggcatattatcagtgactccaagtatcttgccttatttattttcagtaaatatagaatcatctagttctttttaactgtagctacaaagttaattttaaaatgtgaaacacattttcaaatatacttcttaaaagaattttttattaaaaggagccttcctgactaatcaaacagtatcagtggggctgccccaacccctgtggcccccacacaggccagagtcaggtcagtgacagggtagtccctggggtctctctcctctgtgttcctcagctggactttaaatggcaaatacagaagatcagcaaaaggcaaaaattggttctttgaaggaaaaaaaacatcaacatagacgaacttctggtacaacttattgagagaagaaaagagaatttacaaagaaacaaaggtcgaatggtaatggccaggtgtggtggctcacgcctgtaatcccagcactttgggaggccaaggcgggcagatcatgaggtcagaagtttgagaccagcctgaccaacatggtgaaaccccatctctactaaaaatacaaaaattagccaggtgtggtggcacacacctgtaatcccagctacttgggaggctgaggcaggagaattgcttgaacccaggagtcagaggttgcagtgagccgagatcgcaccattgcactccagcctggatgacagagcaagtctccgtctcaaaaaaaaaaaaaaaaaagaaaagaaaagaaaaaggggtaataacaagtagagaataaaaaaaaaaattatgagagcatattggtagaaaaatgatgtaactctcttttagactttaaggaaggaaggagttctgagtatataaaaatgttaatgtgaataaagattggtgcgtttgactatattaaaatgaagaatttgtgttgaccagatagacgtctttaaagtatgacaacaacttataactagaaagaatttgtaaactgtaaaccaacaaataattcttatccacatatataaagaacttctacacatcaaagaaattacagacaaaaatagtgaaagacatgaactggaatttcacaggtgatgagacatatatgaccaataagtatatgaagagctgttcagccccattaataagcagagaaatgtgagttaaagctatattgagaactatttttatatatatgtaattggcaagattgtataaagtctgacagtacaaagcatggatcctgtagttctgtagcatgacccactttgctggtgagagtaaattggggcaatccctctggaaaacagtttggcattatctcttaaagttgtatatgtatatatcctttgacctagaagttctgctcctagttgtatagccaagacaaactctttagattttcagaagtacacaaaaaggagggaatagcataatgaacgcccacgaaactttcaccctgcttcatcacttagcaacacgacatggttgttgtttcatctttctccctactctcagacttttggttttgtttttgatagaacaaatcccagacatcatgtaatttcacccgtaaatacttcaataagaaataaggacttaaatttaatataattatcttatcttacaaatttgtaattccttaaaatcatctaatacccagtctatattcacattttcctgattgtctcaaaaaatttttttttcttcaaattagcatcccagcaaaggtctaaacattgaatttgatagatcttatgattcttaatttagggtagttccccttctcattttttgtcccatgccacttatttgtccaaaaaacttagaacttagcctgttataatttccctgattctagatctggctgactgtgtgctcctggttgtgatggccatgcttctctgcccctcgtctttattgtaaagtggtattcagacctgtaggttggaatggattcgaggtcctgtgttgggggcaggggtacccaataggcaggccctctcaggaggtacatggcatgtgtgtcacagatatttggggtgttctggatccttctgtcacaggttcctcctcagcttttcacctggtgcccaccaggaatgaatgaaagttgccagactcattgccttcattacagaagatggtgcaagatagtgatgttctcattgtgttttacattctttgcttattatctggaattcttatttaggggcatggcctttctgaaattacagttcctatggaaccattttattgatgacttttcaagttgagctgttctctgatcaccaaaggtgacccctggagatttcgttttatgaactcatggatttttcatatgctacgtgcttcagtccattgtggactttatttatttatttctgattgtcccgtctttggccagcagggagccttctgaaattggctcatgtgtcctttcagcatgaccctcctggtctttgacagttccccacttgtaaggaagacggctaggcttaccgtgtgtgttctggtcccaggttggggactagctacatctccaggaactctggctctcctcttggtgagttagcattgtctttaaagtaggcaggctactgtcattgcaagaccaaagtgtggtagatgctaaacagataacaatcaggtattgataaaattattgatactagatttttagaaaaatctaaaaaaagtgtagaattattaggcaataaagaagtgtagaattactaggcaaaagacataacttctctctccaaatgtctcagagggttcaagaatcatcccatagtcataaaagctgctcagtgagttctttccatagccaaagactttctaaagggaaagcagtgagtgagaaagcaatactgagtgtcacgagaccttgttttagtcattttaaatggtttgttcctcacagctaccttttgggagagatgctattagtgttcccattttataggtcaggagaccaaggcacagagaggctgagtgacctagtcaccgttacctggttgctgtgcggggaagctgggcttgacctcaggttggacaccacggacacacagagcattcagggaaactgcttgactgctaggggactggcttggagacattgatttgtaggacatacttgagaccagagcccgtggcctggggtggctgcttgctgcattggcatcaaaccttttgtgtgtctggctgaggtggcagggtatccacagttggcctgatattgcggggcgggggggtcacatccctgctagtaaagaagcatgaacttagaaataatgcatccacaacaatgaaaggagcctggcgggtaggggaacctcagtgagagctgggcagcaggcagggaggcaccaccctctagacagacgaatctggcaagagttgcaggaaggctggttagtgtgaggtgcttgtctgtgtggaagcctgggagtagtgactggctccagcctgtccctttgtaagtgaaaaggttgaaggctgcagaggccaagaccaaggcccaggctacgtctgggttgctggcgttggggcagacctggcagctgggggcccagggctggggtccaggcatcgagtcatttttgagcactgaaatcagcatgagtggacgagctctcaggagtgaacactcctaggaagataaaaccgagaagtaggaagtgggcctggcagaccatgagttttaggcttcagaagcagggcagtgggcctcaaggatgggtcatttttataataatgcttattttgtaaagctttgaaaatgaagaaacccagaagaaaattcaccgtatttccatcaggtggaagaaatcttgagttgagattgagcataggcagagaagagttgacagatgaggaggaggattcatttgtgggagcaggaggaaaaagggaggaaggagtcatgacgactcaatcatgggctacctcgagtgccttgctgaggccctggccttgtctcctgggccgtggggagccatatgaggttgttgagaataatgtaatcacagtggcatgtgaagaaactgagaagagacgcagccatggctgccatccaggtgtgggatgtgccaggtcagtgagatgagaagaaaattgataagagacaggtgagaatttcaagggagggagtgagccatgtctgctggttgcctcatacccatggcacgtacatcacacacatatatactgcgtgcccatactataccttatgcacgcatatgcacactgtgtgcatacatgcataccacacacatgcacatagcacacacacactgcatgcccacatgcaccacacacacattgcatgcacatgtgcaccacacacatacaccacacacacaaactgcacacacagtacatgtgcccacatgcacatgcaggtacacatgcaccagccgcatgcatgtggcacacacacattgtatgcacacacgtaccccacacacacatatagtgcacacatacttttaccacacagtgcactgcacacatgccacacacatgtactatacacacacacacacatgttggcctagtccatttgggctactataacaaaatagcatagcctgggtagcttctgtgagaaatttacttctcacagttctggatgttggaagtccaagatcaaggcaccagaagattcagtgtctggggaggccctgcttcctgattcatggacctctgttttcttgtggtgtcctcccatagtggaagggatgaggaagctctttgaggcctccatgtaagggcactaatcccactcagagcctccaccctcatgacctaatcaccttctaaaggccttacctcctactgccatcaccttcggggttaggatttcaagatacacgttttaggggaacacaaacatttcagaccctagcacatatatgtacattgcacccagatgttgtgggacctctcctgaggggacagtgaggtcaacaggtggtgaggtgtgatgacagctcttacacctgggataatggaaggagatgagggtgacagggatgttgtcatctttgcacagagtagtggcttttgcgcaatgtagttaagggcaatgtagttaagagtgtgaacatttaaagggtagacaggattgattgcaagagacatgaaagaacagctgtatttggggtggtggagagggggttgacaaaccgggcctcaatcactgagccccagggggcgggaagtggggagcagcaagcttgacatttctgtgcaaacacctccgctttggaatcactggctgtgacttggggagccaaaccttgcctttagtcaggcagtcagtgcctatcataggcattctctctctggagaagagcttgaggtcagcccttgtctcattgaattataaatctattataggtttggggctctagcttcctagacaaaactcttcaggttaggtctttgacctccttttactcttcattttacatacttgccactagctttttgaaaatcagaattgtctgatcctgttttgttttagagacagggtctcattctgtcatctaggctggagtgcagtggtacaatcatagttcattataaccttaaacgcctgggctcaagctattctcccacctcaaccctccgagtagccagcactacaggtgtgtgccactatgtgtggctaattttaaaattttttgtagagatgggtcttcctacgttgcccagactggtctcaaactcctggcctcaagtaatcctcctgttttggcctcccaaatcgctgagattgattgcaagtgtgagcctagcctaatcctgtggtttttaaaaacaaatggaaggaggctgggcacggtggcccacgcacgtaatcccagcactatgggaggctgaggcaggcagatcacttcaggtcaggatttcgagaccagcccggccaacatggtgaaaccctatctctactaaaatataaaaattagctgggagtggtggtgcgcacctgtaatcccagctactctggagattgaggcaggagaatcatgtgaacttgggaggtgaaggttgcagtgagccgagatcgtggcactgcactccagcctgggtgacagagtgagactccgtctcaaaaaaaaaaaaaaaaaaaaaaggaaggagagaggacctttttgtttctagtggcagcactcaaacaggcagattgggtaggtcagtttcctgaccatgagtctcaggaacccggtcagaaacctcacctactcaggaactgcttgtctgcatgacagtgactcctggtggcagtgctgctagctctccctgtgcaggtgaccctggtgcctggcttgccacactcaggagcgcctaggcctgcagtctgccaggaagggtctggcctatccccaaggagacagagggccctgctacccacagcacccaacagagcctgttctgtgtttttcctttaacacatttagaaccttgttatcccagctcatcaggagtgggagctgcagggagacctactccataatcttcaacctgactgctgactcactttcctactcccacccttggtgctgaagcatggatgctccctcccctgcctcctaccatgtgcccaggcctgcagctgcaggggtgaccaacagtggcacagtgggggccagagacacctgcacttgacaggatgcttatttttacatactgttggctggaaataatcaaccttatttaaatagaatgtgcattcagagcactataaaaagcacccaacaacttgcaagggctgttttaggagtgattctcctgcttcctttggagggaatctgcaggttccatgcaagaggagccaggccagggctactgaggacacggcaggaggatggggttaggcaggttctgtgtgatcagagccctttccaaaagcatacagctttactgcagcgtgtagtggcaagggtgtcagatgtcccccctcactcgaaggcagagactgacagccttttgccctggaggaggcagaacccatgtgggcatcactggtggtataggccaagtgactgcactgttgctggcggcagcgtccccaaggatatcccccggcattatactcattctcctttcttgagagagccgtttctttttcccaacttttgaggagtcttcatgtttactccctgatctctgccaagtgctggggccatgttggtcttttgtgtgtgtgtgtgtgtgtgtgtgtgtgtgtgtgagtgtgtgtgtgtgtgggtattttatttatatattttcacaattttgacttttttcaaatggtaatgtatgtacaaaagtgtcaatgaagagaagtctccagtttccagccataaaggtagctgctgctaccctattgttcttttggagatattctctgcatgtttaagcatatttatgtcagatatgagtcttaaagctgctgtcagtgctcacctagaaggatcctgtggaaacttggggtctgggtgagtccccctctctgtgtctgactccttcgtaccctgctccaagggtcaggctagtgctgctgccgtggccgtgggaccgcacctgggtacaggggctgcagggtgcatcactgtctcctgttagcattttttaaagagaaccatttttctcttggctataaaaatgtctacatattctagggagtttggataatacctaggtacaaagaagaaagattcctgttactctactatcagagataaccacaaaaatttaatgtgcttcctttcagtctttttcatatatatgtgcacacttgtgtgtatattatatatttcttcttagaaattaaagtcataccatacttaaaagtaataatacccacttttcagttttatggtatattgaaagctttcttcatattactaaatagtctttgaaaatatgtttattggttgcatctaaatctttcttttgctgtccattttcaacctattgagcattctttagtttccttccccccaccctcttttctcatgtcattcagtcaggaatcctatgtaactcctggtttctgtatgtcatctctctgtcccacagtggcccgcctgtgtgagtagtttaaggctaacatctcttccgattggttagtgcctagtcctgccaatattcagtgctgaattttgaatatcacctctgattgaaattagtttccttagccactgtgtttgctcaggctaccacaataacgtaccacaaaatggccggcttaaacgaaaaatgttgattcttcacagttcctagaggggaagtctgagatcaaggtgtcagcagggccatgttccctctgaaggtcttaggggaagatcttccctctcctcttccagctttaggtggtggcctgcggtccttgacgttttttggcctataggcacatcaccccattgtctccacatggccttcacgtcatctctccaaagtcccccttttaaggacatcagtcatagtggattagggcccaccctaatgaccttgttgtaactgcatcacctgtgtaaagaccctgtttttattaaggtcacattctgaggtcctggggattaagattccaacatagcgttttaggggacccaattcagttcttaacagccactattgcccagcccagaggactcaggccgtggtggaggcccagcttcatgcatagacagtgtgcagggcatacccacagtaggtaaatatgttcttgtcttagaactctggccagagaaagcctgccctcttgaaccaccccttcccaatccttgtcttgtatgtgcatctatatagatgtagatacatgtagttttgtgttttcctgtgtgaaccagatcatagtgcacacattgtttacaagcccatggggccgtctccctgccaggttttgtctgctaatctctgagcaggccctggagaagttgactgagatgcacctactgttggaatgttctgtgttcatagctgctgccttctccatgactaggcttttgtctgtaatttagatcttcagttcactataatggacttgtgagtctaaacttacataatgtttatattattagcattgttacattttatggaaaatattatattttatttttaacatcagcttcttcttggtaggcctatctgtatttagtgctgtgtttataacaggcctatacaataagatttgcttgattgagttttttaggctgtctcattaaacatactgcttatgtcttaacaatgatgcatacaattttaatgcagtccttttagctgtgatttatttactatgaaaaaatagaggctaggggttggattaggattgaagtttagcagctgcaggatgaagtggttttgccttttttttttttgagcagagttttgctcttgttgcccaggctggagtgcaatggtgtgatcttggctcactgcaacctgcaacctccgcctcccaggttcaagcgattctcctgcccaagcctcccaagtagctgggattacaggcatgtgctcccatgctcagctaatttttgtatttttagtagagacagggtttcaccatgttagccaggttggtttcaaactccatacctcaggtgattcacccgcccttggcctcccaaagtgctgggattacaggtgtgagtcaccacgcctggcctctttttttttttttttttttttttttttaaagattgaccctgccaagcagtttataagaaaccaaggactcatgagcctaaggattttattaataagagccctctggttaattaacaggcctggatctcagtactgtgaaggctggcagtaccagctatggtttgactgtggtcacagacacttttcctaaactgtaggatgctgcactggggtttcttttctgtagctttgcccttgtcctgtgatttccatgggtaccatgtaggagggtcagaaaggaaatcacctgaaaagaagaggagtttgcagatgccagagccagtgaacttgagatgaaacttgagttggtcacgtctccaggatgtaggagtggcatgggctaggctgcccatggggtcctctgctcaggcatggctgactgggatcacattttttattctttctcaggattcaggagcagttccagaaaaatcccgacagttacaatggtgctgtccgagagaactacacctggtcacaggactatactgacctggaggtcagggtgccagtacccaagcacgtggtgaagggaaagcaggtaatggccttggcgggtaggggtgggcggcttcacccaagccagtcaaagctgttgcagggaagacccaccagcatccttgagggagtgttgagatcggctttaggatgtgaggtgtgttccttctcctgccctcggaatgagctgagcacaccatccttgctccccttattctgtttgtgaggttctcccagctcttctgcagaaacctccctttggggatggtgaaccctgttcacactgcttcctgagagagaagcccacacatctgatgtcttcacctcttttataaatacagccatagactctcctggggttcctattgtagatggccagcttctcagttttcaagggaatactcaaacattattaccttggtgaattctcttttttcctaaagattaaatctgccttcagtttccctaagaaaagtccagtctactaaacgcacagtgatagctaacatacattcacatagcatctgtcatgtgagtttcctgggctttgccagcccagggtctaataaactcaaattagacaaaatgacacagtgggtagcacctccccgtgtatggtgatgagccatgcatcacagagatgaaaggtttatgatttaattctccacaacctttaatcacaggagagagctctaagactctgcagttctctcagggcaacaacatggctgcacaggagggatggagggagggacaggcccacctcatcccagcgtccccacttgcttcccttgctatttttttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcactgttttagccaggatggtctcgatctcctgacctcgtgatccgcccgcctcggcctcccaaagtgctgggattacaggcgtgagccaccgcgcccggcctcccttgctatttttttatttcctccattcacataggtggcatgcatgtgctgaggataagcttcctgatccccacaccctcttttctaaggttgacttggagtcctctaagggcatcccatccctgccggggccagccacctggtgtcactccctgtgcctctgttactgcttagcggcgtgatgggtaggtctgtagtttgtgcactgataccaaccattctcctttccccaggtttcttttatgcctcctcagggaacaggtgtcaggctgtgggcctttgttcccctcagcaacaaacacaaaatttatttttcttcagctacaaacacccggtcacccccctttaaactacatcaggtcatgggtgagacccattgaagccccatccagtcctgagaggcaaagcaaagaacccaggtcacagcgatgaagtggacggccaggcctgtgtgctgtggggctcttccatggagcagggagccatgtcctataagtaccgcatgctaaccgattgcgccactggagccacaccatgtcatgatgtacctgtaacattcgcaacttgagtttcaaacactaaagtttctgaaacctccatctaatgagtttaagtgagtagacgtttaatcttttttaattttttgatagagatgacctcattctgtcactcaggctggagtgcaatggcatgatcgcagctcactgtagccttgaactcctgggttcaagctattctcccaccttagcctcctgagtaactgggacttcaggtgcttgctatcatgcctggttaagtttaaaaaaaattttttgtagagatagggtcctgctgtttcccaggctggtcttgaactcctggcctcaaatgatcttcccacttcagccttctgagtagctgggattgcaggtgtgagccattgttcccagtggaagtttaatcttttagtgggagagagatgtctactcaaggaattgtgataagaataacattatcataggttgttgtaaatagataatttccactttaaaaaatctcaagtaacaatgcaaaatgggacattacataatttaaatccataatataaaaaaatttgatatatgccagaaactgtatccatgtttccttcttcatgagaacctgcaacctgtgaagtaagtaatttcattctattttgttgtaaatttctttttttaaatttttattttactttaagttctgggatacatgtgctgaacatgcaggtttgttacataggtttacatgtgccatggtggtttgctgtgcctatcaacccgtcatctaggttttaagccccgcatgcattaggtatttgtcctaatgctctccctcccctttcccccgaccccttggcaggccctggtgtatgatgttcccctccctgtgtccatgtgttttcattgttcaactctcacttatgagtgagaacatgcagtgtttggttttctgttcctgtgttaatttgctcaggatgatggtttccagcttcatccatgtacctgcaaaggacatgaactcattcttttttatggctgcatagtattccgtggtgtatatatgctacattttctttatccagtctatcattgatgggcatttgggttggttccaagtctttgctattgtaaatagtgctgcagtaaacatacatgtgcatgtatctttatagtagaatgatttataatcctttgggtatatatatacccagtaatgggattgttgggtcaaatggtatttctggctctagatccttgaggaatcaccacactgtcttccacaatggttgaactaatttacactcccaccaacagtgtaaaagtgttcctatttctccacattctcgccagcatctgttgtttcctgactttttaatgatcgccattctaactggcatgagatggtatctcgttgtggtttttatttgcatttctctaatgaacagagatgatgagcttttttccatgtttgttggccacataaatgtcttcttttgagaagtgtctcttcatatcctttgcccaccttttgatgggattttttttttcttgtaaatttgtttaagtttcttgtagattctggatattagacctttgtcagatggatagattgcaaaaattttctcccattctgtgggttgcctgttcactctgacgatagtttcttttgctgagcagaagctctttagtttaattagatcccatttgtcaattttggcttttgttgcaattgcttttggtgttttagtcatgaagtctttgcccatgcctgttcctgaatgctattgcctaggttttcttctagggtttttatggttttaggttttatgtttaagtctttaatccatcttgagttaatttttgtatcaggtgtaaggaaggggcctagtttctgttttctgcacatggctagccagttttcccagcactgtttattaaatggggagtcctttccccattgcttgtttttgttaggtttgttgaagatcagatggttgtagatgtgtggtggtatttctgaggcctctgttctgttccattggtttatatatctcttttggtaccggtactatgccgttttggttattgtagccttgtagtatagtttgaagtcaggtagcatgatgccttcagccttgttctttttgcttaggattgtcttggctatgtgggctgttctttggttccatatgaaatttaaagtagtttttttctagttctgtgaagaaagtcaatggtaggttggtgggaatagcattgcgtctataaattactttgggcagtatggccattttcacaatattgattcttcctatccatgagcatggattttttttccatttgtttgtgtcctctcttatttccttgagcagtggtttgtagttctccttgaagaggtccttcatgtcccttgtaagttgtatttctaggtattttattttctttgtagcaattgcggatgggagttcactcatgacttggctctctgcttgtctattattggtatataggattgcttgtgatttttgcacattgattttgtatcctgagactttgccgaagttgcttatcagcttaaggagtttttgggctgaaacagtggggttttctaaatgtacgatcatgtcatctgcaaacagagacaatttgacttcctcccttcctatttgaatacgctttatttctttctcttgcctgattgccctggccagaacttccaatactgtgttgaataggagtggtgagagagggcatccttgtcttgtgccgcttttcaaaggcagtgcttccagcttttgcccattcagtatgatattggctatgggtttatcataaatagctcttattattttgagatatgttccattagtacctagtttgttgagagtttttagcatgaaggggtgttgaattttattgaaggccttttctgcatcttttgagatgatcatgtggtttttgtcactggttctgtttatgtgatggattacatttattgattttcatatgttgaaccagccttacatcccagggatgaagccgacttgatcgtagtagataagctttttgatgtgcttctggattcagtttgccagtattttgaggattttcacatcgacgttcatcagggatattggcctgaaattttctttttttgttgtgtctctgccaggttttggaatcaggatgatgctggcctcataaaatgagttagggaggtagggaggagtctgtcttcttctattgtttggaatagtttcagaaggaatggtaccagctcctctttgtacctctggtagaattcggctgtgaatccgtctggccctgagcttttttggttggtaggctgttaattattgcctcaatttcagaacttgttattggtcttttcagggatttgacttcttcctggtttagtcttgggagggtgtgtatgtctgggaatttatccatttcttctagattttctagtttatttgcatagaggtgtttatagtattctctgatggtagcttttatttctgtgggatcagtggtgatatctcctttatcattttttattgtgtatatttgattcttatcttctttcttctttattattctggttagtggtctattttgttaatcttttaaaaaaaacagctcctggattcattgatttttttctaagagtttttcatgtctctatctccttcagttctgctctgatcttagttatttcttatcttctgctagcttttgaatttgtttgctcttgcttgtctagttcttttaattgcaatgttagggtgtcaattttagatctttcccactttctgatgtgggcatttagtgctataaatttccctgttaacaccgttttagctgtgtcccagagattctggtatgttgtctctttgttctcattggtttcagagaacttcgttatttctgccttaatttcattatttacccagtagtcattcaggagcaagttgttcagttttcatgtagttgtgcggttttgagtgagtttcttaatcctgagttctaatttgattgccctgtggtctgagagactgtttgttatgatttccgttcttttgcatttgctgaggagtgttttacttccaattgtgtggtcgattttagaataagtgctatgtggtgctgagaagaatgtatattctgtggattaggtcagcttggtccagagctgagttcaagtcctgaatatccttgttaattttctgtctcgttgatctaatattgacagtggggtgttaaagtctcccactattattgtttgggagtcttaagtctctttgtaggtctctaagaacttgttttatgaatctgggtgctcctgtattgggtgcatatatatttaggatagttagctcttctagtttcattgatccctttaccattatgtaatgcccttctttgtcttttttgatctttgttggtttaaagtctgttttatcagagattagaattgcaacccctgctttttttttttttttttgctttccatttgcttggtaaatattcctctatccctttattttgagcttatgtgtgtctttgcacatgagatgggtctcctgaatacagcacactgatggattttgactctttatgcaatttgccagtctgtgtgtggttttttttttttttttttagacggagtcttgctctgttgcccatgctggagtcagtggcgcaatcttggctcactgcaacctctgcctcccaggttcaagtgattctcctgcctcagcctcccatgtagctgggactacaggtgcacgccaccatgcccagctaatttttgtatttttagtagagacccctgtcttcaccatattggccagactggtctcgaactcctgacctcgtgatccacccaccttggcctcccaaagctctgggattacaggtgtgagccaccactcctggcccatctgtgtcttttaattggggcatttagcccatttatatttaaggttaatattgttatgtgcgaatttgattctgtcatcatgatgctagctggttattttgcacattagttgatgcagtttcttcatagtgttgttggtctttatattttggtatgtttttgcagtggctggtaccggtttttcctttccatatttagtgcctccttcaggagctcttgtaaggcaggcctggtggtgacagaatctcttagcatttgcttgtctgtaaaggattttatttcaccttcacttatgaagcttagtttggctggatatgaaattctgtgtttaaaattcttttctttaagaatattgaatattggccttcactgtcttctggcttgtagagtttctgcagagagatctgctgttagtctgtgggcttccctttgtagataacctgacctttctctctggctgcccttaacattttttccttcgtttcaaccttggagaatctgacgattatgtgtcttggggttgctcttctcaaggagtatcttcgtggtgttctctatatttcctgaatttgcatgttggcctgtcttgctaggttggggaagttctcctggataatatcatgaagtgtgttttccaacttggttccattctcctgtcactttcagggacactcagtcaatcgtaggtttggtcttttcacagagtcccatatttcttagaggctttgttcgttccttttcattcttttttctctaatcttgtcttcacaccttatttcagtaagttgatcttcaatctcagatattctttcttctgcttgattgatttggctgttgatacttgtgtatgcttcacgaagttctcatcctgtgtttttcagctccatcaggtcatttgtgttcttctctaaactggttattctagttagcagttcctgtaaccttttgtcaaggttcttagcttttttgcattgggttagaacatactcctttagctcagaggaatttgttattatccaccttctgaagcctatttctgccaatttgtcaaactcattctctgtccagttttgtgcccttgctggagaggagttgcgatcatttggaggagaagaggcattctggtttttggaattttcagcatttttgtgctggttttttcctcatcttcatggatttatttacctttgatctttgaggctgatgacctttgtatagggtttttgtgtgggggtcctttttttttgatgttgatgttgttgctttctgtttgttagtttttcttctaacaggcccctcttctgcaggtctgctccaattggctgaggtccactccagaccctgtttgcctgggtatcaccagtggaggctgcagaacagcaaagattgccacctcctccttcctctggaagcttcgtcccagaggggcactgggctaatgccagctggagctcttttgtatgaggtgtctgtcaacccctgttgggagatctttcccactcaggaggtgtgggggtcagggacccacttgaggaggcagtctgtcccttagcagagctcgagcactgtgctgggagaatcctccttgtcaggatctgttgctctcttcaaagctggcaggcaagaatgtttaagtctgctgaagctgcgcccacagccgtcccttctcccaggtgctctgtcccagggagatgggagttttatctataagcccctgactgggctgctgcctttctttcagagatgccctgcccagtgagaaggaatctatagaggcagtctggccacagccactttgccacgctgtgttgagttccacccagtccgagcttccaggcctctttagcactgttaggggaaaaccacctactcaagcctcagtaatggcaggcgcccttccccccaccaagctcgattgtcccttggctccctggcttcagcctcctttccaggggagtgaacggttctgtcttgctggggttccaggtgccactggggtatgaaaacaaaaacaaaaaccaaacaaaaaaaaaactcctgcagctagctcagtgtctgcccaaacagcctcccagttttgtgcttgaaacccagggccctggtggtgtaggcacacgagggaatctcctgatctgcagattgcaagaaccttgggaaaagcttagtatctgggctggataacacagttcttcacagcttccttggctgggaaagggaggccccctgctccttgcacttcccaggtgaggtgacgtcccaccctgcttctgctcaccctctgtgggctgcacccgctgcctaactagtcccaatgagatgaacagggtacctcagttggaaatgcagaaatcacccaccttctgcgttggtctcactgggagctgcagaccagagctattcctattcagctgtcttgccagatccccccatatcattcattctatttcatagatgagaaattgaggctgagagaagttactgaatcatccaagttaacttggaaaatccacagtgtcatctcccttgttgttatgcctggaacagtgagcactctggataagtttttgaatgaatgaatagctgcatgaatgaagtagcaaagctgtggtttgagtcaggtgtgtctgcttctaaaccttatgcttttccctctgtgccaccctccttactctatacatacaagtggtgctggcttcttagaaggagagactgtcctggaacacgtctcatgtgcatttataggaaatgaacctctctgtatggtgggggcaacttggcttgcaccttgcatcccacatggtgacagtaaggtgactaggcttagtcccattcctgcctcggctgggtaggtgtgaagtccaggctggcctggagctgagtccctctggccctcctgtcctgtgccttccgactccatgaccactccctctgcagtctctccttcattctccaggggccacttgaaataggtagacatgtcctaaacctgccctgtgtgtaggagtttgggtggggtccatggcatccctaagaagactgagacttttgcaagtgccctgtgcctttaaggtaccacaggcacagatcagtgagttgctggtggcctggcttcggcagcaagtagctgtgtgctcaattttcccttcttcccaccccacatccccagtatatctcttaccagcaactggtgacctctagaatcatagacttcagtataattttaagatcaaagtcagaccagatcactagggatcatccacacggaattctattttcaaatgactacttcctgtctgtttttaataggccaggagcaggagctaatagctcttcccaagtagtttatccagaattttggggttttagtgggttaggtgttgatttccatttcattttttgttagtattgccgtgtatgtagttgaataaattaggaaaagcatcgattgccatgcttcattcacttggctaaaaaaaatttacagtttcctggtcctttatctgtcttctgaactgctctatgaacccctggggctttctctgaaagggtttgtattaggcccaagctaaaactggttattttctctttttttgactcaagagacccaggttagctaacagctttcaccatactttgcacagctacctgggacaactccccactggaaatggtgtctcagatatgcttgttgactatctgggatgttgatgccatgattcttccctgtggtcggcaccgtgttatgagggtcctgccctgatgtcttgtctgaagttcagatttacacctctctcaaatgcacttatcatgacctctaagatgatgtggctctactatcaccaaggataaccctggatttggctcattctacattagacgttttctaaacgtgtgggctgtgctttgtcccaggaactgggcatgtgggagtcaccaagacagacaagattgctggtttggagcttatatcccagtggggtacagcagtaaaagtcagtaaataaatgagcaagatggaggcaggtgccgtatagaacctaaaagtgggtggtttgtgtatttaaccagcactcgtgtggtgccctctctgtgtcttgaaatagtgagttgtcccccccagtcctcctatcatgcaggcagtcgctgtgcacccatgagggctactgagagctgtgtgtgcatggtctcagccaataagagccaggtcacaatcaaggcttgctctggagctagtgctctctctcacctcagagaagggtcgaaggtgaagtttggttataagtatcaggatagaaggatggaaggaagggacttcttttttcagtggcttatttaatagtggcttgccttatttatttattaacacggtatatctatgtgacaataggccttttgtgatgctcgctgacctaatttgtactggtgacctgccttggtggcatgcttcatctcctatggggttggaaaaacttttttctccttcaatagtattttttttccccatgtcattcttacaacactgcagacctcttattttttttattttttatttttttttgatttggagtctcgctgtgtcacccaggctagagtgcggtggcgccatcttggctcactgcaacctccgacttcctaactgcagacctcttttaaaaattcttggcttggcatggtggctcaagcctgtaatcccagcactttgggaggctgaggtgggcagattgcttgagcccaggaatttgagaccagcctgggcatcatggtgaaagcccatctctacaaaacagcacaaaaaaaatttagctggggatggtggcacgctgctgtagtcctagctacttgggaggcagaggtgggaggattacctgagcccaggaggtcaaggcttctgcgaactgtgattgtgccactgcactccaccttgggcaacagagtaagaccctatctcaaaaaataaataaaataaagtaaaaataaaaattcttggtctcttaattgctgaatgattttttttttagtcgtacctcacttaaaactttggaaaaagtttattttgtatctcttggattttgcttgtctaagtgtttttcttcagagctgtactttctttctggcctggccagttattccctaagtctacctgtcacggttgcctgtcagcagtgtttatttttgttttttgtctgtggcacctatgggacattgtcacgatggtaaccccggctgcaacaactcaactgataaaatcagaatctgttctgggttggtgattcaggggctttgcttaggcagcccagtgtttgtgttggggctgtggatagagcttcacaggagagccagatcctctactctccagctgtagcttgatgcaggcattatcagagctttgcctctcctggagtttctcattgatcccttttctgtagaatgggtatgatgagttcacacttgctctctcaagggtagtaggagacaaataagagtgtatgcataatgctttatgttctttagaagaaaactagaaagtgttcctattttacatcgtaacatttaaaaaaaatcatcttgctagtgaatctgaaagaaaacttctcaaaatgaagcttttaatttcatacattagtaaaatgtggttaggtcttttccatcacatgttctttgctcaatctactctgctctgtttaggaaaagcagctgactccctctctctctctcttcagtgtacccacagaatagagacaaggaactttgagttaatgacagatgtttttgtgattgctcatgtcagacctgggtgattataaacctggcatttcattgaatcacagaattggaatgcttttgaaaattaaactccagagatttttagtttaacctctcattttgcagatgagaaaactctcatggtgggttgatggtagatcatagaccagaaccaaggtcccgtcacctccaccctgttttatggccttattgcaaatgaagtcatgattggatgttattgagtgacaagtgaatctgtttcccttgagtcttcttcctctcatagattgtgagtggtcctgcaggctggtgcagtcactgttgtgacctgccatctttgtcctcaccttgggtaccttttggaacaccaccttagccactaggtgtgtcatttatggctctaactgatccccaggcttagattcgtagtgaggccttgcctgtgagcttgatgtaagtgctggaatttgtgttaaaagctccataacgtgttcttagaagttgcttaggaaaaaatgcaggaaaacgttttattataggaaacttccataacagaaaagactaatagactgcattatttttgtatttacataatttttgagtgcataacacatttatatgttcaaaagcaaaaacttgtataacaacacaaaaatccctgtcctgcctctgtgtcttttctgtcttgtcctgacccctccccagccagccctaacctaagtcatcacataactggttttggggatatttcaacaaatatttttatgcatgtataatcaagtatgaacatgtattgctgtgtccccacctttagcacagatggtgcattccactttttaagatgatcttactgcccctgcccagtgtcattttggccgcaccaaagtgactcccatctctttttacttccatgtccccaagtgcctgaggggtgcccagtaaattctaggtagactttgctttccctggtcatctggctcaagtgccccaaacccaccatccctcacacctgggactcctgttctttgcttttgcccccttcaaactataggctgattattaaaccaccctcttgttaatggacatttaggttgtttccaatctttcctgttgtaaacaataaaacaatgccctttaataaacttcattttgcgtatatgcattttcatatagaaaaaattccatgaagtgtagttgctatattgaaaggtatatgtatttctaatttctttcttttttcttttttttttttgagacagggttttgttctgttacccatcatggcccgctgcagccttgtcctccctaggcttaagcaatcttcccatctcagtctcctgagcagctgggactacaagcgtgcaccaccatgcccagctgattttttgtattttgtagagatggggttttcctttgttgctcaagaagctggtcttgtactcctgggcacaagcagtccatttaccttggtctcccaaagtgctgggattacaggcgtgagccaccacacccggcctgtatttctaatttctgtaagtgttgctaaactatcttccatatggggttatactaacttacatatccatcaacaatgtacaagagcccttggtttttcacaaatttgctgacaatagtatgttatcaaattttggggtttcgtaagttgaatagatgaaaaatagtatctatgtgtagtatgaatttgtatttctcttagagtgaggtggagcatctttctacatgtgcctatcctttgaactagttatatcttttgcccattttctattaggttgctgtactttttcttactgatttctaggagttctgtatatattagagagatcagtcctttgtaggtgatatgtattgcagatctgttttcccattttgttattaaccttttgagttgatttatattgattctcccgtctcagcctcccaggtagctgagaccacaggcacgaactgccatgcccaattaattaaaaattttttttttgtagaaatggagtctccctgtgttgttcaggctggtcttaaactcctaggctcaagtaatccccctgcctcagactcccaaagtgctggaattacaggtatgagctgccatgcccagcctcaccttactaatttttatgtattcaagttaattggttctttgttttttcatggcttctgaaatttgaatcaggattagataggagcagattgcgtttggtagagtttctttggtcagttatttgaactcttgctgccttataatccactttgatctttttaccccattagaatagttttgtctgaattctgccaatggtcaatggtttctttctttttttttttcttttttttttttttttgagacggcgtctcgctctgtcgcccaggctggagtgcagtggcgtgatctcagctcactgcaagctccgccccctgggttcacgccattctcctgcctcagcctcctgagtagctgggaatacaggcgcctgccactacgcccaactaattttttgtatatttagtagagacggggcttcaccgtgttagccaggatggcctcgatctcctgacctcatgatccacctgcctcggcctcccaaagtgctgagattataggcgtgagccactgcgcccggccctgccaatggtttctaatttaattgttgcagaaatgaaatgatttgttttcttcatagaagacttctaagtggcaatttgggccccatctcatttgttcataaccaacagcctaacatagtatgaattgtatcacttacagttgatcttcccattgtatttgattagatacaggcgttctaaaatgcaaatgtttaaaaaatacagatagaacttgaaattgaacaaaattagatacaactgaagctgaaaatggacacttgatttttaaaaattgtaataaaatgatctagattgtatacaccatctgttacaagttgtatgtgaataaggattttgtgccatgttggttgtgagtactctgggttttaaaccagtttttgcatcgaatataactttaattatgctcagtacacgtggatgtgttttttggatatatccacacacagtgtacttgcatgtgtatcttcatcttatttattgtttggtaagggacacattgctcagcttcctggatatcttcctagtcttagaggggcctcagtggtagagttcttatcagaacctaagggtgatgacctctggcctgtgacatggcatctgcctgaacatgagtgtgccacaagattgtatctaaggtggtctcaatctcttttcttccttcagactgccttgcttgtcctttgctggcatctgaggacttgtcctgtggaatgaggctagaaagaggcgtctctgtatttccccactgtgcatctacttgtacctccaatctttccctttaccacccatacatggacatatgcttccagttctctggacatatgttttctgtcttcaccactagggtatatacctatgggtggaattgctgggtcatgtggtacctctataattaactttttgaggaactgtcaaacagttttccaaagtggttgtaccattttatattttacagatccaccagaaatgtatgagggtgcttatttctctgtatcctcatcaacccttgttattgtctgttttggttttgttttttaattgtagctatcctactgggtatgaagtaggatttcattgttttgatttgcatttccctcatgactaataacattgagcatctttttatgtccttattttccacttgtgtatcttctttggcgaaatgcctattcaagtccatatgcatgttttaattgggttgtttgcctttttattgtggagttgtaagacttctttacgtattctggatactacacccttgtcagatacattatttgcagatattttctcccattttatgggttgtcttcactttcttgatactactctttgaagcataaaagttttaaattttgatgaagtcaatattttttttttttgctttggctgcttgtggtgttatatctaaaacccgttgcctaacccaagatcacagattttaactcttgcatttaggtttttgatccattttgagtttaaaaaatttattatatgctatgaaatagttgtccaacttcattttgaattattagaccagtttcattcttttgcatgtgaatactcagttctcatggtacaattacttgaaaatactattcttttcccattgaattgtcttggtactcttgtctaaaatcaattgatcataaatatatgagtttgttactagactttattttgagatagagtctcgctctgttgccaggctggagtgcagtgacgcgatcttggctcactgcaacttctgcctcctgggttcaagcgatttcctgcctcagcctcccgagtagctggaactacaggcacgcaccaccatacctagctaacttgtgtatttttagtagaaatatggttaccccctgttggccaggataatgtcgatctcttgacctcatgatctgcctgcctcggcctcccagagtgctgggattacaggtgtgagccaccatgcctggcctgttactagacttttttttttttgagacagagtcttgctctgtcccccaggctggagtgcagtggcaggatctccactcactgcaagctccacctcctgggttcacaccattctcctgcctcagcctcccaagtagctgggactacaggcacccgccaccacacccggataattttttttgtatttttagtagagacggggtttcaccatgttagccaggatggtcttgatcttctgacctcgtgatccacccacctcggcctcccaaagtgctgggattacaggcgtgagccactgtgcctggctgtttttagacttttaattctgttccattgatctgtatagatgcctgtccttatgccagtaccacactgttttgattactgtagctttatagtaagttctgaagattttattccttgtttttgttctgttccttcattattgacttggcttttttgacagtttgattatgacatctaggtgaggctggctcccttttagtttattttacttggaattcattgagcttcttgggtgtaatttttttcatgtcaaatttggaaagtttttagccattattctttcaaatattctttcttcttttctcttctgtatgttggtatgcttaatagtgtccctcaggttctgtgactctgtttatttttcttcactgttttttcctcctgtttcgcagtttgggtaatctcaattgacctgtcttcaagtttgcttgttctttcttctaaatgctaaaaagtggttttgagcccctttcatgaacgcttatcttttcccccttttacttttgaactccagaatttgtatttgattcttaaaaaaatggtaataataatttctatctcgttatcagtatcaatagtgatactgatatttattgatattctctacttaaaagacgttattcccatactttcctttagtaatttttgcatagttttcttagctctttgagcatatttaaaataggtgatttagagactgttttctgctaagttcttcatatgtgggcttcctcagggacagattttattgattgctttctttttcctatgtatgggccatactttgttgtttctttgtctaatttttttttttttgctgttattgagaaatggatttttaaataacacaatggggtgactcaggaaatcagatgctcctttcttcccatggttgctattggtacgtgatatagttgttcttgtttaatgacttttctgaactaattctgtaaagtttgtattctttattgtgtctgaccagtgaaatctgtacttggtgaacttagtggccaagtaattattagatggcgatttccttaaactcctgggatcagtaaacacctgtttttgtcgaggggcttcatctacctgttggagcataccttcattgcttggcctaacagttaaaaactgccttagcctttatttcctgctgatgttgagtcaaagtcagccagaggtgagagcttaaggccttcttaggtttttcctgagtgtgcagtgaagctctgtacattcatgtgtctttctagattcctgggaaaatgtcaaagcttttcaaagcccccacggacattttatttcccacctttgcctttggtttgcctcagttgttatctgccacctcaggaggctgcaaagttaaaacacttgccgtattttcaacagacactcctgggttgggaggaaggcttttctgagtttagccagaaacagtcagtcagtcttgcaaatgaggtcttacagggaaccatcagacaggtcaaatgatgacagttctttgagaatgaagctttgaaagagctctaagagcactgttttctccagcgatggctgctacgctgtaccaggaatgcggcctgctgagagcctggagagtggggatgggtctaggccaaattaaaatatcacagagctcactgttcttactgagatgtggttgttttccttgaattaatgctccctgggttcctgcaaacctttggttagtttccaaaatccataagaagttgatactgacaatttttgccaactttttggttgcttttatggaggagagctttttggaggcctgtagtaaccaccattttcactgacatcctttggatcaggaatctcttaaatcttttttgttttcctgagggttcttgctgcccttcttttttatcttgttatcaaaaatagtatacttcatcataacctcagaattacccagattcattaatactgagtattgtctagaaatctctttctgcctgaactccactctagactggttatttcctgttctgctgtatagctacactcctggtattttcttcctgcgtttatagattaaatgcagtttttggacttgagttggatattcctctttttcagttttcatcctcattttgtttttctcaaagtgatatataatgtagaattgttgtatatcttaaaatgcatttattttaacttttcacttatttctcagtttgggtgtatgtagaattctagcttaaaaataattttcccttgttaggattgaaagggatatcttcttacactctgtgtaattgattctggaagtctattccatctctttgtgagtaagctttttctcctccttggaactttcaggacctttttaaaaacacccagtgtcataaaatttcatgagtctttcattcattctgcttagctcttggtgggacttttcaatctggaggcatattttcctttggctctggaaaattatcttattactgtcataatttctggaatgccaaattgattgcctgaattgatctgtgtttctaccttgatttctttgactttatcttccagcctctttattgaagtttaattttagctactgtattttaaattcttgtgttctttctttttggcctaattgttctattttcatattttattctggttatatggatatagtgtcttctcagatctctgtgaagacataaaatagaaatatttttggatatcttttttccaaattagctctgtatttttttttaacttgttttcatctgcctgttttttctcacaagatgcagtcttcagttctctagttttttttttttttttttttgagacagaatttcactcctgttgctcaggctcctgttgcaatggtgcagtctcggctcaccgcaacctctgcctcccaggttcaagcgattctcctgcctcagcctccggagtagctggggttacaggcatacaacaccacgcctggctaattttgtatttttggtagagacggggtttctccatgttggtcaggctggtctcgaactgtcaaccttaggtgatctgcctgcctcggcctcctaaagtgctgagattacaggtgtgagccaccatgcccggtcttttttttttttttaatacaaaaatatttttctcccattctcttgagtgtgggaccgtattgatgggtttgtctactgtgtgtctgaaacctgctcgtcccaccaccaccgacagctgagtggattgaccagtcagctttgctttataggacatagggtcttggcatcctaatgcttgagtgagtaggacttcacttgacacacaggcatccacactaggtcctcagactgctggtcagtgtctttggagcaaggtcctccattcttctgtagcaaacagagggattcctgtccctttcagtggggcgtccagggccacagcagttcccacatgtgcccctggccttgctcctgctctgcatacctgccgactcccaactggagcctatgtagctgtggcttctggatgtctcctaccctataggatttgtctcctgtgcccctcctccttttgtcttctgcagatttgttgacatctcatctgttcctggcctccctcttcccccattttcactgtctggggtttttctcttcatgcctattatgcctgcagttcacaagaggtcagagagatggctgtctgttcccagtgtgacatcttcacctgggacctctggaagcatttcttgtctggttttctcccttgatgatttggttcattcccctgggtaggcagtgtgagaagcttccccaaatttggaaattattatgttatatagagctgggtgggagaattatatttgttaagtgagcttgttcttgtgaaggcaggctgaggagccttgggccctctgtgtcgtgtttccattgcacacaagttcatggttagacatgatttggcccaacatgtgtctggatcatttcaggagtgagtggatctgttgttccatttgctcacgttcctcatggtgttagaaggtagggagtgaagctcagttgcctattgttcaataggactagccaagtaaatacccttttccgtggtaaattcccctatgaaaggtcatgcaagtggaactgcgatctcatgagaggatgcttccttggagtctgcatgtgaacctggcagagccgcctgtggttagcagaatatcttcgctgtgtcccccagtgggcagccttctgccaccttctcccctcactgcatggctcaggaactatctttcatttagtaactatctgatgggctggatgtggtggctcacatgtgtcatcccagcactttgggaggctgaggcagtaggatcacttggggccaagagttcgagaccagcctgggcaacagcaagacccctgtctctacaaaaaataaaaataaaattagccaggcatggtggcacgtacctgtagtcccagttactcgggaggctgaggtggagggattgcttcagcccaggagtttgatgcagcagtgagctgggatcacgccactgcactccagcctgggcaatgcagtgaggccgtgtctcttaaagaaaaagaagaaaaactgacagcggtgactcctgcacatcatttctcccatttccattttttatttacgaatatttaaactacagttaggttatggtattgtatttcattggaaatactaaactccagtttggaaaatctatcagtttgggttgtctttttttccaatcattttataagcgtttaatgagccatctaccaaatgacatggagagtagcttccaaattatttttattccacatacctattagaaaaaagttttaagtacttgatcccagtgtcttcttaatgcatacattatacagatacaaaatgtaaatggaagttctgttttatttcctcttctaattactgacctgtgaacctcctggggtatgcataccctgctttggagactgctggctggaatacatgatatgaagtaaaaggaaccctactcccacagctgccagtccagttctggagacggacaagtggtggggcagggataggtgttcctagggcggtggggaaggccatggggccagtctctgcctaggacaggctcagagggaggagggtgagctgaggcttttagaggcttggttttgtaaagaaccaagacaaaatgcaaaaccatgtgcgagtgttggtggtatattggtgagcatagctgccttccaaaaccaaaggagttggtctcatactcttggatgaagaccaggctatagtcaaccaggcagtgcagtggctcatggaaggaagaggtggtgcttgtctcttgtacagcagtcctggggtgagcaattcagggtgtgcagccccctcagctttcttggttgctgtggtccagggctgggctcctgcgtctcccaggtagccacaaggggaggcaaggaagaaataccacttgtctcctctgctcactttttgctgtgacaattggtctccgttaactggagaagggagaagaagattgggtcacagcagcttccaccacagcattttacgttaccagttatgctgagaaagattttctggtggatttactaaatgagctgacatcttcaggttgctctaggtataaattaggctggtatggttttcttcactgagatgcctggtgagcctgatgacagcgctgtagtgtgcagtcaggtaccttggaaaccatcaccactcccaccgtacagcacaccagtggtcaccctgataggagagatgattttcttctgctgtgtccccaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtaagtttgggcacctgtgtgtagggctcccaggtggacttcaaacctgcagtgatgccccttttgaccaacaagcctatttacacttaagcagtgaggttgttaatttcagctgctggggcagatgggttttcctgagcattttccatactgctcagagatcgtctctgtgggcacttgagctttggccctttgaggtcttggtcattcccaagagctccactgttcttacatctaaggcaaaaacaagtaaattgaaaatgaaaagctaggttgaatttttacagatgctactctggagggtacagagttaataaattcagagaatcaggctcattgaccaactggctgtccttagccagctgctggttaggcatagctaagagttcaggacagtgagattaaggtgtgactccaaatgaacagctcacatgttaccagttagcagactcgctcacaaattgggctgcacgcctgggccagatctgttggtggctcagctccttctcccctgtgaaagctttgaaccttgtcagtggtggctctgtgctggtgcccaagtggaggtcacctacagataaattgaggcacaacatgttctgaactaacttgtttcctttttttctcctactggggtgtttacagggcatggtaaaaggaataaaggtgaaaagaaaaatataatgtctggacaaaagtctttagaattttatacagatatattcttcatatgtgcaaagtatgcaataaaggtatctgttttggtttctataagacatgcttggcaggcttctgcctgggcttccctggccagtgctgactggcagggacaaactatctctcaggctcacagtgactctgtcctggctgtcctcatgctcggagggacatgcaggccaggtaccgaaaggagtgtattctgtcagtgctgcagaaacctggaccaaccttgactctggtcttgatatcaaacctggacaatggagctcactctggctacacagaggtggggccaacctgggcacagacaacatgctccttggtgctgccgtggcctcaactgctcactctcctagtgagtgtttcatcctaagcagggcctcctatttaggccctacgtgaggccctatgtgtgatgtgtagagtttccagcaatggggcttggactggcccatcccagttctgactctcctggccacccagggcctacctctgctgatggccagtggtagatggcagtggttctttttctaaatctcaccctgtgtgctcccctgcccatggcattcagcagccaaagaccagagaagtgctcttctcctgcctgcaaatactgtgaagatcaccccatcacccagcagttcagttcctcatcctttgaccccagacatataaagcctgtgcattatgacacagcctggagccttttcccaagctataggctcctgtgactactaccagttcctttcctttatgtcatacttgactttgcagatgccattacggcctctccctcacttgagcttcacgtggttgtggaggtatgagagcatgagtgatgcactagtagtactggggccggctagcttgccctctgaaggtgcagccctggccgcctgtattacactagtgagcccgtgatcctggggttgccatctccatggactgagaggtcgtgatagccctgccttaaaacactggccttgactctcctgccttccgttgggtgaactcagtgcagatcatggagcaggtcacgatgctctcaagttggttccctctgagcgaggagctcttggtgagcaaccccgtgtgtggtccggttgcactttttagatacttcatgcagaagcccaaagccttagtcactggtctctgagcccatagccaccgtatttggaatcttttgggattacaatcagggtaccaatgattccttttactttacactatttgcataaatatgtgattattaatacatagctcaactcttaagggttttgttgacggaagtaactctaacttcttcgtggatatttcaaagccatgtttcttttttgtgtgcgttttgtacacttgtatgtataatacaagtggaatagggatgtgactagtggccaaaacattaacttcttttaataatggccgccattcaatgaacacagtctttgggccaggctctttgtgaggtgccttacaatctgtttaattctctgcaaacttattttacgtattgggacattgaggctatgagaaggtaagtagcttgcgaagcgggtagagctagacctcaaacccatgcctgccttgtcccagaaggctttttccagtgctgtgagaaacgggagtctctggagaaggctcagacctgtcggggctgggaagcattgctccgtttcagctgaaaggctctgtggagcagaacatgagggaggagtgtgggtccccattgtgggtttcagagtcttccctgtgttaggtaaatgtgtgagatgcagccaccaggcaggaggttgggggagctgtgccttaagaggatagctggatgtttaactttcatgccagggcccccggggccatagcacaatcccggcaggcctgtctccacctgtgtgttctgcttgagtccaggcttcatttgtgccctggctgcctttagtttttttagttagctttcatgaaacacctgctactcaaagagcttgtagaaattcagcagaaccattgcagactgaggggcacctgtcactgcccgtgaacacggctcctaaatattctctgctaaaaattcctctacaattgaaacactgcatgagttctttcccatggttccttaaagtgcctttattatcaatagatggcattgcgttcctaatgcaccttcacctgtgagaaatcaagtacctgaataaagaggagttatggagagcatttaaactcttcccatagtgctcccgtgcagggctctgcctgcctccacctctttctggaccacgtagcctctactgcagtaaacacagagtatatcacagaaactttgctgtttacaggagctaaggcgtttgttgtcttcttgatataattatttatttatgtgtgaccttttaagcccacattgtttcctctgattacatatctgagataatattgtgaattaatgagccgattgctttgattcacgaagatcctgtttgcctcccgcttgctgcatcacgtctgctgtgtggagcttggcacactgctttgagcgtgtggatgcagagagggactgcaggtgaatcagaggggctggctttgggttgcagctccctgtcaagcagctgccaggttttgggtcatctctttagccttgctgtacttccatttctcaccgttcaaacaaggttgagcactgtagtcttgttgatctccaatgtttgttggtttcttatcattaagtacccaaccctgtgcaggcactgggaatggctaaagaaagtgagttgagggctttgctctaaagggttggagatatcctgtgaatgtggccttatttgggaaaagggtctttgtagatatgattaagttaaggatctctcaagatggaatcaccctggattatccagtgacacctgtctttataagaaacaggagaagacagagatagacacagagaaggccatgagaagatagggcagagatgaatgatataaccaccaagcccaggaacacctggagccaccagaagctggaaatggcaggaaggatcctcccctagagtctctgcaggagcatggccctactgacaccttgatttcagagttctggcccatggggctgggagataataaatttgtattgccttgtatcgcctggtctgttgttccctgttagggcagccccagacaccagtgcaggtctcccatcacagcactgctgtgaggctgcatgagatgagaaggatgcaaagggatggcgtccagagctgcgctgctgccaccaccctcagctccttggttagatattctgaccttctgacctcctggcagcccagtgcagacatggccttcgcttcccagctgccttccacataacctgctcctccctgtgccgtggatcccacatcagccagccagggcaggcaggggtggctgctaaaaccgtatgacagttcttgcctccctccctccctcccacacttcagaatgttaaatgagacttcttgactcaggcaagctcctttcttggttacgaagatgtaaaatcagccgtggcaacggcaccagctcttttttccgatagctcgttcagtccccaaagctaggcagttggcatgcgcaccatcctcctttcttcctgcagtcgggggagctgacaggctgtcctccatgctgccgtgggtggctgctctgctgcgggggctcttggacatggctatgcttgagatggtcgttgtagctgtatgtgaggtgaatgccgttccatatacacttcttcatgtattgacgtggtgcgcacacaagtcatttaaaatcagtgaaattgctctggagtattctttgaggagttagaccttgaagctcaggctttaaaactcatcgtaatatatttgtttatgatttttgaaccctgtgagtgtttttgtgcaagctgtatccacctcctcccctcaatttagattatttctcaagagtggaattctagtgtaactgcagcctctgagctgttgctgtggttctccctggtggatgagttgtttctggagtgtcgccgatgacattagccctatatccccacatccccaccaacagtgggcttttcatcttcacttatctttgctaatttacccagatacttccagtgtcacttcttagaacaattgtgaggataaaatgaagatgggtggtttattgtctacttgtcctcattggcgagccactttcctgagtccccacaactttcctggctcattgaggccatcccatggattacttaacatacttcttcataaactcagagtgggaactacagattaaattaccttagcattttggcaagagcccagagcctggaaattagtatgtgaatgtaatgtgagcccttaagccttcagtgcaagtgatgtctctagggagagccctcagcgtttttcaggggaaatcagaatccttcatcagttccagtagggaagagctgaagcttacagatttaacagaaggcggtagcccaaggaaacctgttccagtgtgagtggaaggaatgtgctgagcagagccggctaatggtgcctcttggtggcaccatggacagggtgctgggcaccctcgtttcatggggttggaggagaggaaaggaacgcagctcggcattgctttgtcggccccatccctggaatacatgggccttccagccacactcagaccacagctgggtcctatctggcctatacagtgtcttaattttgtttctaattttcaagcttaaaaaaatatttgacagcattgaaaatcaggagattgctcataacagtgctgacttgtggtgtgtcctgagaagccagatctgctccattgtggcccacattcccccagcagcaggtgctgagcaggtgccctggacctctgccacgctgtcgtctcaccccgttatctgccctcgctctgaggtgccttcccggaaggaacgtcccacaacattcccataagtctcattggcccagtctcgatcacgcgggcagctgtgaggagtaaagtcgtcctcgctgggcacattgcttccctgaatagaaatgaggttccgttactaaggaaggaaagggatataaatgctggtgagtcatcagcgcagattgggggatgctgaggtaagtttattcatgttgaggtggaagtttctgtgaggacattttgggaacactgttcagcctgcagtctggggtccctcagaaatggactgattagaggtctgggactgggtagataaaagaggaacctggagcattttgttatgctggaaaatgagaacgtgccagggaaatgattgagcaccatcaaagtcaagcaacctccaccaaccttgtctgggattgtttcacaccaacataattaagcatggtaatgagttataagccattgagagaccagagaggccaggaatccaggggtcagtactgacagcaatagatagataatttcattgcagaagagaaggtgcttgcttcaataagatgcataagccatcagtcagtgtggagggactagggcaagaaagtcagcatttcccagccttcgtgggacagatgggaccggcagatgctatgcggggcagggtggagcagggatgcaggggttctggagaggagagtttgcaagtcaataactacagtggagaagtcagacctccctttggccaggtaacctgagtgaacaccccacccactgagggctgtggatgttgtgtgcctgcaggtggaacacatgtgtgtccagctgggtgtgcacacatgagttaatcaggagatgtcaggggaggaaaaaggctgtggaaatgtcctagattaaagaggacaggacccccaagatgcaggaaggactctggactggaccctgttccgtaaatcatcataagttatttccttgtccttaggaaataactcaggacaaagggccaagatgaatgcaacctattcttaaatgattcagagaaaatactatgttattatatattatacatacagcatacatatagagtgagagagctgtgtacagacacacagctgctaaacacttgtatgggtgtctttgtacttattctagtaactttaagcttaaaattctttacaaataaaatgttaaaaaaaatgagaaggctaataagcacatgagaagcttaacgtcatgattcattaggggaatgcaaggcaaaaccatgatgagatgcccctagacacctcttagaagagctgctaagaaggcagacagcaccaagcgctaaatgagatggggcacctggtgctcttctgtgctactggtaggggtgcagcagagtggtcagtctggacagtagctgacatcacgtgacccaacacacgcattcctggctacttaccaaggagaatagaaagcaggcagatctctacagcagctctctacctgattgcaaaacaatggaaatgcccacatgtccacaaacaagtgtgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaaagagtgatttttactatgtgcatactatacctccacaaacttgactttaaaaaaataaaatattcacagaaaaaaacaaaaacaaatgtaaaaccatcagactactttatcagaggtgttatttttagatagaggtctttgaactccatcctaggaacattgtacccatgtcctcccagaactgcatcttgcactgggtgtcggaagacagccctgcaagacctgtatgctctgtaccattcagtggtttttaaggttaactaccagaagtcatatctgaggcctcccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatctgcagctcagagtgagagatggaattctgtaaaggaacagtgtggagagggactccaggcaagtcaataacgatgttagaatgcccttgtttagaataattatcatgctaataatattgttcatattgtttttactaatatgctcatccttaaaaatagaagatattctaagggtactaaataaataaataattaaaattttgcaactgagaccttcctcttccagagcctttacaagaacctttatagacaacacctcaggtcctgtttgctgccccagcatggagggcagcccacttggttacagtgatgacagatggaaacttgactggagcaggtctggaaggcagaggaggcaggcctgtgtgtatatggtcaggacaaaggaccagtggtgctagccacacctgtgggatggctgtaattaaacacacacacacacacacacacacacacacacacacacaacagaagataacaagtgttggtgagggtatggagaaactggagccattgtatgccgctggtgggaaggtaaagtggtgcagctgctttcgaaaatagtatggtagttcctcaaaaagttaactgtagaattaccatatgacccagcacttctgggtaaatatacagaagaattgaaaacagggactcaaacagatgtatgtacatcaatgttcatagcagcattattcacaacagccaaaaagtgggggcacctgaaatgtccatcagttgatgaaacaaaatgtggtttatccatacagtggaatattattcaaccttaaaaaggaatggagttctgattcatgctacaacatagatgaacattgaggaggacattatgccaagtgaaataagccagacaaaaacaaacagataactgtattattccatttgtgtgaaatgtccagaaccggcaaatctgtagaggcagaatcattagtagttgccagtggcttggtggggttgagggaacaatttagaggaagggttagagcaaatggggagtgactgataattggcacagggcttctttgtgaggtaatgaaagtgttttgaaactagataaaggtgatggttgtgcaccattgtggatatactacatgccattggttcacttttgaatggtaagttttgtgttaagtggattttgcctccattagaaattgttcaatataaagtcggctcacatctcctcataaaataccacactgatgcacatgcgtgacgtctgtgagtgaggatggcccccttggagagctgcactgcccagcacagtagctgctagccacatgtggcagctgagtaaacacttgacaggtggctcacgtgactggagaactgaattattttattttaattaacttaaatttaaaacctacttgatttagttactggaaaaccttgaatatttttgaaacaacttgggcatgtgaatataccctttcaattgtaaatattatgaaatctgaacacagatgaagtatttctgatgaaaaagtgcagtgctcatcttaatttttgttgggttcaagtgtacttctgtgtccaaagtacacttgtggacacagaagatttggggatgttcccctccttcctgttgggcaggtggctcattgtcttcaggtccatctcccactgtgcccaggagccctccactctgggtgtgtgtttggacctggccagtgaaaccctgtgttggggtctgtggagtgccaaaaggcctgagagcaccagcaccgtcccctggatggtatgtaggccgaccccctgcccacatggtgctgatggtgggctgtcagccccagtgtagctctgctttgcctcttcatgctgggcaatctggaaaaggcccttacttccaagggtttgtcctcatttttaaatacaaaaaatggtatgtatggtaaatggtaatggtatgtgttttacaggacttgtgaacgctaataaaataagttacatggatcacagtaataactactggtgaagataaaaaattcgtaaaggatctcttctttccagagatttacagttctgtgagttcctctgaagtcttccctggaatagagaaaacaatgcatttccctcttggaaggttttcattgcatcagcttggtaaagacgaggtagagtttgtagtgttggggtctctgagggtgagtcaggtccccgtcacacaaactgtaaagtcaacgacaaaccagcttagcagagtatctggaaatggaagattcatcccaaatttaaattgcacactggcagagcagcgtcatttactgggtagagctggcgtgtaggggagccacccactccccctgttcaccactccccctatctgcattcggaatgtcagacaagatttctgggatgctggcttcagatcatgattgcaggtttttgtcttgctcttcccagttctggaaaatctccactgtgtgctctcccgcaccacatcggtgcccaccctcttcattagtagaacacattctcggacttgatccctgggctctgcagagtctggtgctgagtaccttctttggtgtgggtaggttttggcagcaggagcttggaggtgggaaggtggaaggtgcagtgttaggacactgctctctcaagcccgtgtatactggtgagtctccagtgctccctcttggggggacgtggtgtcctgtggactcactgtgacctcttgagtgtcacagttaccctgagtgtggcttggtaggttttgcccacctggtcagtaagtgtcctggtggctgccacctccatggatgagagctgctctcacttgcgggccctttgctaccttttctccctttctgtgagcacctagtggtttaatcccatcagagagtcccatcacacttgggcatgtgaatgtacctctttcaattgtaaatattatgaaatctaaacacagatcaagtatttctgttgaaaaagtgcagtgctcatctagggcaaagtagacaaacccactctgttgcttcttggccactctggtaagaattttgagcccagccactgaccacagcagatgcagccagttttcttgttttctgtgtctgtatgaccactgataacagggcatggtgtggccagggccctcctctgtgtccctgggacaggccaagcagccagggtcacctaggtacatacagcacccctcacgtttgctctcatactgcagttccagttgtcttttaagtttttatggtaatgacatgagtctcacagaccccaacactgagggctggatcttaaatgctgggtgctgcttcctttgaccaagggatgtctgtgccatccccacagaggtgcccaaggaggcctcttttggggttgtttcttgatggtcgtttctccttcccaagccatcagagaactttagggaatggggctggaggaccccctcatgcagcaagcttggccccagtgaggaagaagtggggacagggcatggtgccctgtcatggggtgaggactccccaggagattctgtcatgcattaggctgagccctaagtctcataggtcccagcttacccctaagatagcagaatgttggatgttgctcttggaagcaagagagatcactggagaggtagttggttgataagagctaagcagagccttccatggcaagcatgggggcaggctgggttggcccaggacaggtcctggtgtgggggggtgtcatgggtcttggaaaatagcctttcttcatgagagtgggcaaggtgtgcacatggaacaggcactgtcctgagtatccaggacctgctgaagaaggataaaggcatcttccagaatgtcagtcccctcaggtatgtgcctcctagctcttccctgggatatgttagcacaggcagcaaatgcattcccaggcacagagggtcctgccttgggttctggcaccccctcttgtctgtcacctccctttgtgtagttggtcctgagcttatcctggacacccatccctcagtgggctctgctctgtccccagccctggacacctgtctcaggtctctgactcaggtctctgtcctgcttgtccccaggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctggtacgagcatggcagtcctggagagtccaccctttaggcccttgtgctggtgacaaggccgatagtggcagaggggttggtgatgacggtggggaagaaggttgtgtggaccagcttcctgccatgtcctagcctagcaaggaacctgtcttacctgctcttgtccccaatcactgcctcacaggtgcactctggtctttcagctgtgttctcatacctgggctgagagcccagttaacaggacctcgaagggtgtcatgagatctgcccttcctgcaccagagcctggtaacatcaagtgtgttgatggcttttgtttgtgcctcatctgcacatatcttcccatgaagagtcgcttggtgggacctttggtagaggaggggagggagccagattgcagagccagtttctggatgttggaggccagcatgtgaagactctgtgatgtcagcagtgggttagggaggaggaagagaaaggttcctgtctgaccagtgtagtgcccagtgtagagtttgctcatggccaaagagaatgattaattagatgtatacattctttcttcctattttaataactccaagagtagctatttagggaaaaaagggttgctttcctcagattatttttaacttcccgtgtcccatatacccagcacgtgggtttgggccgcagtacagcagggcacgcggacgcagtgcagccttgagtcagtggggaggggtcatctgctgggcacagtctccttatttttgttctgtaaacacggaccgcctcctccccctgaagatcgctgatcgatattttcttctcattttgtctcttggaggaaccttaccttgtggtgtatctggattgtcttagtcttaccttccggtacagcacgtattaatacatcgtaggtggttctgcaagccctgttgctgtgtctcgtccgttcttgcctattttcacagacaggtgcatcctgctcttatgaggtgaaggagcctgcggagaggagtgtcaacatgttctcctcacctggccctgccacaccaggggcatgtcctgagcacttagtacacacagttaaggtggggttgactggctgcacagtacccctgaaaatacagtttgtttgttttttgtttttgtttttgtttttttccccccacaatagagagattgaatttctgaggttgtgactcagtagcttaggcagcagggatggggtttgacctctgatttgatttcacacctgtctgtcctcacagccctgtccaccctggcccttgtctctatggaagagaatgttcctctaggtttggcccccttttccacccggggcatggcaagcttaaaggacatctttgcttggcctacgtccatgcagagtttgaagcctcaggtagtattgcagcacctgctcagctgagctcagctcaggtgcttagacagccagacctgcctggttatggctcattccagttatgctgcatttgcctgtggccactagatgaaaggccagcctttgaacctttgccctgtgggtagggcttctcatggtagtgtttggggatggtgtatgtgagggtctgcccactctgtgcccatattcagcattgggtccacaaaaggactgagatgtattcatgagttgaccttcgggagaaagagtctgttttgactggagaacatgaacccagatgccttttgttccagaaagataagaaggcagtcttaccatgtaccccttagaagtgtctttttgtgccacaggatggagggactaaggtcaggtggtttctcacatcttccccagacactgacactgagcctttgttacagagagatgataaaaattattgtagtttgaatggtatttgtgcgtttgtcaaagccttgatgaagtttttgtagactttattttattttattttttaaattttttgagacagagcctcgctctgtcacccaggctggaatgcagtggtgtgatctcagctcactgatacctccgcctcccaggttcaagcggttctcctgcctcagcctcctgagtagctgggactacaggcgcacaccaccacgcccagctaattttgtatttttagtagagacgggatttcaccatgttggccaggctggtctcgaactcctgacctcagatgatccacctgctttagcctcccaaagtgctggtattacagacgtgagccaccacgcctggccagttttctgtagactttagctgttgaggcatgagagaagctaggatgctctggctgtttttatctgtgagccctcatgtttcctgtgattgtatctcttacagaactttatattcaaaaacaaaatagcaggaatacctgctcatcattggagttgccagtagtgccaaagacacgcatggaggtgtcaggggctccaccagccttttcttctctacatccttgcccctccccttccctcctttctttctgtttcccttttctttcccttacatcctcccctctccttgaccttcctctcagtctctttcccccatcctttatgttctgtgccaacaccttgtaacattgcatagtctcacccctctattggggcacgtcggtgaggaagacagacacagatctgcctttgtggtgctaggattccagccattttaatcttaccttctccaaagagtatttcagtcctgctttgcagtttcattgataatcctccccaggaagcagctgctcttgtctctccatttctggaggcctaaggcctccttattttgtatttttgtatttttagtagagacggggtttcaccgtgttagccaggatggtctcgatctcctgacctcgtgatccgcccgcctcggcctcccaaagtgctgggattacaggcgtgagccaccgcgcccggccggcctccttattttgatggcttgttgccaagcccactgcccaggaccaggaatggggaggtctgttcattccaggtaagccgaggcaacttccaggcagttctggacctcaaacccctacctggatcctcactgtcagttcgggacaggccaacctcaaggggtgaaagatggcagcactacacattgtatgtatgcaccatgcacatacatgcttgcacacatgcagcatcatagggtgcaactggcatcccccttcatgccctgctgccctgctctgagggcaattcagtggggtcatcctgttggtgtcctcttggcaagctgtttttttggcccctagggcactgcatagcccaggcgtggaacagaaagtccctgtgcctgcaaacagcttcttgtgacctagcatgggggagcccgtagactgggcagcgacccagttaggaaggattcaaagaaccttgaagatgctgtggtccagtggaaagagctctgtgtgttgaatctaaatctattctgctgtagacttgccatggggcagcatcctgacccttgagaggatgtgtgtccctccccagagtaaagtgccctgggagatcttcagcgacatgcaggagcccagggctggtggcgcgggggtaggtcccagagtgaccctctccctgagattgacctgctcctcaacagccagggagcctccagctctcaggtgacagctatagacagtaatgaactgacctctcagggctatggtcgttcactgtgtgtgtccaggcacctgcctggtgctgatgctaaagtctcaactccttcctgggcatgacagtgtctggggcagggtctgcagcatatggaggcttgcaacacgcagaggtttcatgtaaaatgtccttagtgactgtagcctttttttagaaaatcaaatgaggaaacacctagaaggtaggtgtgtgccctcatgtggcctcatgtagcaggttagccacattttattcaggcgtcctgagggatacctcacaggcagagagactatcgtgagagttagggggccggagttgcttcactgggatcaccaggcttcgctaaggagagagagtggaaaatgggccaggttctcctgtcagcctccatctgccgttcacgtcggcatagtcacagttaccagcgtgctctggcattgatgcccatttatggtgtgaactcagagttttctaaatttgccaagatttcaaattgtgcttctaatgccacagatgctgtgtattttgaagcagttttattttgaaatgacaatacttttattgttttaaattctttggtgtcactaacctttttccaaagtcaacaaatttaaaacccttcatcttttccctaatttaattttttatgagcaggattcccccatctagaaagagaatgtggaatgtacaggtgccattgctctgtctgcgctcagatgtgtctgtgtctaggatctcttcagcctggtaggattcaccctaacagtaattgtgacatctcataggcagatagcattagcatggtctctggtcataagagtgaatttggtgacacacaggaatgcctgctctccacttttgcctcaggaaaggtctgagtgctgatcttggcaccctaggatccctctgttgtaagatcaagtctactaatctgccctttgcactctgggcatcctacatcgggcccccatgcagcaacccgggttcccagggtaagactgtggtggctgcagggctccacaggtgtcatttgccctacagctggctggggttctgttgaaaggttcagaggcttcatgcagctgcctgctgaagtcatccattcttgtgttttgttgaggctgtgcagaggggcttcatgtagtcttctctgcacccacagccactccatgtgagctgcagcacttgttctcaaaatggtctttccaaagtctctgatgtgagttgcctgtaagaaattgatagtaatgtcaattaatccctagtatatagtatctgtctttgatatgcttgttgttgcatcacttaggtcttaaaaaaagaaaatgaagctgggtatggtggactgcacccatagttttaagtactcaggaggctgaggtgggaggatcgcttgagcccaggagtttgaagctgcactgagctatgaccacacactgcactgtagccttggaaacagagtgagaccctatctgtaaaaaataaaaacaggaaaaagaaaaccctcttgttaggaagattatgttttatttaaggagaagccctggtgctgagaatcccacagcctcgttttctgggcctatgctacagggttttgtgcaacagggactgtggatcatattggtagaataactactggccctacatagtctcttttgtctcttgtggtcagaaggttagaaggaaggagagatcatccctagccctcagtgtactcatggtggccaggtgaggagggcagatatagagtccctttgaggagaagagggcctgccagcccaggtacagatgcttccctcagggtccaatctccctgatgtcccctgccatggccacacactgagccttgcttctgatccttggaggctagatagttccagaatggccacacgttggcgagggcttagtcaaccagctctgactgcatctgcaaggatgcagtggggaattcctgactgacgggtctaccactggacattctgaggtttcttcctccgtgccacatcctgggtcaaccctggattgtctgatgatatagttcttgatgctgataactggggtgctagggtatctcctctgcacaccttagtcatgactcaggtggggcttgagcactttctctacgcaccttctctacaaccctggtgggctgggacactccctcttaatgccttagtcagtgcctggtgggaccatagatgttgcagggtgtttggaatttggacagagatcctggtggaaaagggacaagatgaaccataaagaggagccagtgcttgctggggacagaagatggagggttagaaattcagtctgtggagcagtcttggagagaaattggcaggcacccagtacctcccttggtcgaaggctgctccagggtagtacagttctctggccagccggtcttgccaggcaagtgcctgagccctgaggaagcaagaaggctctctacctgcagtcagagtctgctctgggagaaagtacacagtgcgttgtgatcccctttaatctctctattttctgtttgtagaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaatatggatttgttaattttacctttttttttctttccaactttaggttcaagggttgttacatgggtaaattggatcataggg

SEQ ID NO: 35822 - DNA, 16782 bp, Homo sapiens
acgggctatttaaaggtacgcgccgcggccaaggccgcaccgtactgggcgggggtctggggagcgcagcagccatggcaagccgtctcctgctcaacaacggcgccaagatgcccatcctggggttgggtacctggaaggtaggtgctcgtgggggcgcgggcccggggctcgcctcacactctccgcgcggcctgtattggcgagggaccccgagtgaccctgagcagctcgccccgcggacgcccggcgtgctgggagccacgcgcgggcttgcagggtccccagcgggctggggtcggccttgcagagaccgggggccttggctccccgggttggccctgggcgtcagggcagcatcctgcgagtggggtttgggagcagctcacgggagcccccgccctaccgcgggcaacccttgatgggcggcccaccagtccgcattttgggtcctagcgggcgccccaagcggcacaacgcgagagggaggcggggaaagtgggcttcacagaccggtggacctcgggcgcagacagggacgtggagccgtcggcaaggtgtgggagcgcagacccagcctcctttccctcgaggcacctgtagcccggttgcctcacttgtaaatagttggtctcaatcgtttcgattcttgccctccctgaggaataagcatctcaagccggtagagggcagagaattaggtggcgcgagtttgcccggacccagctgttaacaaggcgcagtgcggagctcctcggccaggcgccgcctcggggtgccctgggtctggaactcgggagaaaaatctgggcaccccgtagctagttgataattcaggaggcgccaaggttagcattttccctgtaaaacctcaacaccacacagcgtccccgagaagtgcctagccggatgagaatgacaataggacatgaaacatcataggatatgaaaaatgataatatgatatgaaaaaccaaaaataatagcctgagcctgattatctgaaaattgagcaacaaaggtggtggtatgggagctgaggcaaaacctagaatttttaaccttctaagtattgcatattatattccacagccataacctgggtttctcagtttctgtttttgttgtttgcttgtttgtttgtgacagggtctcgttgcccaagctggggtgcagtggcacaatcatggttcattgcagcctggaactcctgggctcaagtgatcctcctgcctcagcactgcgggtagctgggactacaggcgctcaccaccacacctggctaatcttttttcttccccgcagagacagtctccgcttgttgcttagggtgatctccaattcctgggctcaaagcgctcctcccacctcgcctcccaaagctacaggtgtgaaccatctggcaggcccacgtcccaggtttttctcttaaaatttgaatatgggcctgggcgttggatatttacacacagacaagggaagaaaacaacagaaagaactgagtgaactgtgagatgtttgaaataggacagaagagtttacatgtaccctaaaacctgctgttgaaaattagtaaatataaggtaagaaaaaggtcatttgcatcagggagagtgtttcttggccagaatgatcagggtacgtgatttgtttcctccaaaaactccagtggtgtctctaaggttgtaattgaattacaaccatgacaccaagctaatttccatctgttgcatgttatgctcttggaatggatgcagaaggatgctttcttggcaatagcaaatactttctaagcatgatgcaacgcacagatatatacatgtaactggaataaaaattacttaacagtacttaacctatgtaggctgcatttcaatatttttttctattccatttttccaaaaattattgtcatacctccagaagctagttttgtgacccatcatttgaaaatcactactctagggtaaataaggagtaaaagtttatttttttttttttgagacaggggctcagtgtcacccaggctggagtgcagtggcatgatcatgattcactgtagccttaacctcttgggctcaagtggtcctcatacctcagcctcccaagtagctgggaccacaggtgtgtgccaccacactcgggtagtttgtttttaattttttgtagagacaggtttccctatgttgtccaggctgaggagtaaaagtttatgaaagagggtttcagattattcacttgagcactcaatgccccaaaaagctatgtatttgtttaagataacatcacatcataacatctgtacatttaggttatgcattccagtagacagagttcattgagaaattggataatgtctgcttcattcattactatttctagcacttctcacagtgcctggcaaatataggagtaggtatccaaaagttatgtgttgaattcatatgaagaagtaaaacgactttagagatagctgtatggtgaaaacgcccacttgtattcctgtggatgaggagatcaggttggtgtagaattgtacggtgggggcagcggggaatggtgggtcaaagtaatggtataaggatggacttggaatcaacttcctttttttttttaatgacttaaaacctttccctggggccgggcgcggtggctcacacctgtaaccccagcactttgggaggcagaggcgggcagatcatgaggtcagaagatagagaccgtcctggctaacatggtgaaaccccgtctctactaaaaatacaaaaaattagcccggcatcgtggcacgcacctgtagtcccagctacttgggaggctgaggcaggaaaatcgcttgaaccccagatgtggaggttgcagtgagccgaggtcccgccactgcactccagcctgggcgatggagcaagactccatctaaaaaaacaaccaaacaaaaaaacctttcccttgtatgtgtgtatgtattctttcacagatgctcgacagaagatgtgatcctttgcctgtctttgtgacagctggaggaggccctgcaggcaggtgcagttccttattctcctgggtcttcccatgccgtagcggctgtgttgtacctttcagaccctcagcagggctctggtagtctctactcttgaaggtcctcaaactccattctcttctcaggtgagggtttcaggcagatggggagaccatctctgccccagacccatgtggcttggacagggtttctttctggcagtcttgccttctacattggatagtaaacaattacacctgtaatcccagcactttggaaggccaaggcgggtggatcacctgaggtcaggagttcgagaccagctggccaacatggtgaaaccccctctctactaaaaatacaaaaattagcccggcatggtggtgggtgcctgtaatcccagctgcttgggaggctgaggcaggagaatcacttgaatccagaaggtagaggttgccatgatctgagattgtgccactgcactccagcctaggcgacaagagcaaaaaaaaactcggtctcagaaacaacaacaacaacaaaaacccatcacagcattgtaaagccaggaagcttttaaaacagagatgatgtctggtgcccaccagtgtcttgttactgatagtgtttttaatctagttgaaaaattgttggaggtaaaagtcattgtaagtctcctatgtatgctcacagaatactcctagggctgaaggtacaactatgtttctccatcttttgccatgatcactacctccctcccacctaggagccttgtgagacttttttttcccctaatttgccccaaaataaaattgtaatatcagagataatattgtacttctgcttatggccagtagccttctagagggtcacaagctgttctataagctgaggggggtttttttgccccagagaactaatttttgtctctttggggacaatagcacccactttaagaatgcatgaggtaaaagaaaatgtgccaggaaagacttgctccaccttccccaagtggggtaagcttgtgatggcccaagatccttggatggggtgagggttgaggcgctgtgggcatggaggtaacacaggagccagatttactgttcacttccctggtgtctctaaagcccccatctcttcctcttcaagaccaaagacatttaaataagccctgcccctacagggtcagtcctggtccatgcacatctcaactagttggaaacagcagtgtcttagaatttgggacaaattgattaaaacagaacaggaggaagttaatttctgctgccaaacctgattctgagtgatcgtttcctgttccttgctccaggattatcagcacagcattctcatgcttcctactcaggaccgtttctttacccaaagtgaagtttcctttgccccctccccttatcctttgatttcagtagtaacacctgctaactagagaacatttcaaaaatgaagagttccctgttcccagagatccccgtggttaatattgcaaaatatccaatctctgagatactttggttttaccataaacactgtcctgtgaccgtcttcctgtttagcactgtggcttgctttttgacttgcagagggaagagagggaggggtatcttgaagtaactagcaagacctgtaagcaaaagggaagaagactaggttttaaaaggagtgttgtatctgtgtaggagggagacactgattttagttatcagtgtctcagagttggtattagccagccggtgttatcaaaggaggaactaggaccgctgtcttgaaggaggtggtggaggactcaagggcagaggcttctcactgccatcacttggtgccatcagcccagagcatttcaagtcactgcccaacgtagagctttgcagagccagaagttctgggaggaatgggcatgcatggttttgcccatcaagggcacacagattagtggcaggatcgggttagaaacatgtaggatttgtatgattgagctgtaattggagtgtttcatatactgcatttctacagctctcatcagtaatggctgtgcctggatgccacccagcatgttttcatagtttaccttctttttagaagtcaatctggacccctccttctgtttgcattttctctttgttgacatggaatggggagatgttgtcatcctgtgttggcattcccaagtttagtgaatggtttctcaccatagcttaagttggctgcttcatttttcataaggcaaattagtttctctcagggaagggctgtacattgagatcattaacatagaatgtggttgtggatcctcgtacattttcattgcagaggtgactttttccctccagcacctttgatcagcctcccagcacacatgtctccagcgaatggcacatatccaaggaatgatcagcagcttcttcgtgacctcttgcagtcattgctgtcttttacttttctagaaaaacctctcacaacttttttttcatgtcgtgccaacgcaagcttgattatcctagtctgtgctcttttggttccaaagaactgaaaaaccactttaatcttaagcaggaaaaaaaaaagtgtgtttggggtggggattgattgacttccccaaacaacagccgctgacattaggtgtttgagattcagggttgtaaatgttgtcaccaggatttggcctccctccactttcctgcagcagctccaggctgacattctcccagctcagtgaccccagcagaaccggggctggactcaggggttccaattcaagtgcaaagattgagtcttatggcctggattgagtcatgttcctgtccccgcaccagttgcatggcaggcagtgcgtggctaggctgagcctgcggagtgtgccctcagcagctcctcagagaaaaatcaatcaaggcgccatcaagcctggagaaagttcagtgtgtcctgggcagtttcctgcctgggccccagttgttctttctggggtagggatgtcctctgctctccctgctgtcatcagtggtggttgtgcccggacaccactcagggcctgtggtaaggcattctttctggaaattgagattctctgttccttcaaccgtgcagagtggggaaggctgcaagagcagcttctgaggtcctccagtcaaataagaggtcgccaggtcctctgagggtcgtcccctcttaacccacaccttcgatgagcatccccaccctgcctcgctgctccctctgaggtggagagtgagctccatgctaacaggctctggtaacgggcttgttcaactgggcccctttcttccccaaagcctgttgaaaatagctgatgtcaaaacacagatgtctgcagctgctatggccctggggggtttttcttttcatttgtttctaccccagctctccaaaggaatgtgctctgttcattcaacagcccgctgcacatgtttattgctcagctctgtgatcatagcaggatagtgaaagttgggggatacgtgtccatgcagcctacctgggtgccagtgaagcgcgatgccatgtaggcacttcctcctcctcttcagtagccaggctccccacagctgttctggttactcagatggtcaggtggcttggccatggacacccattcagtcattttgccaggtcagccactaaccatttggtgatcttccatgatccacattccccctcgtttccctttaacttatttctctctgctgatacctctgaggggccatctcccgtgtctccaccccttgaagcagatcctcatacagtgagaattgacacatgggcctttgaataaacatcagtgatgtgcttaacttcatgataatctcccagaaccgcttgaaaacaagcgactgccggtatcagaagccatgcatgaaaagagagcgtaaggggcaggcattcactggctgaactggggagccacatgggaattggggtccataggacatctatttttgaaatattttgagatatttgaaggaaatggtttcccttactatctcagcattcagagtgtggggaaatgtttttaatacagtggtttgcaaatcagtggatgtgaagaagcaagaaaatgagatggcttcagcatatcttttaaaagtgatctcacctacacttaagtggctgtcagattctcctacagggcaatgctgtgtggcctttcacttccatcccccgcgtctgaggctgatagtccagaatgctgctgaggaagtgcacgtggtctgtctttgctgaacaaagtggcaggctggtcagcaggtatcggtggctgccactgcccctcctccttgctgtgcagactctgcattctgcggggctcacgttctttctcctttcagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaaggtatcgttccgcggtggggctggaaggggctctcggtcccatcatctgttggtgcatcagcccaaagccaagtccacactcaatacagctacacttttcactgatgggcgattcttcccggggaaacgtatcacccacggccatacagggctccagagctcgcccatccttggctctctgttgaatggtcattccatctgggcccattgcttagagtcccgtgctgatgaggctgaggttgtggattggccctccctttccagggagtcgctttcaaggatggaacttggttcccatctgcaaactgaatctccagtgctagccactgtctttgacctgagatactgatgcacaaaggacatgaggcaggaggatggggctggctccacaaacaccagcccggggggaaagtttcgagagttcttgcttaggcctagggcaggctagccaatctgtccattccattttgtgtcctctggtccttgtaagaggtctctgtgacctggtcatcctgcctgcctttggaaagttaggatccagtacgcagtggaaatgccctcacaaccattcacagcatcatggtaaagcaaatgggttttggggagaggagactgctctgtctttccagccaggaagctgccttgtggctggcaatgatgacatgtgccctctcgctggcttagctgtggtgcacgtaccatgagaagggcctggtgaaaggagcctgccagaagacactcagcgacctgaagctggactacctggacctctaccttattcactggccgactggctttaaggtatgggatgcctggtgcagaccaggtcccttggggctcaggtgcaacctgtggtgtgttttgagctcccttagcagattacgtgtgggtgactttctgttcttgctgctcaaggtatagccagtggaccatcagcactggcatcacctgggagcgtcttagaaatcacagtctcgggccccacgcaggccatttgaatccgcaccagcagtgactcatacgcacacttcttcaaagtttgaggagcactgctctttgccagttggtagatgtgcaatttaaaactgtcagcaaacacagctgctgtctgtagtgcacacagccatgaggcacggtcagccctggccctcccctccaggcacgtgcacacaccaacccccatacacatgagtccctacccacgttctacatgcataccctgtcctgtggaggcccggtaactatttgcagtctagttgttggcacaagaagaacttgagagttactttgtcttttgccttttttctagccactgcctcagttttctgctgtgagccaggttcaaagtgtgggtttagctttatcccgtagccctgttttattgcaccacagcatatcagggctgaagggacttgacttttatcttttgattttaggggtaagctggggaggctgggccaggtggtagttttataggccagtgacccgccaggccttgggccctgtgagtcctggtcttgagtccttcctgtatccacacattgcagtcagtggcggggctagtctctgtgaccaagtagtgtccatgtctccgtctgacagtctcagctccagcccgtttgataaagaagtgttggctatctgcctatttccttttcatagtggcacacagattatccctagccagctgtggtggtttagaattgttttagatgccagcttcccccagcaggtctgtgaaggactattactgattgttttgtttgtttgttttttattgtaatgacagcctgggaaggaatttttcccattggatgagtcgggcaatgtggttcccagtgacaccaacattctggacacgtgggcggtaagacagcccctggttggaccttgttttcgtgactggttccctcttcttcttagaagcaatctgcctgccatttctcacattgcattttgttattctgtccctgttgtttgctctctctttttttttttttgagttggggtctccctctgttgcccaggctggagtgcagtggcacaatctcggctcactgcaagctccacctcctgggttcacgccattctcctgcctcagcctcctgagtagctgggactacaggtgcccgccaccacgcccggctaatttttttgtatttttagtagagacggggtttcaccgtgttagccaggatggtcttgatctcctgacctcgtgatccgcccgcctcagcctcccaaagtgctgggattacaggcgtgagccaccgcgcccggcctgtttgctcttcttatctcattaaagccagcctggctttcgtctcactgtctcttagcttctgaaaggtctaattcactggcactgaagagtgagggcaggacccgttaaactggtgcaaacgacacttctgatcctgtcctttctgggttcgtttctgcaccacacagacacttttctctgtaggccatggaagagctggtggatgaagggctggtgaaagctattggcatctccaacttcaaccatctccaggtggagatgatcttaaacaaacctggcttgaagtataagcctgcagttaaccaggtaaacatcccccaacgacactggcattgcaacgttgctgttttactgtctgatgctggtagggatttctcgtccacctcacccagcaagtggccaggaggcagctcctgggtgttggcagagtcctgagttatgattcagcatgacacagcacatctgggagaggaaacttacaggaaagaaagagtttgagcctggcttgtgacgatttggggtctgacaaagaggcagccatgagatcctcagaactgtgatagttgataagtggctaaagccaagaaaagcctctagggcccatgagaacatctataataagataataataacaccaaggatactacctgggaactgtaggaagttacagcttatctgggaaatagggtgtttgttatacatagttttctgtatggggtagggagggactttagcataggaagcttcatctgtgtcccatcagcgtgtagccacagtgctcccatcagctcttgtttttgcatttgcagattgagtgccacccatatctcactcaggagaagttaatccagtactgccagtccaaaggcatcgtggtgaccgcctacagccccctcggctctcctgacaggccctggtgagcttcccacaggctcatgctcctgtgtcacttggtgaagattagaaaagactaaaaagaacaattcagcctcaaggaagatgtttctgggggtgatctgcaaaacttcccctgagcctcttgctggttttcctggaagggttggagtttctagtagcaagacacctactctttttccaaagggttgggggttcttaacccagctctgaggaggagactggtggctgccctctgaggtcgatgggaggattagggttggggtttctggctgctgtgagtggtggccatgatggtgtgacctggactgtctttctatcctcagggccaagcccgaggacccttctctcctggaggatcccaggatcaaggcgatcgcagccaagcacaataaaactacagcccaggtacagccacttcaggtgttgctgaccgtccacaactgcctgcattcctgacagtcctgttagccaagaggaggaagtgactgagcctgttacaccctcacaggaagtatggttaggggtcctcaagtacagagtggaaagggcacagatcggggttttagaagactctggcatgggctcttagattaatagtgcctgcccccactactgcaagggtgactgccacgagggccagcgcttgttcattcatgtggaacctcatctgtacaaatgtaagagctcttagccgtgcagggaatgttctttctcctgagtggtagtgtgcatttctagccagtggagggcctcatgtggtctcatgatatgcctgagacactgaagcgtgtggcacagtggctagcgcaggactctggagtcagatctggacctgaatgcgtcgcctacctgttgctagctgtgacctgacatcttggagcccctctctgatcacctgtggagttctagcacgtccttctgcaggttgtgtgtgtgagagactgagatgatgggtgcgagtgcctggcatgtatacacactcactgtctccttgggctcacaggtcctgatccggttccccatgcagaggaacttggtggtgatccccaagtctgtgacaccagaacgcattgctgagaactttaaggtaagatcttggctggtcaggcctggccctcctccatggagtgggggatgggggaggcctctcatcctgtctctggagtgtcatctgtgggatcaccaccatcctctcttctgaggccagggagctgtggcgagcaagccaagactgagactgacacctcaccagtggagccgtgtgcaggggcaggccttgggcctccagggccccgtgctgtgcacgcatacacctacacctttgctcaggcccttcagccacaccgagaggttacccggggagaatctcgctcttgagcttcactgcctggacctgccctgcactggagctctgtcagctaccagctgcataaccctgggcaagtcgcttaactgctcgatgcctcagcttccctatctataaaataatatccattttgagggttgttacgaagattaagtgatgcatcagagcacttcacatggtgcttaataccttagtaagtgatcgagaaatgttgctgtgctgataagtccagggactgcaaaggaccctctgggccatttagtccattcaccagctctgcaaggagttcgtgtgatgatgggcagagcctagacctgtgtcaggactctggcgaagcgctcagtgtggcagctggagcagctcaggctacttggcgccacctccctccctgcctgcccttgcagcattggtggcgggggtgtgggggagggggggggcacgcccaaaggagagcagctcaggggagtcctgatggcccaagagcctctgttctcactgagcaaagtggctctgccagggatgctctgtctttatccaagatctgtgccgagcgcagcacagccatgggcctggggctcttgggcaggccccagcttaggtgagcagctgattttgcccaattccactgcccaaagactgtggccatagtgcctgccacctgtcacatatgagacagggatgagagtgatccctgaagagggaagtggagctcattgtttaggagaggagacgtttttcttcttacgtgcaggtagatgttctaagtacacaagataaaatggcaaaacagtggccactgagggaaaggcatatcccaccagagatgcatcgtttgtttcgtatttcattttttaaggaattaggaaagaaaaaataaatgactaatctcaaaatgctaacctaattattttatttttgcatcttactgtatagcttttgcacatttttctgtgatcataaccacagagcctgtagcagactctctttctgcacattctgtgatcatctgaagctaagagcccttcggctctgggagtgtgtgtcagcctcttgtgggtctcacccagtggtgcctgcctgcctccctccctcccagcctccatgccagctgagttctgtaccgtctgctgccttcatgcaggtggttctcttctcccagtatacctttcttgccctctctgtcaaaatcttatacttcttaggccatgtcaaataccatctcctcttcggctgtggttgttcagtttcccggctggaatccctttggaatacctctgcccttcctgtgctgttgagtgtcttatacagtgtgtgattagttatttgtattacagttgtagaaatacctctgccctttgtttgcttcataaaatagaggcaaagacacatcttacccataattatattcctcactgcaacttatcacaatagaagtgctcagtagtgttttttgaaatgaaataaaatgtatcatttccctgggaggttctggaaaggaaggactgtttccatcgttccatatattatctagcccaacatgcacatttcctgaatactaatatatcagcttttcctaagttcagtttatcttatcgctcctctctgctcaaagccatggaagacatctgggtcctgcacagtattttgtcttttatttttatttgcagagcttactggatttttttgtttgttttttaggtctttgactttgaactgagcagccaggatatgaccaccttactcagctacaacaggaactggagggtctgtgccttgttgaggtgagtgagccccagtgtgaggagcagttcccaggagatattcagatgctgcacagcaagagagtgatccctgcaggcctcagcgccaatgtgctctcgtcacagctgttcttgctttgcacattaccttgctttctcagccacgtgacttgcatcagctgaactgcatggagccaagatgccaagagatccgctcttgatatcttcttccagccctggggcattgttggcctggcctgaagtaactacatattttggctttccattcaatttttaaatcctagcagttcatctgaaactaggtgatcccaggtgaccctggatcaaactctggaagaatttgcctgtgactttttgtcttaatgaccctaatgaaaggggtttggtcgggagcccctggggctgaggtttgagacagtcccggctctgacctggtaagccacatggctccaaaacaggccctccctctgagcagcaggcacctcagttcctccagccacacatcctctggttctgtttcctctgcatggtagtttggaaggagctgcctaggaaggttttctgtggggttttctcttttcctaccattacaataactaggtgacgcatgtaactcactttctgctttcaagaaggaacttctcattttgcagtggagactgagactctgtttctctctcactacccttattcttgtctgagctctgtgtttccacactctctcctttagtacttcctcttctaagcaaaatgtgaacattccctaagatggggtgggctaccagctttccctttccagcgtctgtcccatctccctccccggagtttgcactgctggtggcttcagccaccgccccaggcagatgtttgcccagtctgcgtcctggacaataactctggccctgcttcaggcatatgcgtgcctggcaagcctgctgctgccacactgtggcctcacactcaaaataggccgcaaacagagcatgtcacaggcagccccaggccagtgccctttcagacatctctgttaatgctacttagccctagacattaaaatcatttttggatctagtggacaaggaggagaggagtgaatcagtcaccaagctacattcgttctcctttcagaatctctcccattcatccgtcttccttttcccctcccacttgagacagagtggattgaagctttcagggctgaggaaacacagtggttttctcattgctccctttacagttaggctcctctgccctccagtattgtgctagaaacttctgttcgattatcctgttgcgtggcggtgagtgggaggaagaggctagccctgacatgctcaggtctcctagggagttttcgctaactacacacacaccacccctctggcagataatgctttactgagcctgacctgctgatgtcagtgtcactgtgggtatacaaaaaaggcagaccatggagaacttttgaataagagttacagactgtaagcacccagctcagattacataactctggccttgcgtgagctgcccagctatctgtccagtgttcctgcctttatgttcctagcacagccattggccctactagatggacagtgagtgagccttgacaaacacgtctgcacctgtgctccctgccatgtgctccctgccctgtgctccctgccctgtttccaatataaaatcgccgaccgttgattgggctcacttcagcccccactgatacaaggaggctccctctgtcctcagagcacttgccgttgcttctcttatcctttgagattcagtcacatacagacttttaacatccctttttttttttgaaatgggctcctactctgtcacccaggctggaatgtaatggcatgatcacagctcactgcagccttgacctcctgggctcaaatgatcctcccacctcagcctcccaagtagctggggccatgggcatgcaccaccatgcctggttaatttaaaaagtttttttattaagatggaaatcttgctatgttgcccaggctagtcgcaaacccctagcctcaagtgatcctctcgcttcagcctgggattacaggcgtgagccactgtgtctggcctgccttctcatattattacacaagatgtttaagaccacaaaatactgtctggtcctgccagctagactgagttactggaaggcagaaatcgtgttgccgtcctgcacggcccaggcacagtgctgggcacatggggagggtggtgtccctcacacatgtgctgcttgatgacagtagtggtagaggggtctggagggtgagttgcttcccccagctgcagaaccatcatctgcacactcagaactagcttgttgcctctgaggttctattttatttcttcagtgagacacatcatttctctgttgggagttgggtatagtcaaaatcacctcttcaaaaagcaactgttttctcctttctcctgacagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgag

SEQ ID NO: 35823 - DNA, 452414 bp, Homo sapiens
gtttttcagaatctccttgagacattagctccaggcttaaaggcaattctgaaaaaggatatctatcagaaaaaaggacactatttcataagggttggtgatgctgagttcgaatacaattcaaattttaggtaatgtgccacagctaaattgagtcaaatgtctatgctttttaagataaataatattgaatgccttgtatttcagtcctgtcaagcttctacatggaggaaaaagtaagattgtctttggaatattctttttgtttttgtgttggcagtagtattcatcagtatacagaagagataaccgatttttatcaagtcactccaaaccaacacttttcaaactgtgcatgataaaatctgtgggttttatgaggagtcttcagaagctatgcagaggggagcaagcgagaagcctggctctgcttgtttgttctgtttgcctaaccttttatttgggcgagaaaagtttctgcctctttaaaaaacacacacacacaaaatccatatttaatatctagagcaaaaagagatttttgcctaggaagataaaaagctttatatccatgttcccagcagtaaagggactccaggaaatccacttgtactagccaatttcacacagcactgttacatagatttgattaccacaaaaatgtgattcccaagaaataagatgtttgaattgttaatgtgcattctctccttgtatgcaaagctacaggaaaggccacttataataagagccttctgggtaagcaagtaattggcaaaggaaactagaagactttagccatccttaggctggtgcttttaacttcttcccaggaattctgacggactgactccttaccaagcggtgctgactcttaaacctgttggtcgctgtgtcctccccactgtgcagggctgcagagtctctcatcaaattattactccttagaattctctcttctgtggccgggcgtggtggcgcacgcctgtaatcccagcactttgggaagctgaggtgggtggatcacctgaggtcaggagttcgagacaagcctgaccaacatggtgaaactcctgtctcaatgaaatacaaaaaaaaaaaaaaaaaaaattagccaggtgtggtggtgcatgcctgtaatcccagctacatgggaggctgaggcaggagaatcgcttgaacctgggaggcagaggttgcagtgagctgagatcgcaccattgcactccagcctgggcgacaagagtgaaactctgtctgaaaaaataataataataattctctcttccattaataaaacagtttccaaagtatgttcctcaaaacatttccatggtttaataggtatcactcaaaaaagggatcccatggctttttaaagtgggctaaaggtaacagtcctacgggactttaaaacccctttattcaccaaaccctcttcagaaaatagtgttgtatagactacactttggaaaacactgcattaacccattcttttttcttgctagatataatttgcttgattaagtaacagtgctaaaaatgctaatgaagttacattttcctgaatagacaacatggtccccatgttaggaatgtgtgttgagaagctgctggagggcactgttgtagagggcaggcttcagtgatagacctcactctgtcattttctggccatgtgatatgggcaatttgtttaatatcattaagcttcaatttcacccttcataaagtggaatgaagtattgtctctgctttattaatctgcccactcttcactatgactgctgctgacaccaccctgctccacgccaccatcatttctcacatgtaacccagtctgccagcttccctcttcctcctctgcctctcctcccaggctattctcaagatggctgctacatgttgggtacaatgtacactgctcaggttatgggtgcacggaaatttcagacttcaccaccatacaattaatccatgtagctttacttctaaagctattgaaatttttttttaaatgatagctgctagagaagtctgatttaaaaagaccatgtcactcctcaaatccctccattggcttctcactcactcaggtaaaaaccatggttttcacaatgatctagtggcaagtcaaaacttctactatttaacatttttctgtactccatccttatgtgtaaactaaacatagtatgtacacagtctgtggttgtatttttttaagacttcaatgcaaatgtattcatataatataaattgaaagtgtactttgtatacaaagctgaaaaacactaaaaatcttgtgtacttccaggaaaaatgctttatgtatttttaaataaattggttcatttttttcttctacatgttctttgaataactggtgcctttctcatgttcaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggtaagtcaagatatttagtgatagtaagagatctttgcaaaggatagaataaaaagttataagaaccaaattttgaatttgagccaaaaataccaaatctccatttccaccaggtaactgataaaggtaggtgaatcaccccatttctaaacttaaatattgtgaattttggtgtccctcagttccacttttgcttcagctcattgtgttgtagaacatttgccaccctgtaactggtataagttctaagacaaatcttacggaatctagttagttccctccaaggctctatgcctgtacttcaggtacagacatctgttatatgtctcaagttagattacagagactcaatgattgggttttccccaagtattaataatgaaaagatattttattttatttttctttattttttattttttttagacagtcttactccatcacccagtctggagtgcagtggcgcaatctcggctcactgcaacctccgcctcctggattccagcaattctccagcctcaacttcctgagtacctgggattaccagcgcatgccaccacacccgacttaataactaaaagatatttttaaagaaaataatccagtgacttttatgtatcccattaaaacatgctgttggccgggcacggtggctcacgcctgtaatcccaacactttgggaggccgaagcaggtggatcacccgaggtcaggagttcgagaccagcctgaccaacatggagaaaccccatctctactaaaaatacaccagcctgaccaacatggagaaaccccgtctctactaaaaatacaaaattagccagacttggtggcgcatgcctgtaatcccagctacttgggaggttgagacaggagaattgcttgaacccaggagatggaggttgcggtgagtcaagatggtgccattgcactccagcttgggttagaagagcaaaactccttcaaacaaacaaacaaaaaaagcttttaattaaagtagcagtagaaattattttcttcttcagcacaaaaaatatctaagaaaccacaatctttactgcatctaaacttaaagaaacataaattcctgagtcacactgatgtatgcccctaagtcaactgtgataaaatacagtttatctaacaatggactgcctttctattttaacttgtgactcactggaacttgaaggtttctcaaacactttagtcctcaagagtatgtatagaaatcatctgtagagtttattacctttctttctttttaaaaaatacaaatgcccagtgggtaccgccacagacttactgaatctgaacttccgcacatcgggccctggcttatatttattttcgaagctctctacacaattataatgtccacttctgattacatattatttgtctaatctaaagcccatggtctgaaaggcaagtccatttgttaccagatactgtagtaaaacaaattaaaagctagtttttttaaaaaggcaaaattttaccaatagtaataataagaatataatttttgaaaggggaggaaaccaagtttgatagggcatgaagcacccatatcctgggagcaatattgaccatttcaaacataaaagaacccagggaattaaaaacaaaacaaataaaaactacttgctgatgaggtctcactgaatgagcaatcaaaatcagaaagtggaaggaaacctgagtacagtcacctcacagttcatgcagagaagtcaatccatcctgtttaaaattaaatatatatttttattttttaaagtaaaggttgaattctttaattgctttcatcatcttttcttataaccttagaagaatgttttagaaactaatatatattatattcaagaaatgtttatctgagattcatcaattccattgattctttttcttaatgccagtaaaggtaaatttactagtcacttaaaacacagtatttatagtaagatccatttctcataaacacacacacacacacacacacacacacacacacacattctatttatcaatctattcacttacccttctatctgcacatatgtatagagagagatactttggatgatgttacctatgtgttaacactggaacttttggggcggggatgccatgggtcccacccccacccctcacagcctgggtccacacttgccctcttgcccctcctcttggccggcgctcacaggtgctactaggtggtagcccattccttatcatccagagctggaaccacattcaccacgctgccttggacttcccggaagcaagacagatctgcctgtcttgtatcagtgcaatgtcttgtatcagtgcagtgatgaatttaagccgttcccacattgtagttacaaacttttccccaccggaaggatgtaggtccccactgttagacatttaccttaatgttgatatttcttccctaacaaattgctgcaagtaacagcactttgctgagacctgtggccaaaacaagaataactgtgatggggagttccagtattgcctctttaaggtctgctaagatgtgcagaaaacactgacttgttcagcatgttcttaacctttgacaaagaacttacgtttttatggcatacaactgccttagtttggggaaatgattaagaccttacgagactttacattttgtttaaagcctcaaacaaacaaaaacttaagtagggaaagtagtggggagggcatgcctttcctcctaggatcctcctgagtgttgttgccttaacgtgccattgtcttgacccaattccaaaaagagatatgtgttaaatggagaatttttaagagaaataaagtctgtaactcaatttttgcaaccatgtttacaaaaaaaagagcttaattatattttatattagaaatacaggcaaatcctcacttagaagcatattttttattatgaaattttaaatacacatttatgcctagaggacctgactttattccttttcaatgttaattatacctaataaactgtttctttataacacatgaataaattgtgtttctagtaataaggctaattacatggacaaggcttctgtatctgttttttttgtaagactggagccatctgctggtaacttcttagggagcaaaatatctaagtattatataatatacatagaaggtgacaatcaagattcagaagcacagccactcccattttatgaaccactcttataacaagtcatattttgctataaccttcacctgaattgaacaaaagatggatttgatgagataagtgaaaaggggtttaagataacacacattagggcactatatgcttttattgtgcctttgctgtttattctctaccatttgttccttgtagtagagtctggggtattttttaaagactgtgatctttgagtaatagtggttttagtaaaaattgttcttgaaaaaaactaaattaagagatgccttgattatatacataatttttcctcctcctttctaggatttggtaaaactgggcttttttttttttttaacttttaagttcaaggctacaagtgcaggtttgttacataggtaaacttgtgtcatgggggtttgttgtacagattatgtcatcactcaggtattaagcccagtacccattagttattttcctgattctctcccttctcctactcactaccctctaatcggttcctgtatctgttgttcccctctatgtgtccatgtgttctcatcatttagttcccacttataaatgaaaatatgcagtgtttagttttgtgtttctgtgttagtttgctaaggataatggcctccagctcagtccatgtccctgcaaaggacatgatcttgttcttttttatgactgcatcgtattccatggtgtgtatgtaccacattttcttcatccagtctatcattgatgggcatttaggttgattacatgccttagctattgtgaatagtgaaaactagccattcttttatttatttatttatttatttatttatttatttatttattgagacagtgtttcactccattgccacactagagtgcagtggcacaatctcagctcactgcaacctccacctcccaggttcaagtgattctcctgcctcagcctcccaagtagctgggactacaggtgtgcaccatcacacccagctaatttttgtatttttagtaaagaagggttttcaccatgttggccaggatggtctcgatctcttgacctcatgatccgcctgcctgggcctcccaaagtgctgagattacaggtgtgagccaccacacctggccagaaactagccattcttgttgcctcttgttttctctttggttgattgcccaaactcggtgggaaatggtgtggtagggtgagtactgtgagagatggtccatgacttaggtccagacattactgcaaaagcttcacctgcatcagtaagaatatggtacacagactgtggtatatactaatttcattattcccagcaatggtcatatcaagctgaaatactgtgtttagttctagatgccacatttttaaaaggcttgtttcaaactaaaatgtgtccaagggcaagaatcaaagatagtgagggctctaaaaatcatatcataagaaaaaagcagttgaggaaaatgggaatgtttagcccacaaaacagaagagtttataatggaaacctgagagctcccttaaatatttgaagggaatagatttattatctatactttctagagaagtgctttttcaaaaggtgagttgcaatctattagtgggttgagaaataaatgtcattggtcatgatcagtttcatatgtttaataaaatagaatacaatacaaaatatcagaataaatcacgtaaaataatggcacacttgttattttttgaaaattgattttaatattctatgtgtatagtgggtcatactgtaaatgtattccttatcatggaatggttgcttatcatatgcctgtaaaaaaaataggatccaccaatactaaagtaatataaagaagagatgacggagtgggaagtgaggtgtacgtactattaatcaaatttattaatcaaattcttattagaaatattacctaacttcatttaagagcccgtctctgacataaagccaataagaagccaacagtacaaacccttacacaaagagtgcagagtgaggaaatagccatttactgttacaatagtctttatttaacttcactttttgtttgtctttaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtgagatattctttagtgtgaattttacatgcttatttaatctcactggattaatatgttatattttccctataggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagtaagtaaaagttactattccggattcagtaaaagtccattaaaagtgtgtttccttcctctaaggtgctccaagtcaatgcctctataattgattaaagtaaaagtagcttgaggtcaagcacctccactgttactcaataattttttaatgaatgaatgaatacataaatgataattactatgattattataatcctaacctacaaagcagaatatctaatggtagtcaacaggaacacacccaaacataaacattgattggataccttcaggagttaaaccttcccccacaccccaattagagttgccctcactttcttacgaaaacctggttgaaaatttgaaacacaaaaagcatgtttatccaaaaaggttagacacaattatttaattattgaatcttctaaatgtttctatgttgtatttttaatatgtttattgtctaaactgtggtcaaatacatataacagaatttatcatctcaatttttaagtgacattaaatacagtcacgttgttatgctgtgttgtaagttttaagtctgcaagatggcagactaggatgctataggctcccttccttcacagagataccaagttaacaacaatatacagatcagaatacctctgtgagaactctagagatcagttgagaagctacagcatccaggctattgtaaaaccgagaagagattccagtgaaaggggtaggaaattttgcatcatttgacacatgcctattcatgcctccccctctttgtggtataatgtggaacaactgacaggaaatccccccattacagagttcctccctcggatagaaacaaaagagtagacagtgcatccagtgttctggcttgtctaggggcctcccaagggactagtttttgtcttgcctgactcagaatattgataagactggcatcagagtttggaagccactaaaatccagatgcaagcagcacattagacctgcagtttcacagggagaacttaggaggagcaagggattagaaaaggttaaaaaggtcttagaacctccaactaggctgattggtgagggttttcccctgcacgaagccaataccaaagactgggaaaagtggtcaatttttcaaatgccaatcctggaaaaaaagatacataaggcaaacaaagacacagggggaaatggcccaatcagaggaacaaaatgaaactccagaaacgagtcccacagaaatgcagatctatgggctgcctgacaaggaattttaaataactgtcataaagttgctcaatgagctaaaataaataaataaataacagagaactaaataaagtcagttaaatgatgcatgaacaaaatgagaatatcagcaaagacataaaaactataaaaaagaatgaaacaaattctgaagctgaaaaatgcaaaaactgaactgaaaaattattacaggggttcaacagcagacttaatcagacagaacaaagaatcagcaaacttgaagacaggtcatttgaaattatcgagtcagaagagcaaagaaaataaaaaattaaaaagcaaagagatcctaagagacttataggatgctgttaagttgaccaatatatgcaatatggcactcccagaagaagaaaaaaagagagaaaagggtagagaaattctttgaagaaacaatcgctaaatacttcccaaatctaaggaaagaaaaaaacatacaggttcaagagttcaaagaactccactaggataaatccaaaaagaaacacaccaagacacattataatcaaactgtctaaagtcaaagacaatgacagaatcttgaaagcagcaagagaaaagttatttgtacatacaagggagcttctgtatgattaccagtgatttctcaggaaaaactttgcaaactagagggagtgagatatatattcaaagtgctaaaagaaaaaactctcaaccaataatactgtatgtgtcaaaactgcccttcaaaaatgaaacaaaaattaaggtttctcagataaacaaacatgagggagtttattaccactagaactgctctacaaggaatgctaaagaaactcctttaagttgaagcaaaaggataatacacagtaacatgaaaccatgtgaaaaatgtaaggttcttcagaaaaggtaaatatgtggataaagatagtaacctgtactattgtaattttggtgaatgtaacttaagttacaaaaacattttttaatctataattatgttaatggatatgcaatatataaaaatgtaacttgtgacatcaataacataaggggtggtgctaaagccctaaattagtagattttgatttctttttttgagacatagtctcactgtcacccaggctagaatacagtgatgggatcatagctcactgtagcctccaacttctgggcttaagtgatcctctcacctcacctcccaagtagctgggactgcaggcacatgccaccatacccagctaatttttttaaatttttggtagagacgaggtctcactatgttgcccaggctggcagtagaatttttgtatgggactgaagttaagttgttgtcagtttaaaatagaatgctataaaattaagattaaattatgtaattgcaatagtaaccacaaagaaaatatctatagaatatgcacaaaacaaactgagaagggaatcaaagtatatcaccacaaagatcaataaaataccgaaaaaggcaataaaagaggacaggaagggagaaagttacaagacatacagaaaacaacaaatggcaatagtaattccttccctgtgagtaattactttaaatttaaatggattaaaatcttcaataaaaaggcatagattggctgaattaatttaaaaaacagtatccaactatatgctgtctacaggagactcacatctaaagaaacatataggctgacaatgcaagaatggagaaaaatattccatgcaagtggtaaccaaagagagtaggagtggttgtactaatatcagatgaagtaaacgtgaaatcaaaactgttacaaaagacaaagacagacatgagataatgataaaagggtcaattcaccaagaagatatgtagtaataaatgcttattcactaaacctcagagctcccaaatacgtgaagcaaactttgacaaattgaagggagaaataagacagcgacccaataatagtaggagacttcagtaccccattttcaatagcgaataaaacaatgaaacagaaggtcataaggaaatagaggacttgcacaacactatagatcaactggatcaaacagacatacacagaactgtcttcccaataacagcaggatatacattcttcttaagtgcacaaaaacattccccagatagaccacatgttagaccataaaacaagtcttaacaaattcaagaagtcataccaagtgtatttgccaaacacagtggaatgatactagaaatcaacagaatgaaaactgaaaaatccacaaacatgtagaaattaacacactcttaaacacccaataggtcaaagactaaatcacaagggaaattagaaaatacttagagacaaatgaaaatgtgacatattaaaacttaggggatacattgaaagcagtgctaagatgaaagtttataactgtaaatacctacattaaaaaagaagaaagtgtacttaaattttacctcaagaaactagaaaaacaacatattaaacccaaagctagcaaaaggattgaaataataaagactaaagcagtgataaacaaaatagagaatagaaaaaaaataaacaaaactaaaggttggtgttttgaaaagatcaataaaatttgcaaaccttgagctcagttaactaagaaaaaagagagaagatgcaaaaaataaaaatcaggaaagaaagggacgacattaaagtagatgcagagaaataaaaagatttctaaaagactaccatgaacaattgtatgccaatgaattggataacctagaagtaatggataaattccttgtagtctaccgagactgaatcatgaacaaatagaaaatctgaacacaccaataacaaggagattgaactggtaatcaaacactgccaaaaaaaaaagaaaattttaggaccagatggcttcattgaattctaccaaatatttaaaaattaacataaattttcctgaagctctttcaaaaaattgaagagacagaaacacttcctaactcattctgtgaggccagcattattctgatactaaagccagacaaagatactacaagtaaactacagaccaatatttctgaataacattgatgcaaaaatcctcagcaaaatactaacaaaccaaattcaacagcacattaagaggactgtacaccataaccaactagagtttattctcagtttcacaacagtatgaatatatttaacactactgaactgtacacttaagaatggttaagattggctgggtgcagtggctcatgcctgtaatcccaacactttgggaggtcaagattgggggcagatcactttaggccaggagtttgagaccagcctggccaacatggcaaaaaacacaaaaattagctgggcattgtggcacacacctataatcccagctacttgtgaggctgaggcacaataatcacttggaaccgggaagcaaatgttgcagtgagcagtgatcgtgccactgcattccatcctgggtgacagaatgagactctgtctcaaaaaacaaaaacaaaaaaggtttacatgataaatttacttatatttttaccacaataaaaacaattacctcttacgtaatttttatataaagtagctttttatattttatgtaaaatatatttttatttctatgaagtaatttttatatgaaatagccttaacagtacatctttgtcaagtatctactttgtaatgaataactaaaaggtaaaggtttatctcttctaatgtgatcatctttctttttttatcaggcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaagtaagaaagcattcagtgttttaacctaacttaagtatgtgtgtatgtgtatggattttcaatttgtaaatgtcgtacattatcttacattatgaaaaaattgaagggaggactataactacattttcagcatgcacatgttattcattataatcctcataacaatccctgaaaggattataatgaacttcacgagaaaatctgattagaaatcagaatttcagagagattaaatacaccacactagtttcattacaccaggctagttttgaaccttgaatctgaacaaacctacatatttcattcattttaacaaatgtgtgtttttaaaattacatgggaaaggatcttaccttaaattcaaatgacttactatttttagcacatcttttgctttttctttttccacttcgaactctcctccgtttttcgctactaccttcactcataacacccccactcagaatacaacctaatttgtttccttccacatttttctctacttcacttcctgatttttgccaaaatagacaattatattatgcaataacataaacatccttatacatttttcctttgcttttatttctgtaagataaataatcagaagtggaattgctggaacaaaaggaaattatttttatgttaacagttgctgccaagttgctttcttgaaaagtctatgataacttatatttccaccagcaatatgaatgcccattttccataggagtattgattttttttaaattttgcccatctgtaaagtttaaactcccattagtgttataaataatttgcttttgtcttattatatgtattaacatctatattcaaatatttttctgaattttttattgtctattgaatttgtttttatagtacctatgctatatgcgtttaaatgtttgtatagtcaattatgtctattttcttcctttaaacattcttgatttcaagttcttattaagaaggtctcctcctcccacagttttctctctttgagtcattatctttttattttgttgcgtttatcactaatatatttgggacccataatttattatactgtaagagtcagttacttttatttaaaagaattctttattgaccctttttgtaaagtgaagatctttttattttgcaaataaccccaaattatccatttataactataccttcatgtatcatgaactttttttaagatcaacacatcaatattatctgcattcaaaaaagccgtttctataacctaatttgtatttaaagttagacattgggaaaataccatagaaataagaggtaagtagaaatgataagtgtatctgggagagctggaaatgaagactagaaggcttcccaccttgcaaaaaattgtaatccagtaggactctattgtggtggtaagaggggtcagtattaaatatatgtaggtagatataatatttaatttttcaaaaatttgataatctggttgcattttcatttgattctcatttcccatatcgttatagctggattatgaatagaaacctccaacctctacacttactagtttacattcatcagaaaaacaccacatatacaggaacaggttatgatgtgttggctggctatgcctttggcttctcattttatttcttcatctgtccatcatcttgttatattactattcattcaccacttcagttggtccaagttgaaacttaaatctatcttaacatctccctcttttgaggtgtgaagcatagctagtgatgcctcaaagcttatagaaataaagctcactttaaaagtcagccatgtttagaaaaaaaaaaaagtcacaattttatgacagaaattttcattgtgatatgttttaatgataaaaagtatttgactgttaatgccagtttctttctctaaattatatctagctgaacttttgaatgaaaataaagaaacgtgtaatcctataaattttccctgggagaaactcacttcatttcaaagacttattttggtaagatatcttatgaggaaatattaatattctaaatattttgagtgctttattagtaacttaaacccttcaaaattaaaattttacaagcaaagtgtatttttaaagtacatttcgtgaacgttaataggagagggaagcacctacgcctccccttaatgcttctttcatgtggagagtccaatgtgagtaacattcctggagtccctctgtcccctcatttattctcccccagaaaggaggactcatagccctgtcccttttgggatttgtctgcctataaagaacatactttctgcctgcttctccgtgccataaaccatacaggaacagaccttggtcctgtagggagaggccaatggctgaccagcactgcttgtgacaggtaagtctgtctaattctaggttctgtatgaggaagcacatttttgcctcatacctaaaccacatccaccaacatgacctttattattaataaaaggatatttttgcccagcacctctatttctcaattgtttcagaaactggctgagggtagaggttggtggattatgggtatgcatgggtgtcatttatgagcacccctaacacatgaaaagtttagtatgtgttaagcactttacatatattattctatttaatacttataatagtcttggaaggtaggcacaattatttccctcattttacagattaggaaaccaaggcttataaattgcctaataaaccaaggcttataaatctcagacagcatggctctcatatctgtgttcttggtagtcatactatattatactttccaggctagatcatcctaaattcatccttattgccttaaaaaaatctttattttgacatttactccctaatttagtgaagggaaaatctctcatctcatttaaattccttaaattcttcatttcctgaaattcttgaaaatgctaacctggacaaccagtaatccttttgatttctgccttaaactttattcttgcaacactttaaaaattctctctatgtagagattgcaaaatatgactgcatctggcttacaaacatgttttatttggcctgaagttttgtttggttttttacaacttttcaggtgcaatttattactaatcaaatggatttgaacctatgatcttgcttagaagacttctgtcttaattcatttggcttgctgtaacaaaatagattgctaaaacccaatagattgggtaatttataaacaacggaaatgtactgctcaccactctggaggctgggagtctaacatcaaggacccagcagattcagtggctggtgagggcttgcttcatgggtggcatcgtcttgctgtgtcctcacaacaagaaagtctttctcttttctttctttttttattttatttttttaattaggtctcactcgtctcactctgtcatccaggctgtagtgcagtggtgtgatcacagctcactgcagcctgaaactcctgcctcagccacctgagtagctgagactacaggtgtgcatcaccatgacaggctaattttttaagagatgaaatctcactatgttgcccaggttcctcaagacttctttataagggacctaatctcaccccgagggcagagcccccatgacctaatcctctcctaaggctccacctcttaatactaacacattggagattaggtttcaccatataaatttagaggagacaccagcattcagaccatagcaacttccaagtttttaagcaaaaataactaaaataaatatcagattttttaaaaaaatatatgtatacatatcttgaagtgagttgttttctgggttttattgtgataaaatatagatacattatttcatttaatcttcataataatcccttttaaccctttaagcatgcagttcagtgatatttagtatatccacaatgttgtgtaactatcatccccatccatttccaaaactttgtcatcatcttaaatagaaattctgtacctgttaaataataactccccagtctctcctcctgacggttgctggcaaccacaattctaccttctgcctcccatcatgcttatgtctggcttatttcacatagcatgatgttttcaaagttcatccatgttgtagcatgtgtcagaatttcctcccattttaaggctgagtaatatcccattgtgtgtatatatcatgtttcatttagccattaatccattgagagacaacaaaggtttgtttctgccttttggctattgtgaacaatgctgctatgatacacacatttgttttttgttttggtttgagtttgggttattttttatttttgagccaagatttgaaaattgagagatttcaaataaaaatccagatttctggccttaggcaacactgagcccacattcctcaatggcagcaatagctagagctgagtagtgtctgtccctttggcccagtgcactacagtcttcactgctccctgctacttcctgacactgaagttgaatgttagttgccatttgtcatcatatttgcatctttatttttcttttagaagaggattttcttcttctatccaacccacttctctaatttttgttatctatctgacaacttcagacagattgatacctcaactctacatgtggattattgacatagtagtgacatgaaaatatatttaagctatattaattgacaaatacaaaatactgaataatctgtatagaacaacttcatttgtggagaaagggagggacgtggagatatgcctgtatatgtgttgaaaatatctagaaggagccacaagaaacaatatatctggggagtaacaatataagaaacaacgtatctagggagtaagaccttcactttttcatttttacctttttgcattgcttgaattttatgtagcaaggatgaattacctgaaaaacaaaaataactagactttaaacccatgccacattaccttcccccaataagttcccagtgattttagtttatgaactagaaattttatgagtatagtgatcctatcttccaaaccagaagttggaagacatggtctgatcaagtgttgagtgtacatataggaaaactaagttagttatttaaaactgagcctgacctgtaagagttagaaattgagattgtcacataaaagattaagttaaaatatattagaaagaagcttgccctagagaaggagaatttctcagagttccatgaaggcaaggactttgcctagctttttcaccccttgccactgctatagcctattggactgaaaagaggggatgaaagaggacaatgaaggaatatagacatgcagaaaattatcagaatgatttgtggttgcttagaaaggagctagtgaaattgaattcaacagaactctgtttcttctaccttccctttctctcctacctctaaaaaaaaaaaatagtcctcaaggttaaaatttacaacagtggagaaatgtaacaaaatcttgattgatcaatagaataaaagaggagctaatggcacattggtgacaaaaaaattatgttgaccatttgggagcatagattgtctgcagtgatggtatcggggaaacacctaatcatttgtttcactcaacgattctaacactgtctcactaactgggtattctaagtgaactctgctattagacctagagtctttgtgtgctgcctcttttcatttttaaaaatataattaaaagaaaattttaagaataatttttccaaaacataacagaaaagagcagaattcagcataatgattaaatgtgctgtgttaaacatattgccaatatttgacagtttttgaaaggtaaaaatggcaacttcccatggtccaacctggtacatcaaacaggcacactgacgtgtgtagcttcagttttgctttaaatgatggagtcccagatgttgaacatgttcaggacatattttatggtcattgtgtagacaaatatcatgtaagtgatttgtataaaacagtttttatgggaaaggtctttcctctgaaattttcaatgatttccagtataccctgaacctctgtttactatgcatttatactgtttccaaaatcttttagtccatctagcattcttttcagatttgtattctaattgcttaaacatataaagattgtgccatttgttttcattttattaatggaagaattaatacttttccagttgtgtcatcctgtattttcatccctccaacaccatggggttttcttgctctagacatgtatagcagagcaggaagaaaaccgaggggaaaaaatttctttttgcagaattagggagtataacttggatctttacaaacaaagcaagagctcactcagagtgtgaaagacatagaggcacaggtagcgctggtatctaagaagggccacatgatggccacaggaacatggtggcggtttctcctccatgcatagtctgtcccattaagcttcctcaacaggaaaactctggctgaaaagctaaaaaatgaatacttcttatttttgtttcattttaccatagggaatatctctctgggtggcttttaattttaccttatcttccatgttttcttttttaggtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatggtaagctatttgtgaatagttaagatgatcgatatggtttggctctgtgtccccacccaaatcttaccttgaattgtaatccccataatccccacatgtcaagggcgagaccaggtagaggtaattggatcatggggatggttccccccatgctgttctcatgatagtgagtgagtctcttgagatctgatgattttataagcacctggcatttcccctcctggcactcactacgtcctgccaccctgcaaagaaggtgcctgcttctcctttgccttctgccatgattgtaagtttcctaaagtttgtaaagatccatgcagaactgcgagcgaattaaacctacttactttttaaattactcagtctcaggtatttcttcatagcagtgtgagaacagactaatacaatgatgatacaatatcagccaagagatatggagaagtaggttctgtgtcagattattctgtgtttaaaatattttcctagtcctatttaaaatttttggaaaaggagctaattacaactttatactaagaataaatctctctaaagatacaacaaagaggaataaaacctctcagattcacaaatgaaaaatttatcaatggtgattttctgcacagaaaataccttgcaaacacatactgttgctctggaagttggactcgcccttatgtctatgtctatgcacgtgtttaataaacactgacttgtgcaaaaatatgttacaaaataaactatcaaaaattgtccctgctctccagcccttgtattcctcaaaactccaaatgcttttttttgtttttcttgtctttgcactacagatccgaagtaaaatattttctcccaagcaaaatattttcttcatttatcttctgttccaaaaatcaaatgtgtctttagaattcatcatttcaaactttgattttattacataaaaccttatctggagtgcctccacctggaggcttctcacctggaatgtttccatgcaaagcacttggctagatgcctgacacactcatagtaggtactatccatttcttgaagacttagcccatgatggtggctagggctctagccatcatattcacgttccaaacaacagaatggaagcaaggaagaaaggcacacatcctccctttaaggagatatccaaagtattatacaacacttttattttagtttaattttgtttcattttaagttccaggatacatgtgcaggatgtgcaggtttgttacatagggtaaacatgtgtcatggtgatttgctgcaactatcaacccatcacctaggtattaagccccacatgcgttagcatttatcctgatgctctccctccctacaacctccaacaggccccagtatgtgttgttccccccacgtttgtccatgtgttctcattgctcagttcccacttataggtgagaacacgtagtgtttggttttctgttcctgtgttagtttgctgagatagtggcttccatctccacccatgtctctgcaaaggaaattatctcattcctttctatgattgcatagtgttcaatggtatatatgcaccacattttctttatctagtctatcattgatgggcatttgggttgattccatttctttgctattgagtattacacaacacttttgctaacaaaattttgctgccaaaatctatcacaaaacctagatgcccacagaagttaaaaatgtagtattttagctgagtatacagccatctcgaacaacactggggtacagctacagaggaggaaaggacaggtagatgtcggagaagacaaccagcaggtgctgctgtcgttagatattgttatcatcctcgtgtgttaggctagtaagtggcaggaccaaaatttaaactctgggctctaatttcaaaacctgtagtctttccgctatgactataccttttcccaacactactcaataaatgctggattgtgatttttaaaagggaattaaatgagcttacagttttatatacctctccacgttgttatacagggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcgtaagagttttacatttatctgtaagggatcagattggttaccaaaactataaagtaaaactggaaatgtcaatgtatactgtgtgtaaacaatagcaaaataatgtgctgagccactcagatgaaacttaacctatcttatattggttttcttttctccaggaacttgaaaactacactaagaatacatcagtttttatctttttaaggcctcttcagtttttgttctctgtcttgtttatcactttctttcctcaaactcttactctcaatagatatataagcatacacacacattatatgcactgatggatacatagtttttaatattcgatgtgattccaaacagcagagcataatacctcatatctatccttttggtgatgattcattttatggcctttgcttagtatctattctgactttctctagctcaaaatacttttctaggctgtacctcccaaagcacttagtcactcatgcagaaatttttatacattcagctttcttgtttgcagtggaagcatttgaaagtttattgctgtaatttgagtgaagaattagcaatgtgttgaatcaatgatgtttcaaccaattacattctatagtttttctccagccttggttttctttcttctttacttttcatggccaatatcctgtggtaaaattgtttaaatgagagtctgtctcttcatgctgttatttttatttttatgctttgagcatgcacaaggaaattataaaaccaaaatgcaactgcatgacttaaatttctaaaaactttcctgatgtcactcatgagttatcagattgttattattttagcagtttaaaaactataccagcggggcacagtggctcacgcctatagtcccaatgctttggggagccaaggcaagataactgtttggggccaggagttcgagaccagcctgggcaacagagtgaaccccatctctacaacaatcaatcaatcaatcaatcaatactattatataatttctctttttcacatttatttcatgacttaagagaatcagaagacaaagattgcttagttacatgactttaatagatataaactttcaaattattatttctgccatgtctttcattcattattcatccaaaaactatttatagggcatctgctatttgtcaagtattgtgctaggcacaggggacacaccacggaccaggcaaacactgtagcagctttccagaggatactaaggtgaaaagagccaatagtatggcaggttaacactgtgctaataaaaaaaagaaattagagaaacattccttagaacagaatttcagtcttaataagagtaattaatgatacattaaaaatattcaacataatcagagtattattaaaagaaattcgtacttccgggccgggcgcggtggctcacacctgtaatcccagcactttgggaggccaaggcaggcagatcacctgaagtcaggcgtctgagaccagcctggccaacatggtgaaaccccgtctctactaaaaatacaaaaattagccgggcgtggtggcacacgcctgtagtcccagctactcaggaggctgaggcaggagaatcgcttgatcccgggaggtggaggttgcagtgagctgagattgtgccactgcactccagcctgggcaactgaggaagactcagtctcaaaaaaaaaaaaaaatgctcagcatcactaatcattagggaaatgcaaactaaaaccatagtgatctagccaaagtccagcctattaaaaaacaaaatgaaatatcacctccaaaaggctactatcaaaaaaaagaaaaagaaattcatacttctttattaaatcaagcctttagatatttaagatgaccactctaccagtccacagtaggagaggaaaatgtgaagaaaaaaacatttcttaagagttagtgatatatgttcacaacatattgctaggagaaaaaataaaaagctacaaacaaaatatgcagcataattatttttaaaatgagagacagagagaggcagaaggaggaaaaaacaaaagagaaaagtgtacctaaactcatttagtgggattacaggccatatttgctttctgtttcattttgtattgtgtttttttttccttgtaatgatttggtttgttttgcaaattttttaaaaataatttcacacttgcagagaagttgcaagaacagtacaaaaactcccttatacccttcatctctatctccaaattcttaacatttaccctatcatttctctcatatatatgtaatatttttctgaatcatttggaagtaaattgcagacatgttgccacttgacccctaaatagttcagtgttcattgttgattatttactcatgtttagtttattgtcccaataatatcttttatatcaaaatagaataaaagttttggccaaagtttcaattcaagatttctcattgtattaagttttcatgtctcttaagtctcctgataagtattttatttgtttgttgtctgtttatttagaggtgaggtctcgctatgttgccctagctgaacttgaattcctgggctcaagtgatccccttgccctaaccacccaggtagctggaactatgggtgcatgccaccataccctaaatctcctttaatctataatagttcctcagtctgcctttgtctttcgtaactttgatatttttgaaaagtacaagctagttacagtggtccctgactatccacaggggattggttccaggaccccctgtggatactggaattcttggatattcgattcccttatatcaagtggtgcagtatttgcctataatctacacacatcctgctgtataatttaactcatgtctagattacttataatacctaatacatagtaaatgctgtgtaaattgttattaatctgtattgtttaggaaataattacaaagaaaaaagtctgtataggttcagtacagatgcagacattgtaggcctaactacctagtacgagtcagcaataccttaacattttctgaaattttttttcctgaatattttcaatgtgaggctggttgaatccatggatgtggaacctatggatatagagggctgactgtattttgtaaagtgtccctcaattgggttttagctgatattttcttacggttagattaaggctatgcagtattgtagtaatatcattgaagtaatgttatctcattcttggtacatcatatcaagaggcctgtgatatcaatctgtctcattactggtgatattaactttggtcacttggttaaagtggtttctgccacttgtgggaactttcagaccatgtacagacattaaactttcacctactggtttttaaagttcattgataatttttgactgaattactactatattgtttaccaaaaggtagctttctaactccacaacttcttctaaatttatttaatgatgttctcctatacaggaagagcttttctttctcttccctctatttatttatttatatcagtatggtctcatggatttctattttattcaaggattataattgtttaccgtcatcatttattttgacattcaattgtcccaaattcaatcagtagaactcttcattttgttcttaatttgtaattatttccagattttttgcaatgagtatatgatcactttttgtacttaggggaaagaaagctactcttaaaatgtaactgatgggtcgtgtgcaaattcttgcgcaacatggaagctcttctgataatacagtaagatcttcagtattaaaatgattcgtaaggccacttcaaacagtgaaatgctatgattctaaaaacatgttggtttacatttttcacattaaaatatttataaattttttattttgcagttttaatagtccaaacgtgacaatagaccctgagtttcggctatggttaagctcaaaatcatacagttcttttccaattcctgttcttaaaaagggtttaaaggtaagaacaaagtataacagatttaatgttgactgaggagccctgtttgaatgcaagtcatcttacattcaaaactctgagtttaaaagagaaagctaattctgataaattctgaaatgctaaatttctgctttgtgctcaaccctatactggggatgaggaagaacactaaagtagattcctacttacaaggaattcacaatttatatgttatttgctcaaacaaggatgttagacctccaattattataaagcaaaatttacaatttgtgttgttttcctgcccttcacttctctagcatttcttatttctgccctacttaaccgttttattattaattctctagaaagggtctgacagaaagcaggctaaaactgtttactaaaaagtcctcattaaagattatctgggacttctcatatccactattgaggctgaataaatagtaagacagtcaattctattagaccagggtccagttgaccaaaaggtggggtcctaacagcagagaaaactgaccgatggcataggcagaagggggtacccagactcccgatcacgtgcacactaccagctttcacagaagtgggtgggcatggagaaaatcaggtggatgaggcactttccagatacagccccaatccagcctaagaaacttcctgccacactgcttctcagctctgcccgtctcctgtatgtatctacccaaactgacagtactgagccatttcccaacatcccggttcctggggcagacagaacagggactggagaaacccacaactcttagtctgagactcgaaagattccacttgtctcccagagagcagcagaccatgctctcagacagcctttaatctttggtcaggagaggggaattggggggtggaggtactgggggtaggggaatgaagggtgtcagagagggacagaaatagcgcttcagggaatatttcatcttaagtagtccatcgctccacctccactttaagtctccatcagcattttaaatgtggctataattagtgcatacataaaactttatgggagtttttcatatgccattatttatacagacagagatgataattttcttgatatattaaaagagcacctacacataagtcagaaaaacattaacattccatacaaaatgggcaaaggacacaagaggtcaataaacacattttaaaaataaaagttcagcctctagatatcagaaaaatacaaatcaaaaactgcattaaattggctaagactataactatgatatagttagtgctattaaggatataatgaaataactactctcacataatgctgacaaggtaatatcagggagatattaatccagaaaggaaggtaatttcacagtatagagatagtgtttataaatttcatacaatttgatcatggcccacttctaggaaaaggccaaataaattatgatgtatttgtgtgataaaatagtatgctatcactaaaaatcaaaattaacacacactctctcttctctctctctctgccctccttccactcactttccccttcagatatagttctgaaggcggacagacacctacttttagagatatgagaatgagttctttaaagaatcagtcatagcagtcgggaaacagtgctcgataaatattttctcatttctccacaattagggctaagcaacaattgctggcaacctgaattaaaggatgtttgaaaggcagacatgccttggaaaatagagaatatgtcctctactgtgcacagagccatttgctcacattctaagggtgacagagtcagagaagcttgtcttccatctcctggagccacttaccttctcagggtgataaaacttagagccatttgcttacactccaggggttgtaaaaacctagagacctcctcttttccccgagaagatttgtttacattccaaagcaaaagtctgtctctctttctctatctctgaaaagaggaaaggctgctttgccagccattctgtaagctccaagtttcataatttgagtcctcctcttatggtacaaatcccactatacacacacaggacatgggaatctgatccctgatccaaaagtctcatgttcatacacacacacacacacacacacacacacacacacacagctctatgccatatatacatatatacatacatttatatatcatatatagatacccacacaacttatgtaagtgtgtgtgtttatatatataaactgtgcaaggagggtaatatttcagacccttcacaatttcagacttaacagccacactctcaaaaaagccctccagttgattccctccccacctcaccctcagtctcgcatcatttccattattctagttaagaagtcaaccaaatggactttcaatgcaatcaaagaaattttgtaacacacccagttaattgttctccttctgatggttcagttagtgctgaagctgctgttgattcagtttgtgctgtttcccatgatgtgggaccctctgtatctgctacctcgcagaggccatgcagcctgggtcctgttacagcctcataactgccattgacactaagtttaggctctcataactcttcattgtcaaagttcctaaaatcccaagccctatgctctgagcaaataagagtgcttttaatcacaacattatacttcccatttcaaaatatgaatcggaacaatagaaaatctgggacaatccttttagagacgtttttacatggcaaaagaataacatgagattttggatttgccagtgaatcttgaaaatagttacattcttgcccagttcttttaccagtgttgtagaaagacaagtgccctgaagaccagtgcctgcatctgtcctcacatgccattttactcacatctgttttcaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggtaagtgtagtctcttcaaacaaacaacaaataagtaacaataagatacaaattgagagcctactatgtgcctacacaaatgtgagtgttttacatggtggtaagaaaatgaactctataactaggcaataagggctaacgtttagaaacatggtctttgatgccagcttttctggaatcaatttgcagctccaccacttatagctgtataagtacgtaatctattgggcaaactaacctctcagagtcttagtttccttggccaaagaaagcaaactgagggagaccaaatgtcagtactgactccagaggatcattatgtaattataggcaaacttgttaatgtaagtaaaccacttagaagagtgcctgacagacataacttagtataaaaatgtttgtttgttggtacgacttattcattaaaagcaagagagattccattgacccattgtgtggggaaaagtttagctcagtggtcttcctttactattctctatatagaaccttctatttgtgctttattgcagggtgttttctttattgctaaattaaacacgtggtagcatctgcttaagtttttcccgggttaattttcttgcaattgtgcttccagcgtacaacattacacccttgattacccattcatttatataatacaacaatttaaaaaaaaaactttctgaggaaaatcttgattctgcctctgggtatctataacctagacccactctagatgggtagccttctatgtcttctatatgtttccattaggcttttcagttttgaaaagaggctgtcatacttactgcaagctcaactgcctatcagatgtaatacttctgtacctaaccaggaacataacataaaacactgcatttgggatatttatttaaaagtataagctcaagtacgcttctgtcaaggccttattcaaagctcaatcaaaaggcagataatatattagggggaaatatttgaaccatatattagacatgttggtgtctaatgtaaataattgatatttttatttaaatcagaaaatgaattcaaagaaaataaaagtcacctttaatagaaacagtataatgtctaaattaacaaagaaaaaaagaaaataaataacaatttgatcaagatatcaaaataaaagggagagaaaaaacaaagcaaaataaataataacgtaaagcaatatggaaggaatgttatcagtcatttattaagtgtaaatggatgcattctctcaataaaaggcaagactattaaattgggttacaaaacaaaacccagaaatgtgcaatttatacgaaaaagtgaaattaatgaagaaattttgaaattatcaagaaaataaaaaagaagaaagcagaaatggcaatattaatattagtcagaatgtaatgactgagagtgctatattcttcagacaacagcatattgtagcatatatatatatatatatacacacatgtatatatacactggtatacatgtacatatatatgtatatatgtatatgcaattattgtgggaaatttcaaaaaacctccatcaggattggacagctctaataaacaaatataagatgaatagaataatgtagtcaacaaatttgattaacagatagatcgagagactaacatccctctaataaaaagtacatattttttcaggtatccaaggaactgttacacaactcagtcatgagcatggccacaaagaaaaacctttaatgattttatgggccacgttatctgaacacaatttaatataataaaaatttgacccctaaaaatctaaacaacttggatattaagaaacataactctagataaccttttatcaaataggatattaaaagggaaatcagccaggctcggtggctcacagctgtaatctcagcactttgggagggtaaggtgggcggatcacctgaggtcaggagttcaagaccagcctggccaacatgatgaaacctgcacggtggctcacgcccataatcccagcactttgggaggccgaggcagttggatcacctaaggtcgggagttagagaccagcctgaccaacgaggagtaaccccatctctactgaaaacaaaaattagcctggcgtggtggcacatgcctataatcccagctactcaggaggcaggagagttgcttgaacccgggaggtggaggttgcagtgagctgagatcacagcacttcactccagcctgggtgacagaatgaaactccatctcaaaaacaaaaaacaaacaaacaaaaaaaacacgggaaatcacagcctgtgcaatatagaaagccctgtctgtataaaaagtaaaatatatatatatatagccaggtggcacgcctgtactcccagccactcgggaggctgaggcaggaggatcacttgaccccaggaggttgaggctgcagtaagctgtgcttgggccactgcactccagcctgggtgacagagtgacaccctgtctcaaaaaataaaaataaataaaatcacaaatatctcaaaaacaatggaaatgagactacttcataccaaaaattacaagacagaacaaaagctatacttaggaaataaaagactggccttaaatgtctccagtattaaagaaaacatacaggaaataaatatccatcttaagaaattagaaaacaaaagaaaataaaagctaataaaggaattctttattagctggagtaataatacaaaagctaatattaatgaaatatacaaaaaaccgtaaaaggaaaaatacattttaaaattggatttttaaaattcttttcatatattttttaaagcttacagctataaaaaattggattttgataagacaaataaaatttgaaaatctagatgaagccaatgattacttagaaaatatgaattatcaaaattgactcaaagagacatggaaattttgggtaggccaattgccacaaaaggcattgcaaatgacaccagaatgagatggttttacagcttaattcactctgaacgttaagaaacagatagtattaatattatatattctagaccttagtaaaagatcacaatctccctagtgtattttatgaaaccagcatagttttaatatgaatacctgaataatatacataagaactgtagattaatttcactcaggatttgagatgtaaaaattctacataaaatataaatggatctcagcaatgaaacaaaagaataatacactgtaaccaagttgggtttattccagtaatgcaagaatgacccagtaactggaaatttataatcctaatttatatgatcatctcaatagatgtagaagaggcatttgttatgaattttggagccatttctagtaaaaacctaaagtaataggattaaaaggaaccacttaaatatgaaaaagactatctaaaaataacaatgaatgttattccacatagtcaaacactgaaattgtttcaaataaaatcaagaattagataaggatgcccattatcaccactgtcattcaacagtgtcttagaatttctagtaaattcaatgagataaaattataataattcatattaacattgtaaaaagagaaaaaactttttgttgattatataattgtacgtctagaaaacctgagatactagtaaaacaaaatctagtaattagagaattttgtaaagtaactggataaaaatgtaaagatgtaaagagcaataaagcctccctggtagtaaacacccgggaatggaagtaggcaaaaccgtactttcacagcagtgatgaaaaaatttaaatactcaggaacaaatttaacaagaaacatatgggtcctaaataaagaatagcataaattagggagaaaagagtcataacatttgttgagagcttaaaatatttggattgctttatctaaattatttaattcccacaacaacattatgaggtaaggacactaattatcctcattttacagatagggaaatagaggcacagtacacctaagaaacttgcccaggttacataggtaataagtggaggtccgattccacagttcgtttttttaatcctgcctcccctaaataaatgcatccatgttctttatgggaaggcttcccatatcataactatcaattcttccaaaattaataatcagatataatgcagttccaattaaaatcctattagagaagtttcagaattaataaaattcatatggaagaacagatgctgaagaataagctaggaatgtacaaaaaagaaaaatcctgaaagggtcctccttcaccagatatcaaaacatggtaaaaatccactatactaaaatcaatattgtttggcagagaagtagacaataaatcggtgggacatagttgagggtgcaaaaatctaagtttttatgagattttaatatttgacacaggtaatatttcaactgaggaaaaagggattttcaaaaagtaaatgatactggcacaactggccatccagctggaagaaaagtactagttcctttatcttatatcctatataaaaataaattcccgaatggaataaaatttaaatgtataacaatacaaataaccaaaataaatctaggagattacatgtacaatcttggagttgggaacaagtaacccgaattgaaaacccagaaccataaaagaaaagataggcatatttgattacaaaaaacttttatatggtaaatggtggcaaaataaagtcaatggacaaatgccagatttaggataatgcaaatgactgacagagagttaatatctgtgacatacaaagagctcttatctattaacaagaaaaagaccaacaagccaaaggaaaaacaggcggtgtatagaggattgtacttaaatgaccaacggacataagaaaagatgctcaaaataaccagtactagtaggtgaaatacaaattaaactaacagcaaatgtaccgcccatgagactggcaaaaattaaataaaccaacatttcctgttagtggcagggatgagagaatagtaacaaaaaaattccttcacacactgttagtgtaaatatgaattcttacagccactgaacattgatagccgatgtattgtccaattgcggcacagtgtgtatgctaaactagcatttgtggaaaaaaaaaaaaagacaggaaaacagaaagaaagggggagaggagggccgggcgcggtgggtaatcccagcactttgggaggccgaggccgccagatcacgaggtcaggagatcgagaccatgctggttaacacagtgaaaccctgtccgagcgtggtggtgcgcgcctgtagtcccagctacgcgggaggctgaggcaggagaatcgcttgaacccgggaggtggaggttgcagtgagccgaggtcgcgccactgcactccagctgggcgacagagcaagactccgtcaagaaaggaagggaggaagggagggagggagggggataggaagagggaggcggaggtgataaatagttgaagagcacagggaggatagaaagaagggagaggagaagcgaaggaaggagagagaagaaaagaagtcaacctatgtgcaaatagaatgtctgtgtaaggatacacaagaattctgtcaatggtggcctcaagggagaggatctgacggctaaagtcgggagtggaagaaaacttactttctcttgtttgtttttgcgctttttgaattcagtaccacgtgcctgctttgcctattcaaacaacagcaattaaacagctcaatgcctgttcaacaacaacaaaaaagaactagtggataaaagtgtatgtcccagggcaggcacggtgcctcatgcctgtaatctcagcactttgggaggccaaggcaggcggatcgcttgagcgcaggagttccagaccagcctgggcaacatgaggaaagcccatctctacaaaaaaatacaaaaattagccagacagggaggctgaggaaaaaagctgaggtgggagaatcgccttagctggagaggtcaaggatgtagttagccaagatcacaccactgcactccagcctgggcaacagagtgagaccctgtctcaaaaaaaaaggtgtatgtcccaatatttgtgtcttactatatatatatatatatatatatatatatatatatatactattctagtaaatataaactattctagtaagacaaatgaaatatatataatatatatatttgtctatatatatatatatatatatatttttttttgagatagagtctcactctgtcgcccaggctggagtacagcggcctgatctcagctcactgtgatccccgcaccctgggttcaagttattctcctgcctcagcctcccagtagctgagattacaggcacatgccaccatgcccggctaatttttgtatttttagtagagatagggtttcaccatgttggtcaggctggtctcgaactcctgacctcaaatgatccgcctgccttggcctcccaaagtgctgggattacaggcgtgagccactgcacctggcctatttctatatattttttaaagagaaaatatatgtagctgtttgagagttgattttatgttaaaaagtcagagtgagtaagctggaaacacatactgaaataataaagactcatgggttttccaaaggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagtgatggggtaggaaaagaatcaatcttcttgcatttctcgataattttaaagtaaacattgttgctttatttaaaatacatatttaaataaattttgatgttcatttttaaaggcttttagtagctttcagtagtatggaagtaatttacccatgactctattaaacacaacattatgcagggcagtaaacaaaaagaatgatttaaaaatcgttcatgtcctccgagaacgtagagtgtaagatgcaaagcacaaggaagctaacatttataaatcaacgattccatgccagtcacttgatatatgtttctcatttaatgctcaaaataaccatggggaatagatgctgttatgtttccagaaatcccacatctcttgtttatcccctcttctccccctcagtttctatcctctatccaagccttcacatttgtggagcagaaaactccatattagacaccagcagctgtgtgtgcctgttgagtggctgctagcagaggaaagaatcctacagacctctgaccttagactgtagagggttggacttgacataaactttgatgggtgggaatttggataagagaggtgaatggaagatgaaaaggaagacgacagctgtgggtgatcattgtgagctgggagtgggcctggtatcatcaagagaaagagaggtcatatccaggttgtctgtctgaggtcttgaggatatggatagataaacaaaatagtaaaaatattttagggagattcatttgtaaggcatctatagaatggatagcaatggtctatgttgatgaccctgagtcaataagaaggcattaaattatatcctttatgcactatttgctaaggcagaaaaagctatgagggcttttttttttttaagatttccatcaaaaaacaacaacaacaacaagtgtcttaaggccgggtgcggtggctcatgcctgtaatcccagcactttgggaaaccgaggcaggtggaccacttgaagccaagagttggagagcagcctggccaacatgatgaaaccctcatctctactaaaaatacaaaaattagccaggcatgatggtgtgcacttgtagtcccagctactcaagaggctgaggcccgagaatcacccgaacccaggaggtggagatttcagtgagccgagatcacaccactgcattccatcctgggcatcagagcaagatcctatctgaaaaagaaggaaaaaaaactgtttaaaataacattttagttaaatttaggattctttggccaaatgtggtggctcatgcctataatcctagcactttgggaggccgaggagagtagatcacttgaagtcaggagttcgagaccagcctggccaacatgatgagaccttatctgtactaagaatacaaaaattagccagccatggtggatcatgcctgtagtcctagctacatgggaggctgaggcatgagaatcacttgaacccgggaagcagaggttgaagtgaaccgagatcatgccagtgcactccagcctgggcgacagagcaagactccatctcaaaaaagaaaaaaaagtttagggtattttaaattgcccaaagaatacaatgtgcatggttttgtacagagtattacattaagtatgcactaagagaataaggtatactgtaacatacagcatacaattgcattggcagaattatatcagatgacagaagggtattctgaaatttgtatttcaattgttcagttgctttaaaacactaggaattttatgacagttccagcttgccagctcttcctgttttttgttataatcttgcttcttctgcaggtaatttttttaatcagtgactgttatttgatttttccctctgaccttcattaattcttcaacattttccttaatgatatcaagaaagccaccatcacccactttcctgaccatatgaacaatgcatttctcttcttggtcagtggtcaattattcttaagatcattctcacattccttctataggtttcactaaagtaaaatgatttgttcaagccttattgcattcattatctatgggtggtcagaatcaccctcacctttaaagcgttttttttttctttctctcttttcccaaaaagaaagttatacatgcatatcatatgcacattacaatacagtagtcccaaatgttgcttttgacagtgtctataatataccacatgcaaataagaaagccttcggtataaaatttcatgggaaaatattgtcttcaagcattactgaaagtaggtatcttactctggcaaaaaccaacaaagtgttcagaagtagcaggattgaagaaaaaagctaacaaaatgttaaattttcagatatgtctgccagttccaggatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcaggtaagaactcgctaggaaaaattgttggtcaaaaattatcaggctgggtctggcagctcatgcctgtaatcccagcaccttgggaggctgaggtggacagattgcttgagctcaggagttcgagaccactctgagcaacatggtgaaaccctgtctctacaaataatacaaaaattagctgagtgtagtggtgagcacctgtagtcccagtaacttgcgaggctgagaccctgtctaaaaaaaaaattcatttgaagagatatatagaaaagtatagtctacatggtaaagaaactaaattctacttcaatgagttccttatgtatttaagttctaatttttcaatttgtacgtctaacaaattttaacacttttaaaagatatttgaatgtttgaccccatttataagcttaaacattttcaaatatattaatattcattataaagttaatgtacttcaatttgtcttccagaccttctcaaatctttgagtaacttttataaatctaataatcaaataaatatggtgaatcttaaattttcttgttccctaatattttatatcaatctaacaagatttcaacctaaaatcataaatcagtttctcaattatctcttttaattggggtcacaagactgaccccaatctaacacaaggtattacgaggcccaattctcttaaacattacaaatatttaagataccaacatattataaggaaatgcttttaataaacatactagatatgcttattaatgtccctttggtcactttgagaggctataattatcccagtcttgctgcctttgcttattagagacttgtctgtgggacttaatccaaacatctatcatattcaatgtaatttccttagtggtagcaaatctttgccctctgaaggtaagcttgatttttgacaccttttgaccttttgaattatttgaagctacctgggttgaattctaaggagaaaatcaactttacagtcaaaacagtgtgatgacaaagtaaggagccatgtgacctcaggcgatctgtaaactggtttggaagcagcactgttggactaaatacttcttggcagctttaaggttattgcttaccttgaaggataatattcatttgactgtgaaacctggagtgtttgttgaaaaatcagtcctggccgggcgcggtgggctcacgcctgtgatgccagcactttgggaggccgaggcgggtgggtcacgaggtcaggagttcaagatcagcctggccaagatggtgaaaccccgtctctactaaaaatacaaaaaattagccagcatggtggtgagcacctgtaatcccagctactcgggaggctgaggcagagaattgcttgaacccgggagggggaggttgcagtgagccaagatagcaacactgcactccagctggggtgacagtgcaaaactccgtcccaaaaaaaaaaaaagaaaagaaaaagaaaaatcagtcccggctagtaaatagagcagcagaactcaaaagagatgtgccccatttcctactcatccactaactgtctaaggaggtcctcccacctcccggggccctggtttcatcatctttaaaaggattccaaagagctcttccagctctagtgtttagtggttttgcatagtatcgcagcctcacctaggcctggacacgcgctcctcctgtcaccacccgcggagtgtgtgattaagaagcccttcgtgtcaacacaggaatgaggcaagcagtggaatgttccatgcggctgcttcagcgtgctctgtttagttgcctcctctttttcattgtcttgcagatgcatgcagatgattattttacaaagaaatcctaaaaaagcttttataatacatatttccttgcaaatgtctaaagtacattggacagtttctcatctacaaaatgaaatgaattccatggtctctgtaagatcatccatagcataattttgtggttctgtgaagatacatttatcttcagacggaacttaagcagaggaccctctaacattagatagatctgtagcttgtttttctcttgatttcttttattttattttcctttccttttctttttttaaattttttttttgagatagagtctcgctctgtcacccaggctggagtgcagtggcataatcttggctcactgcaacctctgcctcccgggttcaagtgattctcgtgcctcagcctcctgagtagctcagactacaggcgcccaccatgcctggctaacttttgtatttttagtagagacagggttttaccatgttggccaggctggtctcaaactcctgacctcaagtgatctgtctgcctcggcctcccaaattgcagggattacaggcatgagccactgtgcccagccaatttttatttttttaattgacataataattgtacatatttctgaggtacatagtaatgtttcaatacatacaatgtatagtgatcagatcagggcaattcatatgtccatcatctcaaacatttatcctttgtgttgggaactttcagtatcctctcttctagctatttgaagatgtataatctatttttgttacctatactcatcctacagtggtatagaacactaaacatattcctcctgtctaccagtaatcttgaatcctttaacaaatctctccccatctccccacttcctgttctgtgtctcattcttctcttggttttttttgcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaaggtgagcatgggacaggagctttttccccttacctcactctcctcaagaaaggactctggtgtcaggagtaaggtaaagataagacaaaaattctgtagaagtgaaaatactgagataagatggaaaactcagtctctgcctcctctctccaagttgaaagacagagagcacagaagaaaatcacgctttagtttgggggtgggtagcgtgtggcactgaaatcaaaagtgaagaaataacaagtgtagcaaactagaaagcagcaactctgctttggagattgtcaagagttctaggtgcctgttctctctgcctctctgccttctggaacagcggaagtttagatggaccttctgctgaaagaccacttgactccaagaagctaaggggaatcagggcaggcccaggaagacagaggaagcctgattgcccagagatgactccaaacccagctctaagtggctaaattgctagactatgataattttcccagttaaattttaatacccatattttatccctttgcagaagtttatttgggaaccaaatattgagcaatagtttatcaaaacagtgtcattgttgagtctcaatcaaaggtcagcaaattagggctcgcaggccaaatccagcccaccatttgtttttgtacagcctgtgaactaaaatggcttttgcattttttaatggttaaaaaaaatcaaaagaaggaatatagtttgtgacacataaatgttatatgaaactccaatttgagtgccataagtaaagctttactggaacacagccacacttactcatgacatattgtctatgcatccacacatagtagatagtgtggccgcacccacactacaaggggagagctgagtagctttcacagaggtggtgtggtccccataccctaaaatgtttgctatctgaccttctacagaaaatgtttatcaacccctggtcaagacacacaaaattcccttaactttcaaagcctaagtccctccatgtaaagcctctttttaatctgtaaaatatcaaaattttatttctttttaaaatccagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcaggtaagcaattattattatttcctattttcttgcttgcttgaaataaatgtccaagttcaagggaatggtgaaggtaaatggtgcatctgtgtgatgaaatatgtaactcttaaaagatgctgacgtactttttcatattttcacatctctgaagttggaatgcctcttaacagtcactgttagccaggcagcaccatcacttagttctcactatctgtgtatgtgaactatgtatcatggcagttcatgtcaaagtaggtgcactcttggtattactataagtgttgagtttaattgcttttaaaataaaaacaaagctaaacaagatgatgaagaaattactgggtcatggtcttaaacagaagaccaaattgtaaaaacacaaaatgtattagaccaggaataaaataagccatggaagatctggcagcacagagtaggaaattaacaagcttgatgttggacacaaacactatttctccagaaatgaacttctccccttaggattagcactggccttttccagaaccctgaatcctataccagattgaaaacctgtgtagacatgtgaaaagatgttcaacagcatttgctttgagggaaatgcaaatcaaaaccacaatgagatacaacttcacacctactaagatggaaagaattaaaaatacataaaaacaagcattgggagaaattggaacccaaatgcaccactcatgggaatgaaaaatggtgcagctactttggaaatagtccagtagttcctcaaaaagttaaacagatttaccatttgacccagcaatttcactcctaggaatatatccaacagaaattaaagcataaatccaggccgggcacagggcctcatgcttgtaatctcagcacttttggaggccaaggtggcggatcacctgaggttaggagtttgagaccagcctggcaaacatggtgaaaccccgtctctactaaaaataataataataataaaatggccaggcatggtggtgggtacctgaaatcccagctacttgtgaggctaagggaggagaattgcttgaacccagaaggcagaggttgcagtgaactgagatcatgccattgcactccagcctgggcaacagagggacactctgtctcaaaaaaaaaaaaagtccacccaaaaacttgcacatgaatgttcatggcagcattatttgtaatacccaaaaggtgaaaacaactcaaatgtccattgactgatgaatggataaaatatggtatgtccctgtaatgaaatattattcagccagcaaaatgaatgaagtactgatacaggctatcacatggataaaccttgaaaacagtagttcttctgtgctaagtgtaggaaggccatcacaaaagaccatatattgtatgattccatttacaagaaatgtccagaatagtgacagaaaatagattattggttgcctcagtttgtgggtgacagagaactggagaatggatgctgagagggttttcttttggactcatgaaaacgttctacaattgactacagtggtagttgcacaactcagtgattatacgaaaaaccattcatttgtacactttaaataagtaagttgtatggcatatgagttatatctcaatgaagttatttttaaaacctaggtagaaaacatgaagacagacgagaggaaataataacaattataattccttaaaattgaatacaagctgtgatgaaaaattgagatgtggagacacatccgaatcacaggacttcagagctcgaaaggatcttagggaacccccactccaatgaccttattttacagatatggaaactaaaaagcagagaggccttattacattcttagcaagccccgtggtgaaacagctaggactccacacgtgcaaagttaggctgaaagaacaatgatgagttggtacactgtaagtacagtcacatgtggctgagaccattgctcacttgacagagtgacaagaggtgagatgagtcaggtagaaatgtccggcttggacaaatgggtaggaactagcacattcagagacgaggtgagcagaaagacgtgctgtgtgagaaacagatgaagacatcctgttttggacatggaaagtgtgagaagctagaggggctctcaggtggagctactgaaaggcaatgggactgatcttagttatttcttgccttctgctagcttttgaatgtgtctgctcttgcttctctagttcttttaattgtaatattacagtgtcaattttagatctttcctgctttctcttgtgggcatttagtgctataaatttcccctacacattgctttaaatttgtcccagagattctggtatgttgtgtctttgttttcattggtttcaaagaacatctttatttcggccttcatttcgtcatgtacccagtagtcattcaggagcaggatgttcagtttccatgtagttgagcggttttagtgagtttcttaatcatgagctctagtttgattgcactgtggtctaagaaacagtttgttacaatttctgttcttttacatttgctgaggagtgctttacttccaactatgttgtcaattttggaataagtgcgatgtggtgctgagaagaatgtatattctgctgatttggggtggagagttctgtagatgtctattaggtccgcttggtgcagagctgagttcaagtcctggatatccttgttaactttctgacttgttgatctgtctaatgttgacagtggggtgttaaagtctcccattattattgtgtgggacactaagaacagagcagaactgaaagagatagagacacaaaaaaaccttcaaaaaatcaatgaatccagaagctggttttctgaaaagatcaacaaaattgatagactgctatcaagactaataaaaaagaaaagagagaagaatcaaatagatgcaataaaaaatgataaaggggatatcaccaccgatcccacagaaatacaaactaccatcagagaataccataaacacctctacgcaaataaactaaaaaatctagaagaaatggataaattcctggacaggtacaccctcccaagactaaaccaggaagaagttaaatccctgaatagacaaataacaggttctgaaattgaggcaataattaatagcctaccaaccaaaaaaagtccaggaccagacagattcacagccaaattctaccagaggtacaaagaggagctggtaccattccttctgaaactattccaatcaatagaaaaagagggaatcctccctaattcattttatgaggccaacatcatcctgataccaaagcctggcagagacacaacaaaaaaagagaattttagaccaatatccccaatgaacatagatgcaaaaatcctcaataaaatactggcaaaccgaatccagtagcacatcaaaaagcttatccactatgatcaagttggcttcctccatgggatgcaggggtggttcaacatacacaaatcaataaacgtaatccatcatgtaaacagaaccaaagacaaaaacaacatgattatctcaatagatgcagaaaaggccttcgacaaaattcaacaacccttcatgctaaaaactctcaataaactaggtattgataggatgtatctcaaaataataagagctatttatgacaaacccacagccaatatcatactgaatgggcaaaaactggaagcattccctttgaaaactggcacaagacagggatgccctctctcaccactcctattcaacatagttttggaagttttggccagcgcagtcaggcaagagaaagaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggataccaaatcaatgtgcaaaaatcacaagcattcctatacaccaataacagacaaacagagagccaaatcatgagtgaactcccattcacaattgcttcaaaaagaataaaatacttaggaatccaacttacaagggatgtgaaggacctcttcaaggagaactacaaaccactgctcaacaacataaaagaggacacaaacaaatgcaggaacattccatgctcatggatacgaagaatcaatattgtgaaaatggccatactacccaaggtaatttatagattcaataccatccccatcaagctaccaatgactttcttcacagaattggaaaaaactactttaaagttcatatggaaccaaaaaagagcccacattgccaagacaatcctaagccaaaagaacaaagctggaggcatcacgctacctgacttcaaactatgctacaaggctacagtaaccaaaacagcgtggtactggtaccaaaacagagatatagaccaatggaacagaacagagccctcagaaatagtgccacatatctacaaccatctgatctttgagaaaccggacaaaaacaagcaatggggaaacgattccctatttaataaatggtgctgggaaaactggctagccatatgtagaaagctgaaactggatcccttccttacacctggtataaaaattaattcaagatggattaaagacttaaatgttagacctaaaaccatgaaaactctagaagaaaacctaggcaatactattcaggacataggcatgggcaaggacttcatgactaaaacaccaaaagcaatggcaacaaaagccaaaattgacaaatgggatctaattaaactaaagagcttctgcacagcaaaagaaactaccatcagattgaacaggcaacctacggaatgggagaaaatttttgcaatctacccatctgacaaagggctaatatccagaatctacaaagaacgtaaataaatttacaagaaaaaaatcaaataaccctattaaaaagtgggcaaaggatatgaacagacacttctcaaaagaagacatttatgcagccaacagacacatgaaaaaatgctcatcatcactggccatcagagaaatgcaaatcaaaaccacaatgggataccatctcacaccagttagaatggcaatcattaaaaagtcaggaaacaacaggtgctggagaggatgtggagaaataggaacgcttttacactgttggtgggactgtaaactagttcaatcattgtggaagacagtgtggcaattcctcaggtatctagaactagaaataccatttgacccagccatcccattactgggcatatatccaaaggattataaagcatgctgctataatataaagacacatgcacacgtatgtttattgcggcactattcacaatagcaaagacttggaaccaacccaaatgtccatcaatgatagactggattaagaaaatgtggcacatatacatcatggaatactatgcagccataaaaaaggatgagttcatgtcctttgtagggacatggatgaagctggaaaccatcattctgagcaaactattgcaaggacagaaaaccaaacaccgcatattctcactcataggtgggaactgaacaatgagaacacttggacacatggtggggaacatcacacactggggcctgtcatgtgtgggggggagggggagggatagcattaggagatatacataatgtaaatgacgagttaacgggtgcagctcaccaacatggcacatgtatacatatgtaccaaacctgcacgttgtgcacatgtaccctagaacttaaagtataataataaataaataaataaataaataagaaaagcaatgggacaagagcacgggctgcaaagcgagcgcttggtgtcatcagcctagacagagccatggattaaatctgggagagggaatataaagtagcaagagaagagggctgaagggattccaggcaacaccagcctcaagggagggaagaagaggtgccaatgaatgagacctaaaaacaagtagttggagaattcaagagaaagccaggatggagtctagtcacagaagcctaggggagaaagcaggaggaagtaatgagcgccgtcaaaagctgcagaggatacaggtgcagggagtgaggcttgagtatggaaaatagaaggtcgcttgtgatttctaatgaagactccagaagaggggacagtaaacaaaaggagaaaggggctagagggctgcaagggtctcctcctccccacttgcaacaaacaggtaggattgagtgttgggtggtttgtgcagttaagatgcaagggagcgttaataaacagggctggagaatggaaagctgaatccacaaggggcaggggcaggggcagctgggctcagaactggaaggcaaaggtaggtaagggagtagacagtgggtggcatttatagaactttgtataggggaaggtcaggaagctgaaattgctcacacctaatagcatgtgaaggtaatctccccagagaggaggaaaggaggtgaggaaatgaaaagatttgagaagagtgataaaagccttcagccaggatggaagcttccaagcgttttatccaaagcactgttaagataatgttgttttgccctggtaataaggtttagacttttcattatatgctttcagttggaaaaggacatcctcctgccaagttatttctccctggcaattgagtctattaccaaggtttgcagaaatgttcctaatgaccccaaagacaaagaaaaaaaatgatgtgactgtctttaaatcccaacagaaacacgcctacagatcttgtaagccactgagttcctggattgatgatctcatccagcgactgaatttcttcaatacttgggccaaagtggcttatactgcaatacagcgtcggtatggataaaagatgctttacatttcttcctcatttttgcttaaagcccaaaggtttatgacatcatttcccatgcttggtctccttgggttctcacagtaatgtgtgaattaagcaagggagggattcttatcttctgtttgagctgagaaagtggggacctaagatgctgagtcctgagtaagctccctccactccaagagacagttatgactacaacatagtacatttctctttcctaagaaatgcacagggtgaaatgtgaaaggaaataattagttacatgtaattttttttttttgagccaagagtctccctctgtcacccaggctggagtgcagtggcacgatctctgttcactgcaacctccaccttctgggttcaagcaattctcctgcctcagggattatgggcacctgccaccatgcccagctcattgtttgtatttttagtagagaaggggtttcaccatattggctggttttgaactcctgacctcaagtgatccatctgccttggcctcccaaagtgcagggattacaggcatgagccaccgcgcccagccacatgtaatttttaaatgtgtttttagttataataaaaatagctggagaagcgttagagtagcaacatctagcaagtgcctcacaggatgtggagcatttctctaggagctttactcacagaagcccactcagttctcacagcagccctgtgatgtgaagtaggtgctatcattatcatcatccccattttagagatgaggaaactgagtccaaggacatgaagtgcccaaggcttcacaactagaatatggaagtattgagattcaaacccagaactggttccaaagtctgtgccaggctgcttcctataccatttaactataagtgtagcaacagcactgcagacatctgacccacatttctttatatcctttgggagaagtctgtgcctcaaaaacaacggacaagattctgcgaggcgcaggcaggattcccactataataatgacatctgttgttacccaaatctgttaccttccagcctttgtggtccccttttccctcatgagcttaaaaccatagctggcttccattcaagggcctgataagagtcctgcattgggggaatcgaaatgaaaagtaaaagaagggccctgggaggaaatggcccacatcacccaaaggtgtgcaattattatgcccttaacccccaacctgtggtctgccttccactaggtatatgagatttgtcacagtttggaagcagtctattccatcaactagccaaaaatgcaaacaccctgaggattcagagaacaatttctttgaagggtttccttcaagatactggctcccagctttcttctttccacaaggtgagcattagaaccaaggtcagctccagacctggcccaggcaagtttgcactcagtccttctgtcactcaccctttcctcctcccctttaggatgacaacacctgcgcctccacaggtgcctgggtctctagtgtgcaccagagcagtctcttctccctcccaacccacttccttccctcaccccaacctcctcacatgccaaatccacccacccctatcagatttcacctgcgccttggcaggtcactgtatcatctctctgccattgcttctatgatgtcaaaggtcaacattagcacccagctcctccaaaggccgtgacaaaggggtggagacgggcaacttcacaagattgactctgagcttcagccattcattcatttatttctgtaacaagacttgatgactgaatgctggaacctaggccttacctgctcaacataaacgtccagcagcgaaggcagacatgaaccggagtgcattccaacgatgcgtggtcgtggggtggaaagagagttgtaaaggggtgacgctgggctgtgagctctatgaaggcaagaaccaggtctgttttaacttctgtggtgtccctagcacctgatacaggccccagcacacacacacaaaaagctctcaataaatatttgaagaatgaatgaatggcattctgaatagaatatatgaatggatcagtacttgtggagcataaaacagggggaccttcactaagaaccaggcaagcccgctaaggaaataacatctaggatgtcttgaagcttgctaccaattaagtattatccaggtgcggacaggggaagaagagaataattcgtggagcttacatggtacttactgggtgccatgcagtgttctgaggattttatataaattaagtcatttaagtctcatgacaatcttatgaggttgttcctgtaactatccctgtttgcagagagaaaaccttagcacagagaagttaagaaatttgccccaagtcatatcactagcaaaaagttgagagtctcatccaaggtcacttcactactaagtggaatgattctgggggtggggggaaactaataggtgactgagtcaagatttgaactcagcctgacttaaaaagttgagtgtttcaatgactggactaagcggggacagcattcttactagagaaaacacctttcacactaggagaaaccaaatgttcattatggccaaaacaaaagaccccaaaagggagaatgatgccgctgcaaagttgggcacggctggcccccagggctgtgtaagacacactgagggagctgactccatcctgtggcagcagaaaccactgaagtgttccaggccagagaggtcatgatccagcagctataggaaggaagaagggcaggggtacattggagaagaacaagactgggtcctggtcatataaggagtctgcaaattagccaggtgtggtggtgcacacctgtagtcccagctactcaggaggctgaggcaggaggattgcttgagcccaggaggtcgaggctgcagtgagccatgatcatgccactgtactccagcctgggcaacagagcaagaccctgtcttatcaataaataaataaaataaggagtctgctttattctccaggcaagagctgctggtgatcagagtagagcagtggtagtgggcagaagcagggagtagggggcatttaggaagcagaagcaactggactccgtgtttggaaggacaggggtggggggagaaggaggttaagcatgactcctgggtctctggcttggaaagctgggtggctgctggcgtcattcactgaaatacggagcacagggagaggagcaggctgatggggatcataatgacaggcatggtgagttcgagatgttctcatttttttcctactgcacatagcctttctccatgcacccagggggaaacatggccacaagcacctcagcaaccctagaggcaacagagccttccttttctcagtgtccatatgtcatttcttgaggaagactctgacacacttggtcttgtacttgcccctgggtcccatctttgttgccgagaggatgaggcatgatcatcggccaagattggctcagaaatggagagggtctcagaattgacagcccctctatccccacaacgaatacaggaggggtgctggccttgaaaaacaacccacattcaccaggaggctcctgcagctggccagaccaaagtcaccaaggcctgagagggtgggtgaactggtcctctgctcccgcccagcccatctcttttgttctctctttttcctccactcttccctttcttctccatgagacatcattgttgctaaccccagcaggaggccctgagactcacaaggaacttgatggtgtgtgttcttctccaaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaaggtactggaatacttcaaggattagaaacggtgatcattcattcattcatttattcattcaatcaattgtgccctttacaaacctttactcagcacttaccacatgccaggcactagacaggcagatcaacaagccctgcttcaagtccaaatgccctcagacttcatgtcttccactctctttctgggggggataaaagatcataaatcatgaataaaagatttaagtcaatgtaatcaacagactttctaagtatcccctattataaatgaagacagaatgctgctgaggtcagcatcaaaaggtgatattttaaatcagtgggcaaacctgtcctagctgctcatggccgaaattcctgcccccagcaaccgacttattccagagctcagccaggtgctaagtggaaacctacacctacccagacctcagcggtgcagtgagggggacccatggaggcagcttgggctgaagcagagcacagagcaccagccagccaggtgcaccgtgcaccccagccctgccactcccacgccactgtccccactgatttgaagggccacagctgtcattttctaaattccaatttgttctgggaatctatttttctgctccaggactaatgctggggaggaaggggagacagggttgggagacattggtttaaagatttgaaaaaacaaaaagaatgtgaaaggatgctcaatatctttagtcagagaaatgcaaatcaaaatgataatgaaataccattttacacccactaggttggctataaccaaaagaattgaaaaaatagtaataaataaataagtacaatcatgtaccacttaacgatggggatacattctgagaaatgcatcgttaagagtgtacttccacaaacctacacggcatagcctactgcttacctaggctaaatgggatagcctattgctgccaggctacagacctgtacagcatgttactgtattgaacactgcaggcagtgtaacacaatggtaatttgtgtacccaaacacatctatacatagaaatgcatggatgcattcctctacatcatcgctaggtgataggaatttttcagctccatcataatcttataggaccagcttggtatatgtggtctgtcattggcacaaatgttgttatggagctcatgattaaatacactgagggtcatacatggccatatgtttagttttggtgtagatactgccaaatggtttttcaatgtggttgtaccaatccacaggcccaccagtaatgtagaagattgctccacatccctgccaacactcggtatttttagtgttttagttttagtcattctagtggacgtgcagtgatatatctttttttgttttttttttgtttttttttttgagacggagtcttgctctgtcacccaggctggagtgcagtggcacgatctcagctcactgcaagctccgcctcccgggttcacaccattctcctgcctcagcctcccaagcagctgggactacaggcgcccaccaccacacccggctaatattttttgtatttttagtagagacggggtttcaccatgttagccaggatggtctcgatcttctgacctcgtgatccccctgctccgcctcccaaagtgctgggattacaggcatgagccaccgcgcccggccacagcgatgttatctttatgattttaaattgcatttccttgatgattaattaaggtgggcaccttttaaaatgattattgatatttggatttcctcttttgtgaagattctgttcaagactgtggactgtttttgtcgtattgatttatagaagttcttgtgtattctgaatataagctgtcaggtacatgtattgaaagcatcttctcccagtgtgtgactttccaaatcactttcttaatggtgtcttttgatgaacaaaaatttttttgttttaacaaagtccagtgtatccatcttttatttagggttaatgcttttttatgttctgtttaagaaatctttgcctaccctaaactaagttcatgaaaatattctcctgttatcttctagaaactatattgctttacctttcattttctatgatctatatataattgaaggccaggcacggtggctcacacctgtaatcccagcactttgagaggtcaaggtgggcagctcacctgagatcaggagttccagactagcctggccaacatggcaaaaccccatctctactaaaaatacaaaaaattagccaggttgggtggtgcgcatgtgtaatcccagctacttgggaggctgaggcaggagtattgcttgaacttgggaggcagaggttgcagtgagcagagatcgtgctactgcactccagcctgggtgacagagagagactctgtctaaaaaaaaaaaaaaaaaggagaattgagttgtgtatggcatgaggtgagatcaaagttcttttggttccatatgggtacccacctgactcagcaccattttttcattgaaatggccctttccctacttcaactttgtcatagatcaaataattctacatgcctgggcctgtttctattgaaataatcagatagtttttatcctttatctcattaacatggtggagtacatagaactatctggagtgtagttggttataaggtatgattcctatattaggaattttttaatgaagaatggaagctaaatgtgatgagagagcttttcagggtttatggagattatcacataatttatcacttttatcaatatgatttattaaaagatcctaaggttgaatcatcttaattgtaatattttattcaagatttttgtatcaatattttatttgatattattctgtaggattaggccgggcgcggtgtctcacacctgtaatcccagcactttgtgaggctgaggcgggcagatcacgaggtcaggagatcgagaccatcctggctaacacggtgaaaccccgtctctactgaaaatacaaaaattagccgggcgtagtggcgggcgcctgtagtcccagctactcgagaggctgaggcaggagaatggcgtgaacccaggaggcggagcttgcagtgagcagagatcgcgccactgcgctccagcctgcgcgacagagtgagactcccgtctcaaaaaaaaaaaaaaaaattattctgtaggatggggcggggggcttggagagggtgatgtttttagtttttattgtgcatattattgacggtggtttccttattctaatcctatctgccttctgtctttagggttctcacagtttctggtccactggggatacttcttgttttccggtgctttcatagttgcattctgggatttggagtgggaggaggtggtggacactcatgctgtttggcctctgggtcctggtcttcctctcctcagcactcatcagactgcactaagatgattccgagactacccagaattagtgaacgttaggaacatgtcagaagaaggatggaactgggagagtttgtcctacaaggcaaaagactctgaggagaaaaagaaatattgaaaagggtgatacatgaagaactagactctaattctgctagaactccaaccagggggacctccaaggggaagacacatgcagttgatctaaattgatgatgatggtggcgtgtccttttatagacagggagttccctgtcactggagctttaggagaaatcaggtgactgcttggcaagagtattgacgtggaagaaagctcaggttcagatgtgttttcgactggaggtttatccaactgtttatttaaaatatgggtccaaaactgctctggctgttggaaatatcgagatgaacaacgtaaggcctctgccctctagaagatcccaatctacctgataatgatggcactgatgcttgctagccaacactgactaagtactatgtgctaagctctttacctgcattatttaatcctcacaaattagcctcattctgtaggtcaggaaactaaggttcaaagaggcagatcataagctttgaacccaccaagtctagctgactctacacccatagcctaacctcttcctacataacccattagacatgaaaaggctaccgagaggcagatgtgcaccagggccttttcttatgactcacagagggagcacaggggtatggactgcccgcctaagtttgctttttgcctctattcatctaatcagatgttctcacttatttctgctttatacaaacaaccagcttccactgagttgaagtaagattacttccatttattctgagtggctctttgaagagttaaatcactccaaaaggggctgtttacaaattacctacagtttagatttttcagaggaaaaacccatgtaagctatgaccaagttacacaagtataaatggaagtgacattgtcaaatgcgttagattaacttcttccaagattgttaggaaaggacaacactagaacaaatgcagtataggaaaatttgcatttatataagttaaggggaagagaagtaaaaagcattatacaaagcaattcccagtaaaattcttttttttttttttgagatggagtcttgctctgttgcccaggctggagtgcagtggcgtgatctcagctcactgcaacctccgcctcctgggttcacgccattcccctgcctcagcctcccgagcccggctaattttttgtatttttagtagagacggggtttcaccgtgttagccaggatggtctcgatctcctgacctcgtgatccgcccgcctcagcctcccaaagtgctgggattacaggcgtgagccactgcgcccggccaaaattcttttatagaataagccaaaataggaagtgcttaatatgagttcagcttgcacctccaggtagtcacattccagagtggacaacacagaaggcatcaccaggcacagcacaggctgttccacactgcctcccctgtgtcaacaagctggcccaggctgcatcaagggagagctcaggacagcggtgcccaccccttctcttcagagacctgccccatcagaggagatggcagagccctccagggtggcctggtacttggccaccagctcctccaggctgggcatccctccagcacacctgcaggagagcatgtggcttcacaggcctacctcaggcacacctggagtcacctggaattggagctgcaggcaactaaattttctacttcacagacctcatcagaaactcattttacttaaccctttatcattaaaatgtaatcctctatttaacctatatcattcaaaaatatatggaacccggccgggcatggtggctcacacctgtagtcccagcactttgggaggcgaagagagacggatcacttgaggtcaggagttcgagaccagcctggccaacgtgatgaaacccgatctctactaaaaatacaaaaaattaggcgggcgtggtggtgtgctcctgtaatcccagctactcaggaggctgaagtgggagaaccgatggaacccaggcggtggaggttgcagtgagccaagatcatgccactgcactccagcctaggcaacagagcgagaccccatgtcaaaaaaaaaaaaaaaaaaaaaaacccctcctctgccttttttacatttctagagcctaaaacagtagttatggccactatggtaaaggtaggtgacaatgtttgagcacagtgtactctgtcaccttttgtaactgttcttgttctgtcctaaaaagctcggctacacgattacaattgtagaaatttgcatatttattgtgtttgaaggtctttgtcttcatgctgaggaagggtgtcatggaaaaaatacatatatttcagttcaggatgattatatagatacacctaagcctatgtcgtttttaaagcactcagaataggaaaaaaaataagtattcaccttagaacttggggcaacatgccttaggcaggatgagcccctctggatcggtcggctcaattccggacggagcctccagttggtcgctgcttctcctggggatccctgacaccacctctcttccatcttagggctcagcttcctctcacactggagtttacatttttggtttattcatcgagggggcaagatggaatcgtgaacagaaaatactggaagactcgctgcctctggagatgtgctgtgattttcccgacatatactttttgccaacaaaggtaatcaccctgctattatcctgaagtcctaaacctctgagcgttgcttcagtaatatacaaaccactcttattcccattccctacaattttgcaagggagatgtgataatatactcagacaacaaagattttaaatctcccaaaatattactaaaatctaaagtagatgctatacttacatcccatgttctcaataatatgtactataaagccataatactctttaaattctccaggtataatttccacatgctgttacattaaccatttaaccttaaatgtatctaattcataacaaatccctcaagcctagcatacagaaaatgtgagctactgattcacttgaactatgcaatttgactactggattttttttttttttaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccattttaatttttgactctaatcagacttacatgtttcaagacattcacatgtagtcaacaccctttataaaatatttgtgtgttcagccagactgggcaggtgcagtctatttcatttgtacatgaaaacttcaacacagaggggaatcttgcagctgctttttattctaagtacatgagacctgactgtgcaatgtccctgtggttgggctctagtacaggtcagcacaacccggaatacagcaaatttgactctcctaacagtaaaaaccacagcacctggcaggatatcagggcatgcctttatgaactttttggtaaaagtggtttataaaattatatacaataaactaaatatacacatgtagaatagatctttggaatacttcccctggcttctctaagtaaacacagaatactacactgctgacctagctgcagacttctgaaacaaaagagaagggccttcctctttaaagaagtgcagtctgggccgggcgtggtggctcacacctgtaatcccagcactttgggaggccaaggcgggcggatcacctgaggtcaggacttcgaaaccagcctagacaacacgacgaaacccatctctactaaaaatacacaaattggctgggcgtggtggcgcaggtctgtaatcccagctcaggaggctgaggcatgagaatcacttgagcctgggaggcagaggttgctgtcagctgagactgtgccactgcactctagcctaggtgacagagcaagactctgtcttgaaaaaaaattgcggtctggctgggtacagtggctcatgtctgtaatcccggcacttggggaggccaaggcaagaggatcacttgaggccaggaattcaagaccagccttgacaacataatgagaccctgtctttacaaaaaattgtttaaaaaattagccaggcatgatgaggcacctttagtcccagctactcagagtctgaggtaggaggatggcttgagcccaggaggttgaggctgcattgagctatgatcacgccactgcaccccagcctgggcaacaaagcaagaccccatctctttaaaaaaaaaaaaaaaaaaagtgcaatatggttctgacttcactagacctctctgaccactaaaagccaaatcctgagaatttggtaaattcaatgttcctataggaagaatgttattctactaataatggctaacataactgagcactatgttgaacactaataattcctatatcatcctcaggcccctctatactctgtggacgtatcagccagattttatacatgaggaaaccagtgctcaaagagattaattgcccacacacacattgctaagagggagcacagctagcatttgaagccacatctcactgtctctttatcatggcaatggtccatgggcagaaagcataacccacgtgtacacaaatgaagatcccaacagtcccctctctccatagtaaggggggtagaaaaggtgggacttgtacccagcactagactcttttaacagccatgaacaaaacatgtatttaattgtctaggaaactgtaccatctatatttaagtaaattgcacctagaaacactccaccttgtatcttttgttaaaatcctatatttcatcatttgctccaaacagtgcaaaactaaacaccaaaatataaatcgtatacttggtattggtgcatattctgacacacccacattttgcaatgtaatgtcacaatgtaacgtcgcagcaggaagaattgagaggtgaagctgtctgatctcatctcacaattcaggcttagagtcaactggaaatccaaacaagcactaaagcacggtcagcaggcacagtacatgtgtgtgtctcgtgtgtctctcacacacgtactgtctttcaaatgcacagatgcttctgtgattcatacaaatgcatttgaaagtatgactggatctacaatagttttagcatttctgtattttctcaaacagcaaatactaaacacatgaccattttctgggagttaggattcccaactaacccctttgagttccaacattctgagagttttaaacagcagttggccaggggtcccaaacagatgatcctaggaaaacaggaggctgggcaggggtgggaatctaagggctcctgtcttggtcccaaaaatctcagtttcaagcaagaaagggaaaaaaaaaaggctccaaagtgatcaaaatgttgctacattttattttcaacttaaaacttcattataaaatttgccaaataaacatgtcaaaaacaaacttaaaaacaaagtgtagctgatatccagaaattgcagcactgtattgataaagggctcttttcattaccagggaaagaatttaatgtccttccttcctccccaaaagcttccttggtgcaatccagtacagaaaacgccaccactttctgatgccaggagaaaagcaaaataaaaaaactgcttgcacacattagcactgataaaacaatgacaatttcactaaaagaatgtttaaagactaccggatgctggagcaaaccaacttcatgactgcattaacataagctaagttacatacacttcaaatgcagtatagaattaacactgcatatctaaatggctcatatataaaatgtgtaattaaaacccaaacatacacactatgtttattacattcccctacattgaaagtactgagaacaatttaactctgaacacaaaagtttagtgaatttgctactgttccattacaggacaattaaaaatgagactatatcaacttcactagaatttaattgctaaagctaccttatgcacatctattaaactaaaagaaacgactttaaccccttcagttgtttttaagacagcactcctttacagggagtcaggtttggtaaatataaaggatacataaaaaatacagtataaactgcataagcttaacagtagcaaaaacactgatgaacttttaaaaagtcaaaaatatataaaaatattagcctgaaatggcaaattttcaaacaccgatctgtgtaaaaatgtttaaatattgatgttactccaaaaatatatacttattctattttttttctatttgcaacagtttataaaggcaaacaaacacctgcaattgaggtagcaaagccaaattcacaaactttggatcaagaaaaatacccttcctatgttttaacagcatcttctatacaatagtgaatgaattctaattgttccaaaatttttaattcacattactttacaaaattttatttaaaatactgaaaatgttttgttaaaaagacagttagtcctgacaatcatctcacattcaaaatactgtacaaaaaaatctgaagtcaccatatattacaaaaaactaagctatgtatttacattttcaatgtagttttagaagttgaggttaagccaactgctacaaatggtctcctttaagcagtgtctgctaataatgtcatcacttttcactttcagcatttaatataggcccttctttttgctttcaaattatataattagtaaaggatttaaagaaaaacaaatgaaaattctattctcttactgaataaaacataaatgtactttaaatggaacagtgttttcatttaagaaaagccaactggcaaaaaaacatcaaaatttgaaaagtaatcagaaaccataaacatcaatagcattcttcacagtacatttatattaagactgtcttctgttttcagattaagggttgaaaatttcccattaaaatgcaaattctcacatccttacttgtatttttcctatgttaactgtaagttaatacaagtaaacacggctatattaaaagatcaactactcggctccatagtcctgactcaaaaagaaaaaaaaaagtacagaccctgtcagtgcaacaaaagaaagtttcggatttttttccttgtttttgcaaatggcagctggaattgcaggagtattttgtagaaaagccagaagagcattagtagatgtatggaaatatacggtagggcacacgctgacagtacttttcccaagccacgccgtatttcttcttacagtggtactcgtcacgagcttctcggtggacaagcaacatggtgaaataaattatgtagaaataaggcagaatgtggttaaaacctgtggataataatagtacacagtattagatatttttattatcactacaatgtattttttcctgctttcccccaaattctctaaaaatggaaccacaaggtacttcattttctctaataatgatgagaataattaaacaagtctgtaaaatcccactggaaagtggcagaaggtcgtatctaaattagaagctactcaaagactgatgaatccattctaacaatccatcacaatcaaaacatctgtcctcatagttaatacacatctcttcatttctcgcccttcttcccccagcaaagaagaaaaactgctgtcttccaccacaggctgggccaccaaacaggcagcaggcacgggccagctcctccacctccaccagctcccctggatccccctgctcccccagttcccccagctcccccagcttcccaagatccccctgctcccccagttcccccagctcccctggctccaccagtacctccagctccccctgacaccccagctccccaagcacctccagctcccacagctctccctgctcccctgctttcccagctccccacgaggccagacacacaaaaagaaaaacagaatctctttctcttcttaaaaaccaaagtttttcccaatctatgtacactgaatcatgaattaagaagctgaattaatttctatatattctacttagaaaaaagctatcaggcacagctgaaaacttaaaatagtgcttttaggcttaaagtaaaacttcaggctctgtgaattcccaattcccctcagaagccagaggagcttctacagaggccaacctcacagtagaaaagggcgacaaaaagactcacacccaccttggccacactgtcccacacaaaggacacacacacacatctttctggcggctaaaagggtcaaactagcactcttctgaaatgcttaccacatgggagggaccacgccaaggccatgatgagatcacccaagtaattggggtggcgaacaaagccccaccatccagaaactagaagattttttcccgttgaagtatgaatggtttttaaatctatataaaaataaaagtacatttttaatgatgtcgagacaaaaagaaaaataaaaccttcatgtaatatatataatataaacataaatcaatacttacgtgcaagctttggatcactgggatttttccggaatgcatttttctgagaatttgcacctcggaagattacataaccacaaactgcaattttaaaatattttcctatgttaataacttagttatactctaatgcttaatagcatctgtaatttctcttaaaaatgatttctatgctctgaggaaatttccaaagcagactcctaggctcaagagatcctcctgcttcagcctcccaaagtgctgggattacaggcatgagccaccgcacctggcctgattcttaagaacaactcaaaacctctaaatcccactatgtaaaaagatggtaacccgtccgaaatctatcacactactttaatcatccacctaggaaacgctctgaaggcaaaacaaatatagttacatccatgaaagagataaaatctaagatagcctacattacaataaaatcaatactagagttcagtgtaatcaaaattacaagctatatcatctgttagttatacctactggccatggcacaaacattttattatcaaacactagcttagaatcagcaccaaaacatcctgcactttaaatacatgctgaatcccactttaagtctataagttcctaattttatccaaatttcagaatgtcaaaaatcaatctatcactgacatttaactattatatagtcgatcctcaataaactagtaagagaataactttacttcctgctttggtttgaatgtgttctccaaagttcacgtgttggaaacgtaatcctcaatgcaacagtgtggagaggtagcacctttaagagatgattaggtcatgagggttctgccctcatggacagattaatgtggctatcacaggagtgggctcagtatctcgagtgggtttgttataaaagtatgttcagcccctcttgctcttcctcactctctcttgccctccctcactctctcttgtccttccaccttccaccctgggatgctgcagcagaaggggtcttgccagattccagcaccatgctctttgacttcctggcctccagaaccatgagccaaataaatttcatgacaaattacctagtctcagctattctgttcgagcagcacaaaacaaactaagacattccccatttttagctgaactataaaatacactgtcttgaataataaaatggatgacatggacatccaaaccactggtgaaactaaatcttaattttaaccaatggtttgaacttcttctaccacagatactaacttgtgtagcaaaactatctgtatttgcagttcactgctaattttccctgcccaacctctagtataagtgtttagtgaacagtgtaagaacaatgaaaattcatcctgaagtaaaatccatgactgaccctggtggaccgcagctgcagccaaactggacttctcagtctttcccaacctcatctcacacttccccaccacacacccttgctgagctgttcccagtgcctgacttttcgatctccccatcccattttcccctctaaaactccaatcgaacaccatatcctccgataagttcacactaacgctccccagagagaagttctctctatctttaacacccgtcatctaagcccctcttagtgctcactcacacacctcacagcaaggcaggaatgtcttatttctcctgttagaatgtgagctctatgaaggcaagacaaatcttcttactttataagatgcctaccagaaaaagcaggcactcaagagaaaagacgtatggttaccaaaacgaattaaaacaacttaaatttattaaatttaaaagcaagatggtttaaaataatctgtttcaagtactactgagaacccaagtacgaaccatccattctctttgcaaaatgcagattttttattactcatgataaatggcttcaaactgagctaatgctggccattcaaaatggcatgtttcaagtatgtagacagcagggcataaaagcctcagtacataatatttaataaattaaactgagactaaaattaatactcacgtttcagaacaataattagagaagccattggccaagacacttcatttggatgactgactaaataaaaggcttggaagctgtaaataaagggaacccacaccaagtctccaaaagccagcatgaatccaaatccatcgtggatgatgtccatggtcgtcaacaacgcttcctataaggatacagacggggaaagggagaaggagcttctgtgtttaaagtattcaaataaagtactagtttacaggcaaatgtaaaaagtgctatgggcgggtccacaatcaacatttttttgttaaaggggagagagatctggttcccctggcctgctaggtctttctgctgtcacattctcccgtcacgccagcctctcgctcatgctctggagataacagatctctaaagcatctcccatgcccccatgcccaggccctcccctctgctgacaacccctcctccaacctccacataggccctacaccctctgctgccctcctgacctgctgctcagacctgggcacttctcagatatcaccacccaccagtaggctgcagtaattgggttactgtacttgtctagtcactcttcactacactaaaagcctctaaaagacagaggctgtgtgttttcacctttgccaccccagtacctagcacagtgcccgccatggagagaagtgttcaaaatatgcttgctgaaggaataagatcaccaactctttttgtttcaattccacatggaccaatctaatttctgttcataatctggcatttcatgtgcattttccacagaagaaattaagctgcctggcaacatggtgaactgacagcttcgcttctcatgtaaattaataaaagtgcattactccctggtgatttggttagcatgagccagatcgcctctggcccaggatacgggcaggccagactctagaatacggaaccaccaccaaggtcaacactctgaaggtctggcctaagggaatctctaaactacccagaacctcagtacagaccactgatgtagaaatattagccagtataagctctgttggagaatcaaagttctaggttaaagaaaaagagtggtacctctaaatagcatttttttccagaaaagaaagcaaataggccatggaacagaaaaacagatgtcacatgaaacagaaaaaccaatctcacaaaatctagctccttaggcttatactctttagttaaccagagtactttattctctttaaaaaaaaaaattgacatgtaataatcgtacatatttatggggtacacagtgatgttgcaatacatgtaatatatagtaatccaatcaaggtaattagcatatccatcatctcaaacacattctttctttgtgttaggaatattcaatatccttctagctatttgaaactatgtatcactgttaactatagtcatcctacagtggtatagaatactagaacttagaacttactcctcctatcgagtggtaattttgtatcctttaacaaacctctccctatccttcccttccccctacccttcccaccttcccatatcctctgttctactttatacttctatgacatcaacttttttagcgcccacatataagtgaggacacacggtgttttaactttctgtccccaagagtgtcttattcttctctctcaaggcctgtgatctgattcctggtccaaaagaggataaaggtgacaaattggtgggagcagataaaagcaggtgtggtgagtggcagtgagagggcaaagggtaagcacccaatgccgggtagggggaggaccttagccccaccagctcctgagccccaaggctttcacaggacggctcagaggaagggtcatgcatatttaaacaggtagtctcagttttcttaaggtatagcacattcttgaatacagagggatttctatcaagtgacctgacagaagttattaagcatctgctaattgcccagtggcatgccagaatgctgaagaaatcataaaatacaatctttcctcaagaagcttattatcatctggctgagatactgagaacagacagaaaacaatttcctaactctagttctctacccctggggctatgttaatattgcattaagcgttttgccttaagatgcaaaaaattttcttttaacacaagtcaatgtttggctaaatctatagaaaatatcaacttctaagccaattaaaaagtgacaaccacaacatggcagaaagctagtaatagaagaaaccagaagaaataatcactgatcagtggaaagctactagaaaggaaggtttaaagaagcctctgaggtgagcacaactgtgaaatatcatttgatttgcaaactgtaacctatatgctcttttggcgattcattctataacagcaaacaaagctacactggtaacagtaagtgcatttacaaaacagttgttttttaatttcaaaaacatgtttaattttgggtcgacgtggaatttttaaagtcaatttgaagtgttatcaccaccttcacagcttcccaagctctgagccagggtctgtgaagtggtaggagcgcaacaggaacccgtaattagcggatagcactaatcccaccgcttgtaattgaggtttacctcaaagtggccctaatcttcctaaataacaaggagatcatcgaaacaccaatatcaaacttgcgaagttgttctgactaaatgttctctgcaattttgcatagaaggccaaaattaaagaccagccagcaggggtgggggagatacatagtattgatgaccaaataatataattttttttaatgttccaggctcaaagagaaaaggtcttctctcaaaatgtcagcagattgtctcaacagactgtcactaaaacttgttttggaacattatgatgtacagctgccagatttgtttttaatatggaaagaaaactagagttggaatttggagataattacaaagataacagtaaatacgataaaatacttgtaaaataagcctgaggaagacaaaatttttaaaaggaatatgctggctgagacagagaaaacaaacaaaacatttaccagtcttcaactagtagaaagactaatcaatgtatgaaaaaagacacaagatggaaacttagccttatttcaactggtttcctcaatgcatcttgatttctgattttacattcatctaattagagctagtctttgtattttaaaacattaacaataaaacatctcccccattatttaaaaactaggtgactcttgacagtccaagaaacaccattctaatttagtaataatccatccattttcatgtgataccataattaccaccacccacaaaaacaaaaccaagatccaccaatcttaaatatttagaatattacttttaaacacaagaacagctgataaacactgaagcactcccaaatgcctagaaacttcccacctgtcagtgctccctcgtcagcttcacatggatggcctcgtcctcctctcaagcagccttggaggcaggccatgctcccctcactttgtgtgcaagaagccgaggctctgacaggtcactcacccactcaaagccatctgactccaaggcctcggctcttaaaattaattacctcattccagagagcatccaccacatagagaagctggaaactattaactaaaatcatggccaaggatggaacagcgcggtcctgtattttcatttcagccaaaagcatcaccaagttaataaccacctgaaacaaaaggggaaagtatatagcctcaaagcacctccccagagaccttagcactacaaaggcatgagtgagcttcacagctgagacacctggcagacgccaccgtaactcctacccgccaccaggaataagacatctcagcaccatgggcccctggacccaatgcactgagaaggacacagctatcatttctgtgttcctgtcacagtgggtaactttaccgcaatcaaagagaacactggaatgacccaaactgagggacacttacaaaataaccaaccagtaccttccaaaaagtatcaaggtcatgagagacaaggaaagcctaaacaactattagactagagaagactaagaaggaataacaactaaatgtattgtggagtcctgtcgaggttcctggaacagaaaaaggacaacagcggaaaaactggtgaactcgactgaggcctgtggacttggtaaccaatgctgtcactatgttaatctgctgttcttcatcactacactacggtttcctccaaggttaatgttgtgagaaacagaatgaagggtggaagggaactctttgctctctatctgcaactccaagcctaaaactaggtaaaatttaaaaaggaggaaaatgcattttttcttacattaattcatccacactatcactttcctacataaatataaactgatataataaaaataaagcaaagaaaagttatttaatttgtcataacctgtaacagggcatcttaaacctctggaaaatacttacaagaaagtattttgatagatttatggaaagccataattatccctaaaaatataccacccactgcttatttttgaatggtctacatttctttctagcagttaattagacctattgaattgaaatttagaagaaaaaaaaccagacatacccatccaatcaatccggggcgcaattcacaaaagtatttgagatcaaaagtaccaattcgagggtttaattcacggccaatgaagaaatcatagacagcatttcctgagaaaggaaaagtgtttacccaaacagcattccaaacccagtcaggaggctttacaacggcactgccgcccactatccaggctcacaattccactgcctgcaagaccctgagcagggctctggtggtgagaggcagacaggacggcacagacgagcggaaccaggagatgcctgcccgactgaaaaggcagttgctccagcctttgggggagccgggggcccaggtttcttaaaaaagttaaccaaaatcatgggggcccccccaaaggactttacactccattttttttagataggcgacatttttttatattgaaatacttcaggtcagcatcaaccaatttgtaacctctcgtttctcttgttttttgtttgttttgttttgagatggagcctcgctctgtggcccaggctacagtgcagtggcacagtctcggctcactgcaacctccgcctcccacgctcaagcgattctcttgcctcagcctcccgagtagatgggattataggtgtgcaccaccacgcccagctgatttttgtatttttagtagagatggggtttcaccatattggccaggctggtctcaaactcctgacctcaggtgatccacccgccttggcctcccgaagtgctgggattacaggcatgagccacctcacccggccagtaacctctgttgttttttgttttttaaagagtgtttactattttggacaaagaaataatatttgtcataagtcaaaatgcctgtaagtttactaaacgtcttactgtcatcaagcaactgcaaaaaaaagaaatgagtaagaaagtatgaaggtaaaacaaaaatattttcttcctttaaattcatatctctttaacgtttttcttcatcttttcattttttcttacttctcttcatttcccaaaaatgaagttagaaaaaaagcaatctattcaaatctggaaatggctgctggagggctctgggacgcattcatccaacatgcaattcatcactgctcaccagagctggcaggcgacaggtcattccggggcgctttcaaagagcgcatgtagagatacacactcaagaccacacaaaaaacagtggccgcaagtgcaaactgaagaaaatgactgtacacgtaatgaaactctacgccctggaagagagatgttccgatgactgcagatgtcaggataaaagcatagaatcctttaaaaaaaaaaaaaaaaggaagtggaaaattaatattaacccaaggctcacatgaaacttacgccactatgaaacaatgcaatgttcatttttaaagtcttaatttcattattcagactaaatacacacaaatatgcaaataagcaatgtctgaggtataattttcaatatacataccattatctcttgtagaactttccaaatagtttaacatattgattctttttcagttcaaatggtcattatttgcttttaattaagggaaaacagacaagaagtgcaacctgaaaattcccacaatccaaactctcaggcacaaagtcaaatggctaattattaacagagctgggccaaacacatattttaaagtctaatgccattacctaaggggagggtattatgcacctaccaggggtcaggcaccgagccaggttggtagttacaaaattataaatatttatacttaaccaagttgccaataatggtttcaaaagattctagtaaaactctatcatccagaacagagatcttaacatgccacccgcagaaaagatgccacaacacaaatgcccgaggctaggcaggggactgcgagtacctggggggtagggacagcaggcggggacattcacgtgcaatgccaagttaaaaagcacccgccctgtgacgctccacagaactctcgttccgggctagtcctgcagccacacagaaaggctcactggaagatccaatttttttcttttggctaaagaaatagttttgctttcaaaggagctgagtgcctcaaagagctgtgatcctaaaaagtcatcaaatccatttggataaacggtcaaaagcaaaaaagaggtagctgttatttatatgagaattctaaaaccaaaccttttgtaaagtaaaatagttgtctcaaattatctgaatccacattttccacaaatactccaaacaataacttctaaattctgacttttgaaaatattcatttacctttcataaaatgtaattttaaaaaagaatggttagataaagcagtcttttgctctctagcctatgtggattaaaaataatcatccaaaatgtcttaggaacctccttagttaataatcgtaaaatctcgaaaagaaatctcaatacttgaaccagagtaattagatgaggaaatttttaaaaaggatcaagcaacttggccagccactcccccactggctccaagagctccatgtccaagtgctgtgctcagtctctgaatgtaccacacccctcagagggaagtgaaaatataacacaagactacttagaaaagaattggtacctacagagaaacacacaaaacactgaaatcaaaggacctggcggcaaagtcaacaacccacctcaccccagactcaccttccctggtgtggtaagtgaaccaccagagggagggagggtgccaaaggttctaaaacttgctccatcagcaaagaatttggtaaaagcaacaaaaagtctaacaataccaatgataagtattaagcacccaccaggggtcagactctggagctgggggagacgttttatcacatgactggcactaaaaggcagaaggtgtctaaactatctttggcttcccctttagaacccagtggagtgactgcagacagagtagatgctgcgtaagtctctaaacaaagtatccaaagttaaaaaatgaagaattgaaaggataaaaagttcaaccattacaatacataatgtaattctcaagaaaaggaaaacactctactccgtcttgtcaaatggaaaatcattcaaggatgactacaaaatagatctgtactttgccaaagtcttcaaatgacaaagctggactgaagcactcagcacatgctcttacagtgcgagatgccggacccacagggagcaaggtctatccatttattgagctgcccagcaagctcacaactcatccatccagcactcacatatgaatgagcacccactacatgcccatcttcctagcaccaagagtgtcacaatgaacatagccaagtcctagcccatgaagccacattctagtggagagaccctaatgaagagacaaatacactgatgtgtggaggcacaaatgtcagacagaaaaacaaaacagagcaggggagagaaagggacctgaaggcttctctcagcagaagacagatggaggtgaagatgcaggtgtcagacgtttgggggtaagttctccaggcaaaggcccaggaagtgtgtgtgacgaatattcaagggacaacccagaggacatgagcaaggacaagagcagctcacgcagcaggagtggcctggatgcccacatccgtgtaacacctcaggtgataaaatcctagacaagtgcaatgatttctaacagtgatgagcactattaagaaaataaaactggagagtggacaagagtgactaagaggctatgttactttaatggcataatttatacaagttggctacaggtataaacagttgctcttccaactactaagaaataatttatcacttactactctggtctaatcagctttaacaaagagtttaacacttagaagtttaagctatcaaatcatcaatttgagtcttaaaaaaagaaaatcaccatttaatctatacttgagtcttcttccatcaataagaggcgttccttctacaaccttaaaagaaaaaaaatttacaaatttactaagcacatcaccatcatatatacatatatacacacacacatatatatattctagtatcacttaattttcaacacgcccaagaaggaagatatcttgtaacatggaaatttagtaatatgtttcaaaaaccctagtggcaagccctttaatgacgcaattccaccttcaggaatttatcttaaatacaaattcagtaatgacttcctagtgtaggaccaagcaactgcaacagccacgctccctgccacactcctgtgtaccaccacctcaagactaaatgtgcttaaatacctttatatctagtggatccctagctcaaacatctaccaatggctaccatactcttacaaagtaacagtatgattccattgtcttccatttgtggggtccttttcaattgggctctaccctgtttatccactctactatgacccaagtgctatttgatgacgcatactcatatgcttacttgctctgctatatattatatatatattgcccatccagttatttaaccatttcatgtgattcttttatctgcaataagagactgtgagaaaccaggtgtggtgactcatgcctgtaatcccagcactttgagaggtcaaggtgggaggatcacttgagtccaggagttggagaccagcctgggcaacatggtgaaatcccctctctacaaaaatacaaaatacaaaaactagccaagcctggtggcacgcgcctgtggtcccagctactcgggaggctgaagtgggaagatgacttcagcccaggaggaggttgcagattgcaccactgcactccagcctgggcaacagagcaagaccctgtctcaagaaaaaaaaaaaaaaagagagagagagagagagactgtgagcacgcatcatgcatcagaaccatctcctctcttcattcggcatcactcacagcattcagcacagagatacccacaggcatggtacccaatagaactggctcagtaaaaagtccacttgctcaatgcagccacgttttaccccacaaaataactattcagaaatgtagcaattcatttcaaactgtaaaatataaatatagtatcatttgctctgggctaaactactttatcttatcattagctacagatttcattagctagcattcctcctctcccaagagaaacgtaaaagctgtttgagatcacaggattagtaaaatgccacatgctaatttcagatgatccttatctattaaaggagtctagtaaatgctgtgttaggctttaatctgtgaatatatagatccaaatatacagtcagccctccgtatcgacgggatccacatccatggattcaaccaaccagatccaaaatatttcggaaaaaattgcatctgagctgaatatgtacagacttctttttcttgtccttattccctaatacagtatgataactatttacatggcacttacgttgtattaggtattataagcaacctaaaggcaacaaagtatacaaggaagatgcacacaggttatatgcaaatactatactatttcttatcagggccttcagcatcctcagattttggtatgtacaggaggtcctggaaccactccccaaggatatcaagggatgactgcataatattaatatatattttaatatatatgcttttagtcactttagtctatgagtatatacatatatgactttaaacaccaaaactgctttccttgatactctgaaatcaccttaccctaaatgaatctgaatttaactgtagaggcttactgtagaaatgactgaaggtctttatcacaaaaatccttgctagagccactaaagttatggtctcactccacagtattaagcctgcagctctaccctcctatcactggcattcaccagtaaaaccgatcctttggtttacagacagttggcaaacttgcaaagccctaagaataagatctttaaataaattatttattacttagggaatctcatgtttctttaaatatatccaagtaaaggattctactgaaagaagaaaaaactacacttagcaatggagagacaaattttaaagatattgcaggaatctgaaaacaacgtaaaatgttcttgacaacaagcttctgaaagagatgaaaattagaaacttttcatacttttttaaagtaaaagatgtagactaaagtccatcgagcccagtagcctatcaattaatcatttaaaatgctgcatctgaaatgacacatactaagagtgaattttttttccatagcaacctccactgagagtcggctactttgcaaaatagcctattcttttctatttggtttgaaaagttacacaagaaatctcaatcagatttttttttaagttcctcctaataagcaagtgttatacagacagcacaagagaaatggcttcatgaactaagttttgggaattatgaccaacaacagcctttaacctttaaactactctaaggctgggcagcatggcacaggcctgtggtcccagcgactcaggaggctgcggcaagaggatcacttgatcccagaaattggagacccgcctggacaatatagtgagacctcatcttattaaaacaaaacagaattaccataaacgtacctttccaattggcagtaggtagaacaggacttgaatcaaaaaccacaggaggtagaccccaaatactctggtttcccataactcatacaaagctggcaaaggaggagggaaattcagaagactgggatctttctgtttacacatcaacagcaacaggaagaggaacacaggcaggccaaacatgatgagaaacacacctgcaaacaattcatgaacattcgaggctcaaatttcaatctggtttatttatttaagaatcatgttagatttgttaagatcagaactcgttatctggctaactgtctgaaaccaatttctaatgtaccatcaaaaactcccatctctacctgtcacctctggtggcctggcaaccatgggcatcaaagtagtaaaaaaaataaataaataaaaataaaaaaaaaaagaaagaggtccaacattgaatagctacacccacctcagaaaccaagctctaaaacatttgacctccaaccactaaggagcgaatgtgttgaaactccagcaaactgaagatcagaacatctaaaaattatcagcctaatcttaacaaaaaactttatattcctcagtttctaacaattaaaatagtgtcacgttcatgtaatgtgtgcagattttaagtgatgctggacagcatctgtaacaggccagctagccaaaggttataacaaaatacaaagcaattaagccatgcaggattttgagccatttagacaagaagtcttttcttttactagctcataaaatttcatcagttccacccacttagtaactccaaaactctgcacacttcagatctttgaccctcacaatcaacccgcctagcaggtagggcagcctccgggatcccattttatgcaggcagctgaggcccactgctggcccctgccgcctcaggtctgactattagcagagctctctgtccctgataagtaaccatctatgctatacaaactcccagatcaaccttcctttatcacttctttgtacttctgtgctcaaaacctctgaacagactgctaaaagttttaaacacagctacaatggcatcctttctactccataatccctcaaaatgctcccacctcaagcctttgcacccactgttccttctctggaaggctcttccacaggttcccaccaggctcattaccttgcctgcctcagatgtcttcagagaggcctttccagttcaccttgtggcaaccacccctagctcaccccacctgccctctctgggcccagctctgaggcctaccaggtactcctccaaactccaagtcctttgcccggatgggggtcacttcaaaggttctcactgccagttcttttgcaacgtatttttcttccttagaatctatttcttttaatttgacttcttctcttcttggacgaaggctatactgtgttgctatgtaactgctttcttgtgacaaactgaatttttcctaaatgaaaaatttaaaaattaaatatctgcagtgaacaattaccattaatgctactgcattaactatttcagcatctcaatacagctatacactagtaagaataaatttgtgaaattatattcagtcttaatttaaggacagaattttagaacaggttataaaatattacaattttcaatgtgcttctcaagggagagtcacttttaaccaaaaaaaagaaaaaaaaaaacaaccaagatgaaagggaacactttcccacctgtgtatttttatgaggtgcgtcatttctctcaatatgctcaggctccccattatatctgctgatgctatttccaaatggcttctaaattgaagaatataaacatttaatcaaaagaactgtaacttattaaaaagaaacatgatggtaaaaacttactgttttggaatcaagcaataaaacagatttttcacagccttaattctgacgaatttaaccctcattttgttaaaaatgaaaaggaataaaactgactagaatttcccagtctctgaaatattggatagatttctacataaaatctttcatctggccaggcacggtggctcacacctgtaatcccagcactttgggaggccaaggcgggtggatcacctgaggtcaggagttcaagaccagcctggccaacatggtgaaaccctgtctctactaaaaatacaaaaaaattagccacgcacggtagcgggcacctgtaattccagctacttcggaagctgaggcaggaaaatctcttgaacccggagacggaggttgcattgagccaagaccgcgccattgcactccagcctgggcaacaagaatgaaactccgcctcaaaaaaaaaaaaaacaactttgatctttcacgtaatcagactgaatgtcataatttcattgatagattttaggggtatttactatgaaaggcagagaaagtaaaaattggtaaattagttcattaactggataaaaaacaaaagacattcaaaaagacattcactgctccaaaatagcccataatggaaaactaagaaatagtgggtacttatgcaacacacagtaggcccaaggcactaccaggtaagaggcaaagcttctgtggttcttgtgacaccaggactgtaagattacactgtaaaaatatagcagtcactaaatattaaaaatgaaaggataacaaagtatcacacagcatctgttcctggagtcccggggtggtaaagagagccactaatagttaaaatgttctaattcaaaatataagttagaacagtaagttgaaaatgtctgacagccacattctccaaaaaaaaaaaaaaaaattataatactcagaatgagaaactgagcattcatacactgatactactataaactttcttgatgcaatctggcaatatgtattaaaagcctcaaatctgcaccatacagctgacctagcagttccacttgtaagaatccatcctaaggaaataatcagatgttacataaaaatacttgtttgtaatagtgaaaatatggaaggaaaaacactaaatgtctatcattgacagagctgactttaacgattaagttacatgtatacaatttaccatatatccatactatagaatacaacaacaaaaatgatgtagaaaaatacactctgaaaggttatcccaatattttaaaatgtcttaaagctgactactgagcagtatgtatataatccagtttttaaagtttattaaaagtctgttgccgggcgcagtggctcacgcctgtaatcccagcactttgggaggccgaggcgggtggatcacgaggtcaggaaatcgagaccatcctggctaacacggtgaaaccctgtctctactaaaaatacaaaaaatcagccaggcatggtggtgggcgcctgtagtcccagctactcggtaggctgaggcaggagaatggcgtgaacccaggaggcggagcttgcagtgagctgagattgcgccactgcgctccagcctgggtgacagagcaagactctgtctcaaagtctgtgtgccttctatccagaaaagaggttaacattaagtgaatagaagattacttttattctttttacttaacatactttgtctttggtctactatctaaaatactatttgtacaagatctacaggctccatgcaccctgatatttcaaagcttacatcttgaaagtaattccactaaaatcatctttgaataggtaaagtgataaagtataatgatgctaagagtaagaatgtttccgtaatacaggtttgtcttaccatttcatacatgatatgaacttttatacactgtaaaaaccttacgcagttcaatctacaagctacatctatttcaaatttgaacgctgcttttttaaaaactaaaatattaaatagcatttctggtaactgaaggacattcttttccattgatatttaaaactttctattccaaacatttgttttatatgaaaactcccaaagtcatcaacttagatttgatgtttcagtgacattttaatattattaactgcaagtaacttgagtaaatatatacataaagcggaagacaaaaggctgtataaggataaacacaagtaccagaatcagcggagtcaatttaacttccacttccctccttgcttccttaatgtcggcctggtgggaagcagaagcagatcggcgggcacttttaggtggtcgaccaggggatcgggagcgtgaccttgatcgactccctcggcgtctggaaggggaactggaagttgagccacctttcctttgcctaaaggaagttaaaggctagaaagggggaagaaggcaaagagctttaccacaaatcataacacatacagacagacccacactagaagaggataacaaaggcaggaactgctaccattaactctaaaatcagcacgggaaatgttaggatctgagaatggatcagatgaagccaatggaaaatgctttcataatgatccatctttcatgagacaaatgcagcctttccattcctgttctttgaaggtatttccatgaaacgaatgtatctaaaccaattagctgtacttatttccaacaccatatgcaagaagggtaataattaacatggattaaaactgagacgacaggacaaaataaataagcacacagaccaaaaaaaaaaaaacagtaccacagtttcactctgaacaaaacacataagcagatcttgaaaataaaacatgagcttggatgactgggaactgtttcactgtgtccccacctactccgaatctccttatgttgcttctagggatgtagacaaattacgccccaggccaagtccctcaccccaatttttgtgtggccttcctactaagaatggcttttacattcttaaatgattacaaacaaaatcaaaagaacagtatttcctgaagtgtgaaaattatccaaaattcaaatttcactgtccataaagttgtactggaacactgccatgtctgctcccttccatactgcctggagccgctcccataaagtctaaaatatttactttctgtgctttattcctggtctagagcactcgaagtgtcatcctcagccatgggtcctagaaatgctcgttactaatctgtgcaagtaccaaaattgagaaataggtgtatggaaatgtttatagcattttgacaaagtaatctcatatctatcgaatctgatagtaaaactgtgagtcgtctattgtgtatgtctttatttttctagtaactcatttttatggcattttatataaatgtttgtatactacggatcagatatcttaaaacccaggccctcaccagacaggttgaaaagccctgggctagactcgaatctaattaatgtcactctcctgattaaatccttggtgttcaggatgaagcccaaacccttgggcatggaatataaaagcccccccagcctggctcctgcttagccctcccctaccacccccttccagcacttggctgactgtgtcccccagacccctgactttggcatactgccctctctgcagaaacagccccatcaactgctgtttttcctgtttgttctcagcacttggctaggtgtcactgcctctgaaagcctcccctgaagcccagggctcttctctacccttgatacactcaacaccacccacagcaaactccagacacagaacgtagtaaacccaggggaccaacagatgcaaatggctgtctttcccagtaagtgtgagcttcttgggaacaaggactatgcctcattcatacattcccagagccaaaaacagtatgtgacccaaagcaagagctcaatcctctgccttcaaaccgagctgaactgactatcctgagcttagaaaccatacttagagttatttcccacttactgtaaacacactctgataaaccaaaggagctcttaccttaatatcattctctttcaattcaagctctgttccatctttatacttcacagtgtaaagctgggaggtgctgtcgtggctcagaatttctacttcataataaagtgaactcccaggccatcgacctcttaccacttcaccatcggcaaatttcctacttggcattttctataattaacctgaatagttttaaagaaaaaaatttgagtcaatacatacacatttatgtattcgtctttttccacaggctgatcactaaaatacaactttccagaattgactggtcaggattttagggccagaaaggctacattcaatctcatttggaatcatttgagaggatgatttagccactgcgttatctatgtgacactaaagattaattataacaatgtatataggcgccataagttcacactatgtaaaatgttacccacctaccgtgatcacagttctcgctaatcaaaaaatgaggcacaatctcacaaagaacacattttctcatttgtaaatttgcgtatcaatttacaatggctttaaaaatgcatttaattgtatttttaacaaattgcctttattaaaaacagcaaactataaaccagactgggaaaatcaaggatgtacaattaacatgactataacccaacaataggaagaaaaataattccaagtctgtaatgaataaatttgggggttatttagctttcaactcttacagctaaagtacaaatgcataccaagtaactctgccaaccacccacctaagccagggtggttgccttcatccaagctcacttctctcaagcctacagcagccatcaacccccaattataacattcttttcctctgattcaaaacatggcccacaagccccacaatactctaggaatccacaagcaatctgcaagaactgccacttacgtgaggcctgtctgccaccctttttgaaatatcaattgatagctgggtacttccagctgccagacagtaatgccgctccatcggctgaccagcggaatcacatttccacacaacaaaaccagggctgccgaccttccccagtaccacatgaactagctggggccacgtccaaggggcagccagtaggacagatatgagctgtctcccaaatcaccttcatttcaccaactaagcacttcttgatgtattgtccaagcctatcaatgtacattcctcactggctcctgttaagagctgatgatacaataaaagcaacatttaggaacctttgaagactctggaattaaggagaaagttgaattacctaccccaagggagtagtgggagagtggggggggaggcggggtgagggaggcctttcttaaccaccacattttttcactgttaatcgtctgtgaaaaaacttaacaagctctactagtttacagagatggcagctaggttggtagatgaaagaaaacacaagtacttatctggtgattagaggatgtcagtcaattaacacattaggtaagagaggcagctttcttccctacacctacctgagattgggcatcactggggtaatgaatgggtttgggcttggagtagtggggaggagcccacaagttttcgggatgaagtcaggcctggctgagtcacccgaggggcacttagggagcaggggggcagtgaacacctctgcatgagcaggggcataaaaacggaaggtgacaacatccagctttgcctatttcaacatttagctcagagcctccaagtacaaagaaagaggaaggaaatgtaccctccttctctcttctcttgagccccctcctcctccctaggccccccaaaatcaaaccactcttactagtactagctctcctacactggtcagccagagttaaaagaaggcaattatgtcttcctacaggaagatgctcaagttgcaaaaaactctttataaacttttgaaacacaagcccttcaggacgcaggggctacttgaggttttaaaagacccttgaacagtttctgcgtgttcttaaaaacttatttactggcatctttccattgcacttacacaccacatacacagtatctgtgtaatataaacgcaggccagtgccaaaaagattcttatcaattattctgggttaaacaagttaacacatatggtggatacctgttaggtctctaaagcttactttttaaaagaagaattaagatttgcttgaaaaacaaacaaaatgaaccggcattcttcttagaagaccattatcttatacacaaatgttccaaaagatgaagccaacaacatgatgtgcacccccactttacacaagatccacacacaattgtcaaacgtgaggatacagtgcaatcacatcctaatatattcccccacaggagtgaaatagccaggatggcacacaaaagccccacatttgttcgtgtcactcactatgcactcacctacaggagtcaagatacacacaggattttcttacaagagatgttttaggcaagtgtgtttgtaaagaaaaattttgttcactgcacccaatgtcctcattcgccataaacaggaaaaacacggagaccctcaggtttttctctattaagccagatgcccgctaacttcagagtcaactggcactgcaatcctcacacattccagctccggtatgttactgtttgtgaacacaacaattctctgctcattaacattacaggggtctccagccatctttccttcacttctccaaattcatctaaacgtggcatagagcaagacgctcgaatgacgttggacagcttccttttcacacctgagccccggtagccccactaggcaaaatgcaaacaggaaccccgggccttgctccgcgccctttgcttcatgaagcaacagaaaggccaccttcctggctgtaaaggcagaagcgccttcttccccataaacatccttgggcagctcatcattcccctcctgctcgttcttctccctcttcccaggcagcctgagaaacaaaacttaaactggacttgttgcctaatctaaattaggatccctctgctcttctccgtagctccatcttctcccacacaccagttactacaatgcgtaactacagatctacacgtgtttacgtgcaaggtccccgggggcctgttcaccctggcactgcccaggcgccgcgcctcgcgctgcaggtgtccacgcgcggaccacggtatctaccgcgccctcgtgtgaacacccgaccgggccccgtaatcactctgggaaagcgccttcaacaaagccctccgaaagcaagtgctttactaagtgccccttgaggctactggcagtgcgaggctggctgtcattagaacatttttctgaaccctcaaaaaggtgaaaaagcaggaccgtgctttagcaggaacacgcacacccgcctaaatacccgatttttgagactgtccgggcgaaggaattcaacgcataggagcgagcagccatgcagtgtgcctggagaatcaccaaaccgcgacgaccacgaccctcaaagccagtgacaagcagcgcgaatctaagcccacctcggccgcagacccttccccgtcccgccaggccgccgcgccctgtcagcctcctactgcaggaccgcggggccgcctgctcatctgtcagacgggcgctcggaggggccgggagccaggctgcggtggggcaggacaaaggcgcccacgaaccctccctgccgccgccgctccacagccgcgccgcgccgccaacatggagggaaacgtccgcagtttaaaacccccagctccatttccgcagcgggcccggctcgggcgagctccagcctcgcccgccgccgccccgaccacccgactgggccagaaaaggcgaggaggggaggagacgaggaggcgaggagaggaggggaaggccgccgcgccaggccccgcgcccagggtccccggcccggccgctgcgccggcctcgggcttcctcccccagcggcccctcgaagaacgcgccgcggggagctgggagcagggcgggggtggaagcactcacctgcgccaggttccggcggtgacacggacggctcccggagaatagtcgcacagcaacccggcggcagatccacgcgcgcgacgctacccggccgcgctctcgcgccccgcagtcccgcaagccgggcgcgcgcctccccggccccgcctcgcggcgcttctcccctcccctcgcctcccctccccaccggcgaggccgcccggggctcccattggctcctcgaccttttgaatcatccccggcgctgtcgattggtcgcgcgccgtggcgcgtccgccccgccccaccctgcctgggggcggggaggccggtgagcgggggaaaccgagtctggcggggcggcccggagcgcgacgtttgccaccgccttatctcagccgcccaggcgccctcgcagcacacggagcccgcgcgctcccgccctttccctcccagcgctcgcagcagtgtttggggtgccaggtggcttggcgaacgagatttttttttaagctacaaagaaaactaatacattcttgaagtgatcaccaaagatccgagctcgaaagcgtttctcggtaaaacactatgagtgccctccttagcgtgttaaaatcccacagaagcccctggaccaagcagcggcatcgaaggcgagcaggggcgcttttgtgtccgcggccgctgaacctgcgtagaagcgaacccggaccgatgctgggaccggcggcgggagggagggggaagaatggccgagggctcctacgacttacgctgcgaggaggggctcggttgttacccgagatgctgtcgagatgcagtagaaaatccccaacaccgcggagcgtggaacaagaagttttatgcgttacacaccgaaacacaacttgacctgcaacctacaagcctggttttaattgaaccccaaaatgctgagtcatgtcattgttgactccgaatctgttacggatcctaagcttttttttttctgctagttttcattatcggttagttgatttccttcctttgaggtcgagagtttaaagcagtccattgaagttccctattttgcagtgtggttttaatcaaagtatttcttaacaccctaactaggtatatttaagtgaattgctattttggaagcattattaaattgtaataatgaatagaacttttcatctatagcctagcttcagctttcattttctcatagaactacaaaacacccaggtttacttcttaaaaaaaaaaaagtgaaaatacatcgagttttctcagtcattcacatgcagtgtgaatgagttcatcagagcctttcctgagaagttctgacatcaaattgtcattgccatcgaatttgcccttggtggagatctgtgcaacagaaatgcacatcgcactccaaagtcagaaaatcttttatttttgacaaacccccaagtctcaattgtcttaacccttgacataagataatattagtcctacctcatagagttttgcagtaaattacacagaaataaaagcgcttatggggacctaagacagatcctatcccaaatagccaagcagtgagtgctacactattcttttctcatatgttctacccagaatcaagatttcactggatttcccttgaggtgcacatttcctggatgatttccacttgtgaaatagaagaagattcgtttcaaaaaaaaaaaaaaaaacacctggccaggcgccgtggctcacgcctataatcccagcactttgggaagccgaggcggttggatcacctgagcaggagttcgagaccaacttggccaacatggtgaaaccccatctctactaaaaaaatacaaaaattagctgggcacggtggcgagcacctgtagtcccagctactcgggaggctgaagcagaagaatcgcttgaacctgggaggtgaaggttgcaatgagctgagatcatgccactgccactcagcctgggcaagaagagcgaaactctgtctcaaaaaataaataaaataaatttttaaaaattttaagaaccttattttaaagatcaggtttataaagtctcatcataacaaaatgaagccaaaactttgtaaattaactagagttagcttagctaacattttacctaataaattactaatgacatttttaaaacaaaactgatttgacatcaggaaaactaagcaataatttttgttcatttctacttcgtggactcaaacataccatgaacaatcagatctatatgtaggctgctttctcaacaaaggaactgtttggtatttttctcttcttttttaagtctactaaaggctgtgtaaacttggaagtggggaattttcagaaagttctcagaaagatgcttgtcactcacaactagcaagttgtgggttttcagaatctataaagtaaaagtcacttaaaagtccgcatcttggcaccattgttgttaatgaggccatgagtggcaaagcccctttccccattcacataacaaaagcaaagcaaaacccttcagtcctgccactaaagccaaccaaaacacacatgcggccaggaagctttcatatataaaatacaggaacccccagcggaatgcattccaatgtggcagttatttggctctggtctccagaggatctcggttcccaggattgaaacatctctttcaggaaagacgtgtaggtaaagtttcacgtggcgtgagatccagttggattcttttggtactgttacataaggaacaaacttctgtatgctgcaaactgcagaaagcctttattcataaggtagaggtacctcaaaagctgtccgataaaaacacatttctactgatgatgtttgatatggtttctattcacacagaaatggagctcacaattaacatgatgcattatgtccatctcaatagcaatttaaaaattatttgaaacttcttctacatactatatgtatgtttgcagcacttatcctcttttttttttttttttttttttttgagatggtgtctccctctgtcacccaggctggagcgcaatgacacgatcttgggtcactactgcctgtgcctcctgggttcaagcaatcttctcacctcagccccgagtagctgggattacaggtgcacgccaccatgcccagctaatttttgtatttttagaagagatggggtttggccgtgttggccaggctagtctccaactcctgactgcaagtgatctacccacctcggcctcccaaagtgctggtgagaggtgacagcgtgctggcagccctagcagccctcgctcactctctgcacctcctcggcctcggcgcccactctggccgctcttgaggagcccttcagcctgccactgcactgtgggagcccctctctgggctggccgaggccggagcgggctccctcaccttgcggggaggtgtggagggacaggcgtgggtgggaaccagggctgagcactgggcttgcaggccagtgcaagttccaggtgggcgtgggctcggcaggccccgcactcggagcggctggccggttccgcaggccccaggcagtgaggggcttagtacccaggccagcagctgcggaggatgcgctgggtctcccagcagtgccggcctggcccaccagcgctgtgctggaattctcgctggacctcagctgcctccccgcagggaaaggctggggacctgcagcctgccatgcctgagcctcccccacaccatgggctcctgagcggcctgagcctcccagatgagcgctgccccctgctccacgcgcccggtcccattccgaccgcccaagggctgaggagtagtgtgggcacaggtcgtgggactggcgggctccctgatgcaggatccactaggtgaagccagctgggctcctgggtctagcggggacttggagaacctttatgtctagctaagggattgtaaatacaccaatcagcactctgtgtctagctcaaggtttgtaaatgcaccaatcagcactgtgtatctagctaatctggtggggacttggagaaactttatgtctagctaagggattgtaaatacaccagtcagcactctgtgtcttgctcagggtttgtgaacacaccaatcagccccctgtgtctagctcaaggtttgtaagtgcaccaatcagtgctctgtgtctagctaatctagcagggacttggagaacctttatgtctagctaagggattgtaaatacaccaatcagcactctgtgtccagctcaaggtttgtaaatgcaccaatcagcaccctgtgtctagctcagggtttgtgaatgcaccaatcagtgctctgtgtctagttaatctagtggggactttgagaacttttgtgtctagctcagggattgtaaacataccaatcagcaccctgtcaaaacagaccaatcagctctctgtaaaatggaccaatcagcaggatgtgggtggggccagataagggaataaaagcaggctgcccaagccagcagtggcaagatgctcaggtgtctttccactttgtggaaactttgttcttttgctgtttgcagtaagtcttgctgctgctcactctgcatctgcattgcgtttatgagttgtgacactcactgtgaaggtctgcagcttcactcctgagccagtgagaccacaaacccaccagaaggaagaaaagtctgaacacatctgaacatccgaaggaacaaattctggacacgccacctttaagaactgtaacactcaccgtgagggtccgcggcttcattcttgaagtcagtgagaccaagaacccaccaattctggacacactgggcttacaggcatgagccacgatgcccaagcctatttaaacattctcaatattaaacatttatttgttaatacataaattagaaggggaaactatttgaatagatggagcaagtatactgcttcagtggaggaacttagaagatgtgggatatgtgtgctttaatgacttgttgatagagggaaaacagcagcaggatatgaggtaataataatgataaataatctttgttcagtttttacttcgcccccagctgttgctcaaagtgctccctgtgttctaactgatttaccctcataaaagctgtcccaggtaggtgatcttatagctgaagaaactgaggaggtatggggaggttaatacttccccagacttatccaaggcagtgtgattccattgtctcccaaaccaactagcaaagtgcaggagttctcaaggtatggtccctgctcagcagcagagcttctcctgggggcttgttagaaatgcagcttctggctgggtgcggtgcgtcatgcctgtaatcccagcactttgggaggccgaagtgggcggatcacttaaggtcagaagttcaagaccagcctggccaacatgacaaaaccccatctctaataaaaatacaaaaattagctgggcatggtggtgcatgcctgtaatcccagctactcaggaggctgaggcagaagaatcacctaaacccaggaggcggaggttgcagtgagccgagattgtgctgctgcactccagcctaggcgatagagcaaaactccatctgaaagaaaggaagaaaaagaaagaaagaaatgcagcttctcaggtccgctcctgaagcttgaagcttggggtgggctcagccatccagctctccagaggattctgatagaagcaggctccagttggagaacctctggcgaaaagataggtcatggtgaccgtaatgatttattttccttcacggtttcctatctgaggctttaaaccacttacttgatttatagaaaggaatactagaaagctgttctgaagcttgtgcagcacccgagtgtcttcccaaaggactgatgatatgttgagccttagattaataagagtccatacctgctggccaggctgaagagactggccaagaggtaggggggtagggagagggggctgtcagggatgggagtggctgccaccatacagccttctcctcctctctggccagagcatcatgagattaactgctctggcaaagtgtgctctcttgttttggaaaactatttctttactggctgtagaattaatgtattctgaaaacttctaaggaaatttactttttaaaaaataataataaagaattaaaactaagggtaaaggacatttaaactgaatgaggacactgagaatcagaaagatcacacagtgtgtggcaagctgtgcttcaaaccaagtttttccggactccaaagcatatgttctcatcataggttctagagcaggcacctgcgttagcaagacggtcagatgcataagcacatgcaaccttgatttacgttacttattgccagccagaaagaggaacagaattcagtaccagaatttactagattataattctagtgaaaccaggtctatgttgcttttgttgatagttcttggcacataataggtgactatttgttgaattaattgattgatttggtgatcgattgattaggtggagagaaggagggagacaattctaagattgatccaacactcagtacaaggagaaattagtgaagaccagcctggctggggtggagtaacagctcataataggaaaaaactatgagaatgatgtcaatatcattcgatctatcaaaagatcctcctacctcaactaaagggcatagagtgaccatggaagtgacactgggccaggaatgcagtgtctgaagctccagggctgccactcagcccttatccagcaagttatccaggtcctgatttcctcatctgtaaaatggggataaaaagtacccattctggccaggtgcggtggctcacacctgtaatcccagcactttgggaggccaaagcaggcagatcacttgaggtcaggagtttggccagcctggctaacatggcgaaaccccgtctctactaaaaatacaaaaattagccaggcgtggtggtacatgcctgtaatcccagctacttgggagactgaagcaggagaattgcttgaacccgggaagcagaggttgcagtgagccaagatccctccactgcactccagtctggacgacaagagtgaaactctgtctcaaaaaaaaaaaaacaaaaaagtgtacccattctgcacaaggtacactaggtaattgtgaggattaaatgctatatacctgttagaacatatcaggcaatcataacccttagtgtaatcattttatttcaagttcgttaagtcaccatttttagtcaactataaatagatgaaagagtgttttcagtagcagatgtgtcaataatgttttaatgcgtttgttgttttttctctaaccgcctaaatcctttgaatcatcctgtagtgcacacttcaacataaaagacgtaacttcgtcttttcttccatgctactctaactgaaaaatctaacccgctggattaatcttaaaacttaaaggtccttggactgttcaggaagtgattattattcacatttattttaatgtttgctaattaataactgttttttaaaattcgcctaaaatgcgtttggataggtagagagtcctgaaatatttatctgcaggaaaaaaaaatcaaacttagtaacatgacacagacaaggccttcaaaaactcaccctaatggatttctggtaggctcaacatcctcttctctttccagcacctgccttctctttcccaccccctccaccctcagttctaccaaatttctgatgagtcctcagataagccttttcctctcttgttgcttggaatgcctcccccttcttttgagagtggcctgttcttgctcatccccagcaaaacttcctagggcagtccccacatacatctgtcactgccttcccatgttatgggcatctgcactcctcccaggcaggaagtatatttaatttctccttgtatctctccccattaagtaaatgaatgtgttcatcatgaaactgtgtcatatatgttctcctaaaggtcagaaggtagtaaacgctcttgttccagttactgagctgccacaggctggactgaggcaagaagagataaagcctccgctggcactgactgttcccaccggctggagaggtgcggaagcctatcttcggtgtctctcttgctgtctgccacaggctcacagccccatggtggggactctgctgtgcttaaatacccttttctccacctgggttgccaccatctctcttaattcagaatatgtaactaaatgtttctttttaaaacctacagggaacacaggtgcatggcttgttttggcatggttgctaaaactgcgagtcccagagggcagccttcttccccacctcccacccaaagtctacattcagaggcagacgggggctcaattgtggaacagaaagtaccatctaggtaacatgtaattaccatgttgcttcccttctggacaagataaggctcagcccatcagtgttaatgtttagcacttcatgtctgttcagcaattgctcccactctatcaacaaaactacaccataccctttaggaaaagtgtgtagcaactacagttggcatcagaacaatggagaaagagaaggagagggaaggggactcatttctaatgaggccctgttctgtgtcacttaccagtccttaccttatttatggctcaaatcaactcaacaaaataggcatcaccccctctttcaggacgaggaaactgagactcaggtcagcaaagttgcaatacagcgcacccaccaaattggggctggaaaagaaattctaacccagttctctggattccaaagcatatgttctttctaccctccaaacccattagggtccccaagcagcctcttagctcccttagccattgacttccggtcgccacacacaattcatattacatgatcccactgtcaatgtcagctggagacatcccaggctaatgagaatatagcttgtgggcgttttgtctacatttctggagcaaagaacactcatccctgctctctcaaagagcaccatgcatgtgaacttgtccttgtctctcaccctttgattctttcttccatggctggtctattttaattctgatacctattctggattctgtaggactgtctttatgtcttcctttccagggactatcttagaatattcacttgtaggtatgatatcaagggcaggatcactgtaatctttgtagtacacttagtacagtacccaatgtgattaaatctgtttaaaacacatttaaggggaataaaatataaaatatttgagatgaatatttaaaaccaaatttgcataattgttttaaattttttcattttacttgagcaagaggtacaacataaaacctatttggagcacagtagtgtattgaatcattttagtcataacacacacctacataaatgactaaaaatatcaatattttatccttttaaacagatgacatataattgcaacgtagatttatttgaaagttgtacagagttggcttgatagttattcaacaactgtaagtattaattggcatgagtatttcagcagaaaaaaactatatattcatactaagttgctgatgatattttgcttgcttactttagatacaagaggctaggatcccagaaatttcactgctgtagcaaagcaagtcatgttactctgaattgacagttcccagtcattctccacggtaagtcatattgccaaacacaatgccatttttaggtctactttaatcctatttgactatacagatatggtttttatttacttagtcctatggtttgaatgtttgtcttcgccaaaattcatttgaaatttagttggcatcgtaacaatgttgagaggtgggacctttaagaggtgatcaggccatgagggctgcaccctcatgggcggcattactgccattataaaagggcagggtcagccccctttcatctcttggcccttccaccttctggccatggagtgacacagcaagaaggccctcaccagaggcaggcatttagtgctgttcattataaattacctggtctgtgttattctgttattcaaaaatgtcatttctgcaaatatatagttcctccctttttaaaaaaaagttctacttcttttttctattttacttttactgatgttttgtgtattcatcttcctggtcctatagagaactcctattgctccgtaagtcaaggccagaactcccatcctgaccagaaggaaagatgcccagttcccacatctcctttgctaggcctgccagaagggggctcctcctcctggccaaggcaggctagtcagatccctttgtgttcatttttaaaaagaagtgccatatccttaaacatacttcagctgtccttgtgcctgctggataatgtatgagcttctggaaaaaattcttcagcactgaacatgaatttaacaggatatcgctcccttcttaaggttttcaaatcataaagtcagattagggattcccattaataattagtcctctttattacactcaaaaggacaacataaattcctgtcagttactttgaaaatactttgctcattaatacctactcaaaccaacgataaatactacttacaaaaattctctccttaacaaaactccacccaggctcctctcagccctcttctcaactaagtgctatccttggactataaagacttgatcaggccgggtgtggtggctcacgccctaatcccagcactttgggaggccaaggtaggtggatcacctgaggtcaggagtttgagagcggcctggccaacatggtgaaaccccgtctctactaaaaatacagaaattagccaggcgtggtggagcatgcctgtattcccaactacttggaggctaaggcatgagaattgcttgaacctgggaggcggaggttgtagtgagctgagatcatgccactgcactccagcctgggcaactgccagagcgagactctgtctcaaaaaaaagacttgatcaaatgctagcatagtttctaacagctcaagggccttccctaggatggccctagcccctcttagaatgcctgcctgagaaaactcgaggctgcccagggaatttactgttggttccagccaacacctgaagacaaggcccccatctccctgcctctgtgggagggtaggagcctaacttccataagcaccagtaagtaaacagatgggttgcacatggaccaacccccacttcctgcattttataatttttttcacagaccctcttgagcccctgctcacccactccctattccctcatcctccctttttttttctgagacagagtcttgctctgtcacccaggctggagtgcaatagcgccgtctcagctcactgcaacctctgcctcccgggttcaagcgattctcctgcctcagcctcccaagtagctgggaccacaggtgcatgccaccatacccggctaatttttgtatttttagtagagacagggtttcactatgttggccaggctggtctcgaactcctgaactcgtgatctgcctgcctcagcctcccaaagtgctgggattacaggtatgagccactgcactcagcccatcctccctttaaaatgccatcatctctgtacacattgaagttgagtttggagcacactggacttttttccctattgcaataataatagtatattactgatgaaagtctgtccttaccgagtatccaggcttgtttatctttgatactaccaatcttcttttactaaaataaatattatgatttctaaattttttaatcaactgagttatatcagatatgcttagccaaagcatgtagaaccccattgaaattttgatttagcatgcatccactagattaagaattattgctctaagagtctaaatgtatttgcatcatgcatttttttcagtacaacataaaatggcttcatatataatatagttcaaaatgttgttaatttcttcaggccaaggaacatgcaaacaaatgaagaactcttccgatttcctagggaaaatacggtttgaggatggcttaaacataaaatattaacaggagttaattaacatagaagcaagctgttacctcaagttgctttcatctcagcataattcaaggtggaagagaactgagcttcagagtcttctcttccatggattgtcctttgcaaagcaagaaaacatttttccaatggtgaatgtgttagtaaatgccagtgaagctataattaagtgatctgggtttccaaggaggaaagtgaagtttcaaaccatgtttactgtacacagtttttcagggcaagtactttggacacataagacacataagcttttttttttttttttttaggggtcttgctgtgttactcaggctggagtgcagtggcaatcatagctcactgcagccttgaactcctgggctcaggggatgctcctgcctcagcctccggagtagctgggactgcatttttaaaaagtataatgctacatctaccaggaaaataactcaggtggaggatggcttttttccaatgagagtccatgattgaaagagttagaggaatcctaactagcagaactgagtaacagaaagcacatggactttggagtcagaaacacctgcctttgaatcctggcttctgcgcctgcacttgagatcttaggcaaggtacttacattttattttcagactgtttccttatctgtaaaatgagaaaactaataatacctgcctttcacagagctattgtggggcttaaatttaacaataagcaatcaataaatagttctgattcattgctttaaccattcattcattcagcaaatatgtgtcaaactctgacagtggaagaaatttaaaacaaattccaggactgcctgggatttttatgtctatcaaatgggattcaggttagtgagggagagtgaagaaatgaagtgcactgttcttgaggaattatttaaaaggcttttccaagaggatctacgtggctgtaggacatttagatgcctggaaaggccagtaagccagctgggtgttgctcagaacacggcctcccacagcaggagacaatttcccagttctctgaattagtactttggctggaaaatcagcacactatgcctgatccctggagcaatggactgagtatatagttatagctagatgagttctttgacatccctaaattggaaaaatgtctttcctagagtttggaaatagctcaaaaccaaaaccaccattttccctaaatctatttgtagtgcttgagccacacgttattgtaaaatacaagggaccagttggcaggaagtctcttagactacttgaacatgctctttgcccctccatgtacacaccctggcctcctctccgtcccagcttttaaatacagttagcagtaagaactccctgaattcacaccagggcctttaagacctcacccacaggtcagtaacaactaaggatggatctgaggctatgggaacaaagtgctcacctcagatggcgagggggtgggagatgggtgcatctacgttcagcaattggacttatggctcctgaggatcacattgccacccacgcccatgttgaaatcaacttgctttgtcaggccattggctcaggcatgtttcatgacaatttcattccctcttggtaagacctgggtcatttttgaatgtttgcaaacgttagaaactctgaataccatggattaataattgatgacgcccctgagctccctctactggctctgcctcagccagctacagcagggggtatttctgtttatatttctttcaagaaaagagtaatttataatccacaagcagggatgataaggcaaagacataaaaaatggaggatttttttaagtagttggaagttggtggacactcccgggcaggctttacacttccaaggcagaagtctgagttgcgtgtcctgctcttggcctgggcagatggtgcacagctcaggaacccttctagaatgtcattactgtgtgcagataaaactgaaagcaaaggggctggaaccctttccgtttgttctgcacctgaaggagttcagagagaataaaacaatatctgggccattttttttttctgtttcaagtctctaaacagaaagaacaacaacaacaaaaaaaaaaactgatttgtacgggaatcactccaggcatgacaggatcaggaggtactttatcctgaggttcctctgagccattaattgccatgctgaaggtgaagaaactgaaagaatggttgaatgacctgctccggttgacacagggaatgagtgccttctcctctgcagaaggaggaacaccctccaccatgatgctctccaaaacacctgcacagagcaccctgctggatgccagagccctgtgagggcttcctggtgcaggtgaggcccggcacagccagcagaaggacttatcctggctaacaaagacttgtgttacatgtcccccttcaaaactggtgccacatgtctgtgtgacctacctgctggcctctcactgctaactgaagacaggcactatttccccaccatagtggtctttttgtccttctcatgatttattggatgcataaaacaaacacatgagctggctcacacctgtaattccaggactttgggaggccgagacgggcagatcacgaggtcaggagttcaagacccatctggccaacatagtaaaaccccatctctactaaaaatacaaaaaattagctgggcatggtagcaggcacctgtaatcccagctactcaggaggctgaggcaggagaatcctgtgaacccgggaggcagatgttgcagtgagctgagatcacgccactgcactccagcctgggcaacagagcaagactctatctcaaaacacacacacacacacacacacacacacacacacacacacacacacacggagggccaaaaaaaaatggtaaggaagaagaagaatggaggcagaaaagatgccaccctggagaggtgacctggctgctgtggtaacgtggacatgctcagcgcgtttcaggactgttaggtttcagggtctgcccacctgcctctcctgagaggggggcgacagagagctggctgcgtgcagggctctcctgggaatctgggctctcagccaggccaccccacagaagtgttcaggggcagggagttgtatatcctggaatgactatttagaaaggatataacagaggggagagaaaaataaggaaatgtgaggagttaggtcaatgcttgccccttcccacgggcccacccatggtaacgctgtggctcgctgcaggccagccagtatctgggaatacagagacgcatgatagtgtctttctactctgattacaactccactaggtgccagcattttgcatgcaatcgctctattaatcctttcaatgtccttgtgagataggtccatttatccccattccacaggtgaagaaactgaaagaatggttgaatgacctgctccggctgacacacggagtgagtggctgagctgggaagagagaccagtggcgtgtaactcagagtccacggtgtgtgatgtatgaaggactaagagagaccagtcaggagcagccggaatcccatctggagcctaaagagttgtctttggtgtagaaagtgtctaccccacccctaattatatatccagtgaaggctgttgcttaacgtggctgttggctcataaactgtaagcactatgagagcaagtcttttcatctgtgacctcgatgtcccccttggtgccatgggctgtgcccatgtgcgctaaatacacatgatcagcctattgctgtttggccagctgtcttttttttttttttttttttttttttttttgagatggagtttcgctctttttggccaggttggagtgccatggtgcaatctcagcttactgcaacctccacctcctgggttcaaatgattctcctgcctcagcctcccaagtagctgggattacaggcatgcaccaccatgccaagctaattctgtatttttagtagagatagggtttcaccatgttggccagtctggtctcgaactcctgacctcaggtgatccgcctacctctgctcccgaagtgctgggattacagatgtgagccaccatgcccagccacccagctgtccttttaggacactttctgtactctctgtaataacagaagtcccacaccagggctgactttatagaaccctagttccaaactctcttagttctgtcaggaaagcatttgcatttttttttctcccccgagacagggtcttgctctgtcacccatgctggagtgcagtggtgtgatagctcactgcagcctcaaactcccccagctcaagcaatcctcccacctcagcctcccaagtagctgagactacaggcataagccaccacacctagccagaaaaactctttctttctttctttctttttttttgagatggagtcttgctctgtcacccaggctggagtgcagtggctcgatcttggctcactgcaatctctgcctctcaggttcaagcaattctcctgcctcagcctcccaagtagctgggattacaggcatgcgccatcacgcccaactaatttttgtatttttagtagagatggggtttcaccatgttggccaggctggcctcgaactcctgacctcaggtgatctaccagccttggcctcccaaagtgctgggattacaggcgtgagccaccgcacccgtgccagaaaagcttttttcttaatagctcccctgggaacctcagttctaccaccgaaggtatacaatcactccaacagataacaaatcgacattgtcgtgcataaatgtagagctgatccgtatttcatgtcaaaggcctggactgtgtgaaattggctggtatttgttccagaagcacttgttcatgttgaagatggggcagttctgagtgggttagcaggctgacgagcttggctcagaagccgctcactattgtttgggctttgcttttgacttcacatcctgaaataaatggtcgttgcagaccaggcacgtgagcaggaagtgggcagggcttaaaacacagagaagtcataacctctgcggtttggttcatgttgtaatatgaaaaccaggaagcttatcttgcaggaggctgatgtgtaaaagttcagaatggagtggagccctccctcttggcaccctatgcgcggagtcaccctttgtctgccacaggaagcacccaggtcctggcagctagaaaactgtaacaacttggaaacatttcccaaaatgtcatcatggcatcaaaatgagacaatcaatttcttgcaaaattgtttgcaagaatacaatttgatcaaaagtagagttagacttttttttttttaagacagtttcgatcttgttacctaggctagagtgcaatggtgatctctgcttactgcaacctctgcctgccaggttcaagcgattctctgcctcagcctcctgaatagctgggactacaggtgtgcgccaccatgcccagctaatttttgtatttttagtagagacggggtttcaccatgttggccaggctggtctgaaactcctgacctcagatgacctgcctgcctcggcctcccaaagtgctggattgtaagcgtgagccactacgcccagccgagttagactttctctaagaacagcccctctgtgtgttttaacttaagtgagaaacaacatgggtgagtcagtggttgaaggcaagagagacacgggagagacactgatgccctgtccatcccttctctgggcctcagggcattccagcaggtagagaactccaccctcctgcctgcctatcagtctgcttggtcttgaaagtctgctgcacagagtgggtagtggccatctgaatcagtgctaacacaaaagctagacagcaatgcttacaggctagccaggaaaatgtttttaccagaaaattgcttgagaagagaacacagagtttcagtagggacatgacgattgaggatggaaatgcttggtgaagcagaacatcctggcgtagccacaagaaaacacaataaccttaaggcagtcactcgaaggcatcctggagccccaggcagggagcatttcacttcaccaaggcgtctggggccatcaagtgggagaaaaaactgaagcctaaagctcctgctactgctctctgagctcccagatccctgtacctgacacctgccacacctggctcggcaggtaactaagactggaagaaccagatgaggagtggctctgccacacttatttgagaaaatgtctgagtagtatctgtccagctaggtcttcctgagtttcccatggctcttaaagattagacatcattaactgagtttcccagcagcacacctgcctgaggtagattacagtgtggactattccctgtgagaagcttcctgcagcatagcgccagggaagggctaaccaagatcgtgtctttgcaaaacacctttcagactgcagcacccccagggtgaacttcagagtcactttgatctcaattagcattcttggatattataaacaaacacctagactcccagggaggggaaaatcagtaccccaggaaaatcacaggagatggagttctcagggctttatcacaggctggccatcgaaagccacagggagccctcaggctagccagggtcacatctcacctctgcccagccaccccaggtgtttcctagaagcccccccttttcccgctttggcctgcctggctctttttggcttctgaaaacaaagagaggagctgtgtgcagtcagcctgagacacgtgggaagatggttgctgcccctgctggccctaaagctccagaaagccaatgccaccgtgcaggcggtggagagcatattctgatatgggaggaggaggcgtccgcagacccctagttcctaactttgggtcatggccaagggacctcctggggaaaactgcgtgctagagagccggtgagcatatcttaagttaggcccaaaggggactgggtgggtttcttcctccagcacccctgctcttcccaagaggagcccctttccttccctgagcttccccttcccaggctcctgttttgacaggatgcctgggtctgatcacagccacaggcccgttttgggctgtgttccccctggagtgtattggccaaggaattcctggagcatttgaagaaaggccccttcccaggggcagtattcctcctgtaattaaaaggttgcatttcaaagacacttttaatgaccccaaccgttgttgccagaaagaaaatgctacagaagacgtgactgacagattgcagggagagtgttcagcccagtgctggtgcagatccccgtgaggacacaggagcagggggttttgtcatcttgaggacccatagctgaccgatgttcatgcacgcaggagcatgtgtaccaggcaccggtctagtgggagagtcagaggaggttgcagcgggcacagagtgggcatgctgtgatggaggccaggcgcctgcaggggaggacatccttatctatgggacctggcaggtagaggggaaggcactccctagggaagggccagaacagaccttagaagggtgtatacttgggatttagatgaaggagaaacctcctttcctctcacttccctctctccttgttcttccctccccgagggcccctcctaacccactccactgcacagcctgcagcttggccagagttccttccctaccaggactcactgtctcgctggggccttgaaccctctccccccaccaaataaggtgctggtctggagctgagcacacaccacagtggccagttatggtcagtctgtcactctgttccttctcatccgagaactcagaaagcattcactgtcactgggctgcgatcccagaacagccgctattcaaaacatctttataaggtctgattctgcctctgcctcaccccagcccagcagaagtcgacttggctctggaaacatgatggatttttattcagtgttttattggccaaacacatatcttcgggataagatcttcggaaactcacagggtttgatggaaatgctcacagccttcttccacacacatctctgtcatcgctggcttctggacttttcgttactttagcctgggataatattcatccttcacttcatctgaccgagacacaaggaaagtttatacctcaaactatgcacgaagcagaggaagctcagtttcagggatctttgtgaggttgtcctggataagggtcccgtgagtctctcagaaatttgtcctcccagagtcaattcaacctggggacttgtcatagctctgtggcctcaaaagcctctcattcccaggcactgtgacgggaacactgggctattgtgtgacagggctagctagcgtgtgcacagctctcggctgggatcagagagaagtttgcaggcagacccaaggttttagaatcacagaaatcttcacatctcttcccttcccaggaccctccatcgtggcttctggctgagattttaggagaaggatgctcagtccagttggttttcaggttgtgtccactctggtgagaaaagagtccggcttggtgggggtgggcaaaagttaaccctctcagggtctgaactttggggtggcctctgggtttcagcgcctccctctcattgagtcccaggctgctgacccccctgtctggatgtcctcatggtgcctggggcatcctgccttgggtacccactatttctgcaccccaagggcaaattctgtgtcttacttggtgacccaggcgccaccttcagagtaggaattctataaagactcccataaagctgaatgagggaaggacccagcaaagggtggaaagctgagattgaggagctgtgcttggggaaaaccccacataactgtgttcttttcagcctctctatttgcttggatctcagcttaacacaattttgggtttcttttttttgttttgttttgtttttctgagacggagtcttgctctgtcgcccaggctgaaggtcagtggcgccatctcagctcactgcaacctccgccttccaagttcaagtgattctcctgcctcagcctcccaagtagttgggactacagacgtgtgccaccacaactagctaatttttgtatttttaggagagatggggtttcgccgtgttggtcaggctggtctcgaactcctgatctcaagtgatccacccacctcggcctcctaaagtgctgggattacaggcatgagccattgcacccagccacaatttgttattgaaaaaaaaaaaattcccactcttcactacctcaattcaatcatagggccacctgtatcctctatgccacctcctaggctgggcattcacccgtcgagcttacaggatgagtcagaacccatccttgctctcccggagcctgaactctagagtgggttgggaacaaggaaaggcaggcgccgactgccaactatacgggtgcatatctcagcgcggtcacacccttcttgcccagacctgcctctgctctgtcctcctggcccctgaggagcacctggggcagaggaggagcccctaggaaccttccatgatagagcacaggagtctgcaagcggttgatttggtctcctctacccggcccctccctctctctggaccctgcaatgtcgaggtagagagtgttattcccattttacagatgaggacaatcagattcaaataggtcaggtgacatgcccacagtcgcacagtgggaagatggcagagccaggtctctgccgcctggaagggaagcctgtgctctgctcattggagagcactgcctccctcgaccactgccaagctttgatggcaaaggagcaacagaggtcacgtgtcagggattagcaagcaagggtgacaggaggaggtggcattccagaagggccttggagtatgggcaggattttagaagacagtagaaaagatgggaaggttgacgtggcaggggacacagagagagccaagttggggaggcaggatggtgcaggccatgccccgcagcagctgatgatccaggttacccaggggcagcccctatgcctcacacctccagaccccctccaaggcagaacaagctcctgacacatttctcatgattctccagaattccagggggcgtcttttccagttatctagggctatgacattgtaccacactgtgagataaataaaatatgtataagcatcagccactgtttcttcttctttttttttttttttttttttttgagacagagtctcgctctgttgcccaggctggagtgcaattgcgcgatcacagctcattgcaacctccacctcccaggttcaagcagtcctcctgcctcagcctcccgagtagctgggactacaggcgagcaccaccacacccggctaatttttttgtatttttagtaaagatggggtttcaccatgttggccaggctggtcttgaactcctgacttcaagtgatctgccggcctcggcctcccaaagggttgggattacaggcgtgagccaccacacccggctgcaactgtttcttctgatgaatgcagctgtgccagtttccaggcagcctgtgcgaagctctgccagctcatcgtcctgctgtcgcagccctggggcttcctgtcaaggggaaggtcacagtggcccgtgtaaaccctcactctgcttacacagttgtgagcaggggcactctctgaactgcaatgtatataacaataagtaaactgcaaagagaaaagggaaaaaaggaaattgttttcctggcacataaccaaaaagtctagggacagatctggtgcttccggctcaacttgaccaagggactcatatgatatcactggagccacagtctcctagcccttgcctccacttctgctggaagcttggtttcattgtcaggccgcagcagctcgaggacacagccaaaccatatcaccatcttttaccaaggtgcacacagcccttcagaatcctcctccccttcactggcctcctcctctgaccctcttccttctgctcactcagctctagccacagtggcctccgtgctgttggattccacctcagggcctttgcacatgctgccctcatgactggaacacttccccaacactcctgaggctctctccctctcttcttcaggtcttgcctttgcagtgaggcctttcctcaccactctgctgaaaactgcaacccattacctgacccagtccctttccttccctgcagagcactttccaccacacacatatgtcactccttgtacacccatcagtctgtctgggctagaagaatagctcctgcgggacaggggtttgtgtctgttttgttcgcagctgcattcccagtcctagagcaatgcttgtggggcctagcaggtgctcgctaagtgctcatggattggctgagagctgagttgactccataggctatgccacagagtggccctgggcagcttgctgtccttccttcacacggacagaggcagttgtggtttggtaagataccctctgaacagctaatgtgggtaaagaagcatctccctgtgggcaatggtagccatctgcaggcccctgtggttcagctccctgctatggagggctgagtcattgacgtggtggccttttagagacacaccttgcgagactcctttgttaggacagaacagtatctcctggaatctttatttaaattaaaaaaataaaagtttctaagaaccaggccttcagaaaacttcagactgcccttcactttgtccccacttgtcagagatggtttggaaagaagacaaaaaaagacactgggaaaggaaacagggtcaggctacgggggcagcgcgggagcctgcctggattcctgcgtgtcagcgccatagcgccttctgagagtggcacccagctgggttagggacactcggtccagccattctggggtccaagagcagcagcgccccctaaagcagcctgggagtgggtgcttcccagtgccaagcgggctgcaagtatctgcccgctgcccacgcccgcgcccaccccgcttcagggtgctctccccaaatcttggcactatttacctgtgctgggctccgttcggcagtagtgcagaggcccctctcctggggaactcgtgcaccacaagaattggcgcttgcaggggccagcagcgggggcggtgaagcagcaacaaaaaaccccagtctctgtcctggggcctcaccgtctggtgggaaaggcagtggtgtagatatggctaagggctgtggtgggtgaggagggcacaggacatgaaaattatggcgccttctcccgaccagctcgggggccacgggcagacaggtcaccctcaggaccccaactgcccttccagccccaggacacattctgggtgaggccttgatttccttaattaatacatagaacatgcttcttacacccatgttcatagcagaattattcacaatagccaaaagggggaagccacccatgtgtccctcagtgggtgaatggatgaacaaaacgttgtatttacatacaatggaatatcactcagccattaaaggaagaccatgcccccacctgccacaacatgcacaaactttgagagcataattaagtaaaagaaaccagacacaaaagacaaatactgtagaattccacttaaacgaggttcctagactggtcaaaatcatcaagacagaaagtaaaatgggagttaccagggcttgggggaagggaatggggcgttactatttaacagatacagagtttctgtttgtgaagatgaaaacgttctggagctggacgcggtggctcacgcctgtaatcccagcactttgggaggccgaggcgggcagatcatgaggtcagaagatggagaccatcctggctaacacagtgaaaccccatctctactaaaaatacaaaaaaatagccgggcatggcggcgggcgcctgtagtcccagctactcgggaggctgaggcaggagaatcgcttgaacccaggaggtggagcttgtagtgagtggagatcacgccactcactccagcctgggtgacagaataagactccatctcaaaaaaaaaaaaaagaaagagaaaaagaaaacattctggagagggatggtggtgatggttacacaacagtgtgaatgtacttaatgccgctgaactgtacacttaaaaattgttaaagtaataaattttgtgtatatttaccacaataaaaatgaaaaaaactcatttcaggtgcttaggaaaatatgtgtttgggtgcatcttatctgcagaataatccactgggctggacacttctagatattcatttggaggaaggggcatagcatcatgatcaagagcatcagttttggagactgtattaatctgttctcatgctgctaacaaagacatacctgagactggataatttataaaggaaagaggtttaattgactcacagttccacatggctggggaggcctcacaatcatggcggaaggtgaatgaggagcaaagtcacgtcttacatggtggcaggcaagagagatcttgtgtaggggaactcccatttataaaaccatcagatctcatgagccttgttcactaccatgagaacagtatgggggaaattgcccctatgattcaattatctccacctggccctgcccttgacaggaggggattattacaattcaaggtgagatttgggtggggacacagccaaaccatatcagagacatatttcctggattgagaatcccagattctcatctggcagcagtgcaactttgggcaagtgagtgcttctagctgccacagtgtcttcatccataaaatgagaataatgatagcaccttcatgaatatgacttgttagaggtaaataggaataatgcattaagcactgggcatggcttctgacatgtagcaaatctcacaacaaatgttaatgctcactaactattacatattatgcacaaaagaacacagcactctacaggaagagcagttactaaaacctgcactcttgaaaatgtgcctcacagtctaacatttggattaaacagaacacccatcagaagttggcaatgctccatcacacacagtcgtgtttatttgttataacaggtgccaggatcagtagctaaatttggtagcagttgatgctgcatcattagttgattcaacatatatttactgagaacctgtgctgggtatgagaacacagatgcaacaagacagagcacccctgccctccgggaatgtgtgtcctcgtgggagaaaacagagatcaaacaaaaagtgaacaactcctcacctctctccactagtgagtaataagcaaacaaggttgcatcacaaaaatatccacaaacgggagagaatgtgacaagaacacagctaaaacataaagatggtcattcctggaagagaatgtggctcaagtcagcttagcacagatacccttagcagccatcctgaggttggctgggcagggcactctcatagccacaaaagccttctcagtggaggctcactctggtcattcagatctgagctgaaatgtcatctcctaagagatcttccctcggcacctgatctgaagtagacctcctggtactctctggacattatcgttgttttctgcaattaacattggtatctgatgtttgcttgtttattactggccttttctccactagagtgaaaactctacagagagaggacttagcatctcttaggagctcaggatgcctgaatcatgagctccaggaatctgcatttaataaatgcccgcagagattcagaaaggcacttgcgttcaggctccactgccttcaaagaccagtctgtcaactgcctgacatttctccacttgtgattcacacactggtgactcagccacccattcgaccagggtgatagagaagtcagagaaacgccagaactgttgttcaacacaggctggctgctcctgtcacctctcccacgccacccaccccttatgtctagtctcagaaaaccagaaccagggtgacaattgcccccagagtccacagtgaatcagaagagctctttaaacaaaagaatcactcagaacgattgttaattttgagtgttgttctaaaacacaagaaaggggagacgtgtgtttccccattaaagctaatcaatccatttgtagatggatgatgacagggaaagggaggaggagttaaagtatgttaaaagggtcaggagcagtggctcacacctgtaatcccagcaatttgggaggctgagatgggagaatggcttaagcccaggagttcaagaccagcctaggtaacatagtgagacctcatatgtacgaaaaaatagaaaaataaaaattagtacatctatagtcctagctactcagaaggctgaggtgggaggatcacttgagcctggaaggttgaggctgcagtgagccatggtcacaccagtgcactccagcctaggtgacagagcaagactctatccaaaaaaaaaaaaaataaataaagcatcttaaaaggaattgcccattcatgtagatgttcaagggacgcaggatagccagaacaatcctgaaaaagaacgaagttggaggactcacactttctgatttcaaaccttactgcaaagctgcagtaatcaagactgtgtgatcctagcattagaatagagatataggccgggcgtggtggctcacgcctgtaatcccagcactttgggaggccgaggcgggtggatcacgaggtcagcagatcgcgaccatcgtggctaacacgatgaaacccggtctctactaaaaatacaaaaaattagccaggcgaagtagcgggtgcctgtagtcccagctactccggaggctgaggcaggagaatggcgtgaaccccggggggcggagcctgcagtgagccgagatcgcgccactgcactccaacctgggcaacagcaagactccgtctcaaaaaaaaaaaaaaaagaatagagatatatagataaatggaatggaattgagagttcagaagcacattctcacatttacagccaattaattcttgacaaggatgccaagacaattttcaataaatggggctgggacaacttagacatccacgcataaaagaatgaagttagaacactgcctcacctcatacacaaaaattaacttaaaatggatcaaagacttaaatataagaagtaaaattatacacttctgtgatggttaatattgagtgtcaacttgattggattaaaggatgcaaagtattgatcctgggtgtgtctgtgagggtgctgccaaaggagattaacatttgagtcagtgggctgggaaaggcagacccaccctcaatctgagtgcgcaccatctagtcagctgccagtgtggctaggatacaaagcgggcagaaaaacgtgaaaagactagacaggcctagcctcccagcctacatctttctcccatgctggatgcttcctgccctcgaacattggactccaagttcttcagttttgggacttggaccagctctccttgctcctcagcttgcagatggcctattgtgggaccttatgatcatgtgagttaatgcttaataagctcctatagatatagatatatatatatatatctcctattagttctgtccctgtagagaactccgactaatacaacttctttgcagaaaatatagtcatgctttttttactgatacataataattgtacatatttatggggtacatgtgatattttgacacatgcctacaatgtgtaatgatcaaatcagagtaactggaatatccatcacctcaaaggttcatcgattctttgtgttgggaacttttcacatatccctgtctattttgaaatgtataataaattattaactatagtcaccctgctgtgctatcgaacactagaacgtattccttctgtctaactgtatgtttgtacccagcagctcaacctctcttcatcccacccgtttctcagcctctggtaactatcattctactctctacctgcacgagacatgagatcaacttctttagctcccacatatgactgagaggacatttgtagttctgtgtctggtttatttcactaacacaatgatctctaggtccctccatgttgctgcaaataacagaattttattctttttatggctaatactccattgtgtatatatataccacagtttttaattcattcatctgttgatggactttcagcttgattccgtatcttggctattgtgaatagacaagggtggtgcaggtattcctttaatatattgatttccttttctttgaataaatacccagtggtgggattgctggattgtacggtaattctatttttagttgttaagaaactcccatactgttttccacaatggctaaactaatttatttccccaccaatagcatctaagagttctcttttctcaacattatagacgtaaattttgacatcaaggtaggcaatggtttttaaaacatgacaccaaaagtacaagcaaccaaaggaaaaacatggataaattgggcttcgttcaaattaaaaactttggtgttttaaaagacactattaagccagtgaaaaaacaacccacagaatggagaaaagttttgtaaatcatacgcctaagagacttgtctctagcatatatgaagaactctcacaaaccaataataaaaatataaatattctggctgggcgtggtggctcacgcctgtaatcccagcactttgggaggcagaggcgggcggatcacgaggtcaggagatcgagaccatcctggctaacacagtgaaaccccgtctctactaaaaatacaaaaaattagccaggcgtggtggcgggcgcctgtagtcccagctattcgggaggctgaggcaggagaacggcgtgaacccaggaggcggagcttgcagtgagcctaggttgcgccactgtactccagcctgggcaacaaagcgagactccgtctcaaaaataataataataaaaataaataaatattctaatttaaaacgggcaagggatctgaatagacgtttcttaaggaagatacacaaatggtcaatgagtacatgaaaagctgctgaacaccgttagccatcaggcaaatgcaaatcaaaaccatgagataccacttcacaggcattaggatggccacagtaaaaaagacagatagtaatgagtgtgggtgaggacgtggagaaagtgcaaccctcacactttacagggaagattgtgaaatagcacagccactttggaaaacagcttgccagttcctccaaaagtgacatagagttaccatatgactaatatgactgctaggtatatagagcaacaaaaacatatgtccacacagaaacctgtataggaatttcatagcagcattttgtatggactgtgtaatagtcaagaaatgaaaacaacccatgtattattcagttgagcagctggtgaatggatacacaaaatgtggcctagtatatccacacaatggaatgttatctgaccgtaagaaggaatgctacttgttacaaggatgagccttgaaatatgctaagtaaaagaagctagccacaaaagaccgcatagtatagggttcccttaatatgaaacgtccagaataggcaaatctatagaggcagacagtagattagtggctgcctaggggtgggagagggtcaggaggcaggaatgaggagtgagtggtaatgcacacagggtttctttttggagtgatgaaaatttgctacaaaatcagttgtaaggctgggcatggtggctcacacctgtaatcccagcactttgggaggtcgaggtgggcggatcacaaggtcaagagattgagaccatcctgaccaacatggtgaaaccccatctctactaaaaatacaaaaattagctgggcatggtggtgggtgcctgtagtcccagctactccggaggctgaggcaggagaatggcatgaacctgggaggcggagcgtgcagtgagccgagatcgcgccactgcaccccaggctgggcaacagagcaagactctgtctcaaaaaaaaaaaaaaaaaagaaaaataatcggttgtggaggtggtcacataacccaatgaatgtgctaaaagccattgaattctacattttaaatgatcgacttgtatgatatgtgaattatatctcaaaaaggtttttgttgttgttgttaaaaaggaattattcaccaagatgggagtagggagaccatgcaggaagaaagaccaataaggaggtgactgcagctgctgagggtgggaatggggaaggtcggagccaccactgtggcagtgaatgggacctggatctggagatgaggtggagcccacaagactgagtcactggctgagtgagtgagtgtgtgtgtgtgtgtgtgtgtgtgtgtgtgtgtgttgggggaaggggattaataacagctcatttttactgagcgctatctgtatggccacttctaatggaatatctcattgtttcctcactagaagtctataagaggagcgctgatgctatctgggaaactaaggcacagagaggctcaggaacttgctaggatcacacaggaggtggtagagccaggatttgagtctggtggttgactccaaagcctgcattcctctgaccccagggcttctgggctgggtgtttaggaggtgacattactctccgagtagaggatactgaaggagggacagggatgtgggggaaaggggaccagttcagtttgggacacaatggagttgagatgcctctggatgtccagtcacaattcctacaatgagttatatgaatcaggaactttacagagaggaagcctagaaacaacagatttccgaggcctgggcacatgtctgttctcctcgggagtggacaagctcaggtacaagggtctgtttgggagagaagaggctcaaggatgaggacctaaggtccttgctactgaagaagggagcccgaggacaggacccagccacggaggcggagagcagtcccggggtaaaggcaaggcgggtgggagccccggagctgagcatggccaagcgaaaggtgcaggacctcagcgatccgtagggtgaggactgacaggatccactctgtttagccacagagctgaacaggcacagtcagattatcccagggggaggaacgaatgagggtgaagaagaggtgacagggaggccgatctggattttcccacggaaggaaatcctttttcaggcccctggtggcaaaaggaggagcagagggagcatctccaagagtcctcggcagctgcctctggtaccgcccaccccaccccgggcctctgttggtgtctgtggtctgggggctcccggggccatcctccctgcagcctagggtgcagacagccaccacctgccacccagatcagcagtcatgtaagggcttctgttgaactggtttaggagcataactatagttggctgaggtctggggattttttttaagctacagagtattttatggggttttgccaaaggttgcattctgctcagaaacctagcctgtcccaactattctttcttgccatgcttcaggaaaatctaatctaccgtaaaagcagcaaccacagctatgagagctaagccaggtgccacctcgggttaaggtccctcagctgccttaacccctgcaagctcctctcctttgcagccacctcctgacacctcatatgacactgcccaccccacagggcctttgcccatcatttcctctagataaacaattactgaatgaatgaatcatccaccagccagctccccctgccaagagcaaggaagcatcaaggcccctcccctctgtcacccacacctctcactgttaccccaacaagggtgccacccaaggtttctagttcgagaaaaaaacttcccagactcgcattgctaatcacacctactgagtataagtaaaagcaagtgtggctctccccgaccagcgggggatggtggggaaggggtctttcctgcacagctggcagataggcacccctggctgctgtcttgcctgggctgtggaggtaatttcatttctcctgcagcctcttctctccgtgtccagctgtccttgcctgtttgatgcaggacagcacagggagcttgctgctcctgcctggagctagctggaaggatgaggtggctttggaaggatttggaggacctactccccacttcatcctcatccacggttcctctccatccaggtttgctgatgtttaccagagtctggagggcaggcaaggggcagagcggcagctggccaaggcccagaggggttgcaaggtcacatagaggaccttgggcttcactgcacagcttcaaacatattaaaaccctgaaggtccgaagatatatgaaacaatcccctaaaaatgaaactgcccaggggagccctctttgtagctcacctgcccctgccgcctttctcgtatttcttgaggctgtgtgctctgctctctgggaccagatggcccgttggagacttctggcaaacgccccagctcctctgcccagacgatgccgcaacctccactccctgcctgcccacggccaggccaggttgcagtgtctcgagcctgctgggctctcagaccaggctagaagagtccaccgggtaaattgttttgtcccaaagccagagatgtcaggaggagtctgtgccccctctgccccgccccatcgcctgaaggagcagcacagcttcgttttataaaaccaggatacagaacggcctggccccaagccaccctggacccagcagaccagtcctgcccctgtcccctcagcccctttgtcaggactggtgagggccagggagggggctggcaactcttcaggagcagccagggagcacagctgctgggatgtgggggtctagtcacctaaagcatgacagaatatctggtgacttggggacctacctacttgtcgggagcagcagctcaagggcaagagaaggtgttgagggaaggagggtcaaggtggctggggctggaaagtctggatgactggccatggggccacatcactcatctcccaggacctccttcaacatccagacaacaggagcactgcccctaccctgccaccccatggcctgcctcagggggcctggagcccggggccacctccctcttttgaccctgcctgcgcagcttgccttccccgctctctccaacccacagccgctgctgtcccagggcccatggtggtgggaacagcctctcccatatccccctcacgcaataaaagcccatttacctgcagaccagctcaatccagctccagattcccagggaagaaactgaacagcccaccctggctgggctcatgctcatctgggtggagggtctcattgaacctggagcagtgacacagaccagtgagggagggtctcactgggcaacggtggaggactgctctggctaaggggtttgctgtggactagaaagatgctcccaaaatgtgttcacctcagatgctgcgaccatccctataagctttataaaatgaacccgggaagtagggaggggggaaggaaaataaacccagctggcagcacatccagcgtttggcacgaggccagcccgctcccagacccgcttcctcagaggtgtttgcctattgccctaaaatcacgtagaccccgtgacaagattaaggttccccgtcactgttctatagataacaacttgaacactataaaatggtaagttttccatttgagatattcttttaggtccttgcacaccagtgacactactgatgtcagctggtctcaaggaccccacgggaacagactcacaaagaatggagtttccacctcctggtggcttcattcccctcactccaaccaatcaaagaccccagtctcccaacccctcaccctccatgatccccttaaaaatcccagcccagaactcctcagggagatgaatttcagggcttcctcccatctcctggcttggtgccctgctattatttccctgctgtctcgatgtaattggcctgttactgcacagcgggcgtgcaaacctgtcagtcctagagcaatgccatcttacagagggggatttcaggaggaagcacaggcgtggggagaaaagcagtgagtctgaacagcccctgccgcgtggagtgtctggtgggatcatgctctgcagaggcccagctggaggcgtggatctgggagccatcagtaaccaggtggggagtgaggtcatgggggtgcaggtcaccccgaggaagagagatgaaggggctgaagaagaggcagaaagaagcatcagcagctgagaacacagtggaagggggtggagcaggagcagtcagggaggcgggaggaaaacaggcaaaacagcctcccaaggaagaggagggaggggaggggagaggtgcacagggcctggtgctgctcagaggccaagcaggataaagcctgtgaggggacagggctgaaggagcagttcttggcaaggcccctgagaggggtgggctgaatctgtagaagcaagtgggagattttcaggtggagaatcaggcagccaggtctgcaggatgagaacacatcctgtgcaaagaccccaaggaagcagaaggcctctgggcaacttccagggacaaggagttggcacagggtgtggcggtggggagtggtagtgggtgtggcaggtgagacactgaagaggtaaaaaagaaccacacccaaaatgctcactgcactgctgagctgagcacaccttattctgtagactggaactgcagccccagggccaaatctgacctgacacctgtttttgtgaataaagttttattggaacacagccctgcctgttcatttgcatactgcctgtggctcttttcaccccatgatgaccttatggcctgaaaacatttataagtggccctttaaagagaaggtttgcccacccctgctgcagacaacgtttcaccactgagccactctgagaggtgaacgagaagatcagacctcactggctgcagtggaggcagtgctggagggcaggaggctggaggcagggggccagggacccggcattgctgtcatcctgacgacagctgatgccaacctgaattcagccagtcaggattgagggcacttcacgttccagggagagcaaataaaatcctttggttaggccaggtgtggtggctcatgcctgtaatcccagcactttgggaggccgaggcgggcagattacctgaggtcagaagttcgagaccagcctggccaacatggtgaaaccctgtctctactaaaaatacaaaaattagccaggcatggtggcagacacctgtaattccagctactcaggaggctgaggcaggagaatagcttgaacctggggggcggaggttatagtaagccaagatcacgccattccacttcagcctaggcaacaagagcaagactctgtctcaataaataaataaactttggttagcgctggctacctgaagtactgggttgagaaaaaccccgagcatgcagcttggctcagcaacagttcactgcatcattaacgtcacatggaaaagggaccgggagcgggtagcacaagaccacgaaatttttccccaatttaaaatatctatttccgttttgttgaaaactaaagcttggccactgggatttctcctctgctgaaagatactttaaaaattcatcttgggatttgctcacgtctgaaatctctagaatcccctggagactcttaatggcaggacctgggaggcttgtctgggcttatacacagacaaagcctctgcctgcaagtcagtcctgcattccaaagaaggaaatgaggggcgctggggtctgacctcacacaagggctgcagggttcagctgcagagggaggctgggcttctgaggccacttgcactgcagactccaggagccagggctgggctttgactggcagagtccgagcagaggaagcttgccggacaccaggagagctgccacccggacagagctggccagaggcctgtgcatgggccacaaggaaagaaggcacagcctaacgtaacctggcaagcacctgtgtagcctctgtaagtgcttacccagagaagcaggagcacggcgatctgggtgtttggtgacacttccatctgagagcagggcccaggtggaagaggcagctggatgcaggttagtggggccggttccacggacatttggggctgggtgggacaggaagtgggatctgaaaaaacagtgtgaccatgtgcagttagccagggctagggaaggaaatacaaagccttttacaaagtttttttctgggtaagcaaaatgggcacagcagggtgctcctgtcccattgacagcctggtgacgcaggcagggctacgggctggggcctgaggctatgaaccacgtaggactccagcatcagatgtcttttcctgatccacagtgccatgagacgtctttggttgagcacctgccagatggctatgaaatgagctgtctgtgcacaagaaacgaggtgagaggaatgcgccttcccccaacctggaaggacagacaggactttgtgctcctccaccaggctcccagagtaggaaggaaggatgggcttgggagctgattctctgtgcttcaggggctgcccaggcaagaaggaaccaactcccacagccagaccagagaggaatcacttgagttgcccgaggcccagcaggaagggggccttgggcttggggtcctccgataggaaacgcctgcctcctgcgcaggcagccagactgcccacagcccgtggcgtgggccctggaagagccacagagctcccccatctcaagagccctgaaggggtccctgggcacagtctggccacccaggaggaccccatggggacatctctgagcccctggacgggggggacactgttcagggaacagaggagccgcagtgagtgcccaggattaagccaaggccgacgcagtgctcctgttcccccaaaagcctcgggactcccacatgagcccatgcgttaccggaaaggggtccggatccacaccctaagagaggattctaggatctcgcgcaagaaagaattcagggtgagtccgcagagtaaagtgaaagcaagtttattaaggaagtgaaggggccgggcgcggtggctcacgcctggaatcccagcaccttgggaggctgaagcgggtggatcacctgaggtcaggagttcgagaccagcttgcccaacatggtgaaaccccatctctaccaaaaatacaaaaaattagccaggcatggtgatgggcacctgtaatcccagctactcaggaggctgaggcaggagaatcgcttaaacccaggaggaggaggttgcagtgagccgagatcgcaccactgcactccagcctgggcaacaagagcgaaactctatcaaaaaaaaaaaaaaaaaagaaagaaagaaaaaagaaaggaaggaagaaaagaatggctaccccacagacagggcagccctgagggctgctggttgcccacttttatggttatttcttgatgatatgctaaaccaggggtggattattcgtgcctcccctttttagaccatatagggtaacttcctgacattgctatggcatttgtaaactgtcacggtgctggtgggagtgtagcagtgaggatgaccagcggtcactctcatggccatcttggttttggtgggttttggccagtttctttactgcaacctgttttatcagcaaggtctttatgacctgtatcttgtgccgacctcctatctcatcctgtgacttccttaaccatctaggaatgcagcccagtaggtctcagcctcattttccccagcccctatacaagatggagttgctctggttcacacgcctctgacacatgcagtgaggacccctccccgcccaggaacccagtggatgattcctctcaggaggtgcggctgggaattaatttaatttaatctagagaaatgatgtttgtttcatgttcaaatgttctggagaggttacaccagtgacagaggccctctgaacttacacacacaaaaggcaactcattagcaggaagatgagaaagcagaaagcgtctcaagacaggaagctcggcttggtgtcacccaaatgtgtctccccttgacaaatcatctcccatgatctgccggtccccggggaggacaggcaagaggcggtgatgggctgtcaatgtgcatctcggcgtgtggcagttgacagggcaccttcataggtttcttctctgcaacttcactgccaccccctcagaaactgagacccatcggcggccggcctgaggcacccacagctgcagagagccgggcacatccagggccttgggtgtgtctctcctccactgtggtggaggctcccctccactgtgccaagcccaggggggctggcagtccccgtgggtgtggcccagaaagactggcagtgtctgtcccagacctcagggccacagtcaccagataagcacccactgcactcaaggcctctctgatcaagtcccacgaccaggctctccaagtcctgacaccgcggagacccccaaaagaggaggatggagcagagggcaaggctctcagctccgcggactcacacccagctgcagaggcagggggagccgccctttctgtggccggggaaattgaggtcacttcctgtctcgcttccctctctctgtgctggctgcatccttcagaaggggggtgggtggctgcagggcagcgccaggcaaggctgcggagaagccggtgctccctgtgtctaggatgaagaacagagcagggggctcctcggcggtgtcgcttcacctctcttcctgctccttgattctctccacccccaccaccagcccaggtggaggctctcggtgatgaaggtgctggcagtgaggggcctgcagagtccgcatctctctgcagctcaaggggctctcggaggccactgggagctggagagggaggaggtcagaggcctacaattggttttcctgcttggagaaagaacagataggagctttctagggctgcggctccataaatagctctaactgtcccttctctctcttttatgttctttcaaacatgaagaaagaaacaagctctagcaaggaactcaagttagaccggcaagtatttgccaaaggttaaggggccagaaagccagaaggtggacacaaccttagggaccctgggccatgagccgtgagacctctaggatcagcagggcccaacagggccatgcaggaagccctagcttcaaagccacaggcactggggagtgggtgggggctccccaaaaaccacacgctgctccccaaactccttttagaagtgccccggaagacctggacctggctgtgcacaaaagcaccatgctctcctctgaccagatcccttggatgaggtccttaaagaccccctggagctcagtttcctcatcagtaactggagaggtttgcaccaggtggtccttgaggggctccccccagctctgagcccacgatggtgcatttcataccctggactgtgtctgaaaacttgagaaggagtagggaataggatagatgcgaactgagcttcttgatggggtcccgtacctaccccatatttactgcactagaagcagggcctggaatccacacttcaacaagctcacactaaaatgggagaccgtgccacgctggcctttctggggctcctcagccacgtttttgcacctgctgttctctctgtctccattatttcccctagatctgcactgctgtgtccctgatttcactcagatcactgcccaatgtcctcttcagagaggtctttcctaactgcctcctctaacaggtaaacaagtaattttttaatgtaggtatgtcccatgcaatgtttggaaaataccgatactaaaacattatttgtaattgatctgaaattgaaatgtaactggacatctggtattattatttgctaaatccagcaaccctaagcaacaaggactctgcaacccagcccccagactataggccatttgtgagcttgagtctccaggggcggcagacagggctgcagctgctacgcctgcccagcccttcccctctgctcccctcccagaaagatgcataaatgcccggggtggcctaggcaattaaggcgaattgtcttctgggcagtcctgcatacctgcagaggactgtaactacagaggtgtgcacaggagtttctgggccaagaacaagacctcagggctttctcctcccattctcccctccccacctcctaccccacatgtttaaggtgccttgagtccccagatgatcacacactctagccagctatacatatcggtacacactacaatcaggcaactgctgcatgtgagagcccctgccataggtaacaggcaccatggtccagacatataaatagaaggtgaagctcctgccagtaagcatggcaacctggaattggggtgtgttataggttaaatggtgtgtcccctcaaacttcatatgctgaagtcctaacccccaggacctcaaaatataaccctattgggagatagggtctttacaaaggtaaatcaagagggcatgaggtcattagagtgggccctaatccaatatgactggtgttctttacagaaagtaacctggggccaggcatggtggctcacgcctgtaatcccggcactttgggaggccaaggcaggtggatcacctgaggtcaggagttcaagaccagtctgaccaatatggcgaaaccccgtctccactaaatacaaaaaattcacctggcgtggtggtgtgcacctgtaatcccagctactcgggaggctgaggcaggagaatcgcttgaacccgggaggtggaggttgcagtgagctgagattgtgccactgcactccagcctgggcaacagagcgagactccatcccaaataaaaaagagaaaaaagaaagaaacttggacacaaacgcatgccattggaagaccgtgggaagacacgggcagaaggtggccatctccatgccagacagggacctcagaaggaggccatcctgccaacgccttggtcttggactccagcatccagaacttcgagatgataagtgggggttgttgaagctgcccagtctggggaactttgtgacagctgccccagaaatctgatccactgcacctggcctcagagttcaggctggctccactctctctctcccgacacctcccatcaggtggggacctgcagcccattcccaggtgggggtctgcacaaggacaagtttgggatgaagcctcaggtcacctggcttcctggatctataaactgtcatctaagtgacaggcttggctcaggaaagccgctcggtgccaaccagcttgagagcctagctcccgggggcaggccaccgcacagagaacacacacgctttcctaacagccttgctggggaaatttggccactggctgcaaaacctcactggaagtaaaaaataggagtgtcagatcctgtagctgaatgaaagaaatttggaccagccagggttaaggaagacagactttctgctctccagagtctgcctgtgctctcaggacaggcctcggtgtggcagcacgtgaaccagtggcaggctgtttttctttctttccatgttcccagcccctggcacatggtaggtgctcagaaagtgctaaggacttcctaaatgcaaacctacacagcctagcccgtgcagcagggaacggagatcaccgggcactcgggagccatccactcggtggtgggcgatttgagccgctgtcttcaggaccgagaccaggcatcagggaccccagattgtggagcagacaacaacgccggctgacctcggacgacgtctcgtcccgtattctatgtctcatgtcctctgtgaaatggaagagcctccatccctaaggggacagagtttcgggcttggtgaatggagcctggtgcgaagcaggaaggaagccccttggctcccacctgccagctactccggggcactcccccgaccttctggccatctccattgctcagagccccactgtgggaggtctgagctctcagaggctgcagtgaagagtgacaaggatgacgcccccaccaaccccatcagggttcctgggggtgcggatgacatgtgggccacctgggcttgtctttagcgttttggggagatgaatagtttgagtgactgtctgcttgcacctgcctcaggacagagtagtgagaggtaggaggaaggcgtagaggggaagggagcttcagaggtaacccccgactgaaccgagagtgcacaggtggtcatcctgcacccagtcctcctgtcaacaccagtaagtgggcggtcccctccctgggcagggcaagacccctgggcctgagggaggtgggaacgagtgcaggtggcgggggtaaacatctctgcaggaggcagagcctgtgagccagtgcctccggccagcccctactgccgggtgtaacgggtgtgaagggagacatgtggaccggcaccttgttccggtcacttccactctgagcttttcccgcccatcacaccaaactgctggtggtgcccccgccctgcactgccgccgcctgaggccctatccaagccatctctgatagagctgagcctcgaggggcaggactcccctaaaaacatcccctgtcttcagcaggggtccagggacctagacaggtgggggaccacccgttgttacggagtgactgggagggccacccgaggagagccaagcaggggaccacccctcccggcatgggcagacctagcagggcagccccgggacttggggcgtgagatccgacttcctgaggctccactcctggcggggggcaggccaggccaccgtggctctccaaggaaggcgcactgcctagctgcgtggagcgtggttggcctccagccgttggcttcctcagggtcagcatcctctctgcctctccaggagtctgagctaggtgaggatacaagggcctgactattccacccctcaagggctcctctgatgggcagcactggctctgcatgcccactgggctgccagagatgagtgtggcagatccacatcgcagcttacccacccctcctgcactctcttgcagcctctcttttcttcatgggtgttgctccctcataaataaataaatatatatatatacacacacacacacacacatagttgctgttgttgttgttgttgttgtttttgaggcagggtcttgctctgtcgcccaggctggagttcagtggcacaatcacagctcactgcagcctctgcctcctgggctcaggtgatcctcctcccgagtaactggtgagaggtgacagcgtgctggcagtcctcagagccctcgcttgctcgtggcacctcctctgcctgggctcccactttggcggcatttgaggagcccttcagcccacctctgcactgtgggagcccctttctgggctggccaagtctggagcccactccctcagtttgcagggaggtgtggagggagaggcgcaagcgggaaccggggctgcgtgcggcgcttgcgggccagctggagttccgggtgggcgtgggcttggcgagccccgcactcggagcagccggccagccctgccggccccgggcaatgaaggacttagcacccgagccagtggctgcggagggtgtactgggtcccccagcagtgccagcccaccagcgctgcgctcgatttctcgccaggccttagctgccttcccgcggggcagggcttgggacctgcagcccgccatgcctgagcctcccaccccctccatgggctcctatgcggcccgagcctccccgaggagcaccaccccctgctccacggcacccagtcccatcgaccacccaagggctgaggagtgcgagcgcacggcgagggactggcaggcagctccacctgcagccccggtgcgggatccactaggtgaagccagctgggctcctgagtctggtggggatgtggagagtctttatgtctagctcagggattgtaaatacaccaatcatcaccctgtgtttagctcagggggcaccaatcaacactctgtatctagctgctctggtggggccttggagaacctttgtgtggatactctgtatctaactaaggggacgtggagaacctttgtatctagctcagggattataaatgcaccagtcagcaccctgtcaaaacaggccactaggctctaccaatcagcaggatgtaggtggggccagataagagaataaaagcaggctgccagaaccagcagtagcaacccgctcgggtctccttccacactgtggaagctttgttctttggctctttgcaataaatcttgctactgcacactctttaggtccacgctgcttttatgagctgtaacactcaccgggaagatctgcagcttcactcctcagcccagcaagaccacgagcccaccgggaggaacgaacaactccagaggcgctgccttaagagctgtaacactcaccgcgaaggtctgcagcttcactcctgagccagcgagaccacgaacccatcagaaggaagaaactccgaacgcatcttaacatcagaaaggacagactccagacgcaccaccttaagagctgttaacactcaccgcgagagtccgcggcttcattcttgaagtcagtgagaccaagaacccaccaattccggacacactgggacaacaggtgtgcaccaccacacctggctaatttttgtattttttgtagagacaaggtcttgccatgttgcccaggctggtctcaaattttcctggacttaagcgatttgcttgccttggcctctccaagtgctgggattacaagtgcgagccaccatgcccagctaatttttgtattttttgtagagacaaggtcttgccacattgcccaggccggtctcaaactcctggtcttaagcaatccactcaccctggcctccccaagtgccgggattacaggcgtgagccaccgtgcctggctcccaataaatcttttgctctcctaactctgactcagggttggcctcctggagaatcccgcctgtggcactgtcttctacactcctgtccatccgtttccacctcacaggtggtatccatgcctctgacccaacactgcagcagggctgagccagaaccctgtgccgcgcccaccttcccgaagcgctctgacctcatgattcccctcctgcccagtgaagagacgagacagcctcgtgcccactccacagcactggccatgcatgcctcctgcctcgttcctaatgattagtacctgtgtctcctaaagaggcttgtgagcaccttaaagggccttcccataattattctaattcttccagaccagtcagcaagtggccagcccggcactctctaggcccctggtgagtaggatgtccacttcatgaggatgcttcctcctccggaggacagccctggccagtggaatgttctggattgaagaaacctgccaccccattctttccattgttcctcatacgactggatttggagtcccccaccactctcaccacgcaacctgaacatgttgtagtttgctgatgaacttcaaaagtggggtacccagggctcaacacagctccgtggaaccagccgaccagctgagcggagaaaaaaggctctgtggacacatttgttgacataaccaaaggtcatattcgttaccctggacttcatgcagactcttcagtcagaatacctgcattcgtgtattttctcagtcagcttcgcctcggatgcattacttcacttctgtgcctccgtctctcagctgtgaaataggatcctaccagtaccctccaatcccaaactgagaggccgggaaaaggcaaggacgcccgtcggccggcagagggcgctgcgcacccgcgttggacggggcgcgctgccgagcatgaccgccaggggtcgctcgagcgccaccgtccaggccctgggccccggcagaacccggctggccttaggcgcccagcggacctgcacgcctgcggccttgggacgtgccgcctttccctgctccacactctccccgctcccttgggaggatccgagtggttgcctgcaaatccccacaccagcccggctgcggtggacgagggcaggtgggcaggctgggtgagattggtgggatggtgtaagcagtgatgccagccttggaaaggatggaaatgacaccgcacagagtacagcagacccaccacctccaaggactcgatggggtcgaggccagctcctctccccagcagtgtcttctcatcagctgctcctgaggcctgtcctggcccaggacctcatgtgctcctcctggccaggtgcctgtaccatccaccctgcccggggcgccctctgctccattaaatgccccgcccgggagcctgcgaactcccaggactgcccctccatggagggtcaaggaagcagtctggctttggcgggaactgcagaacaaacagacggatccagagccgatgttagaattctcctcccggccgggcgcggtggctcacccctgtaatcccagcactgggggaggccgaggcgggagaatcacctggggtccggtgaccagcctggccaacatggcgaaacctcgtctctattaaaaatacaaaaattagctgggcgtggtggtgcgcacctgtaatcccagctactcagaaggctgaggtaggagaatcgcttgaaccctggaggcagaggttgcagtgagccaagatcgggccactgcactcactgtcagcctgggtgagaagagcaaaactccatctcaaaaaataaaaataattctccttccccttggtgaggaaatggagatgacacctctttctggccggatgggaaatggcagtaaatggtcacagttccccttcctcttggtggccaaggaagcattctgattgggcctaaagtcgaggaaactcccatttccaaagtgcctgctgggtccttgtcagccaagggaagaccatcacatatccatgaaggttcattttcagtgtcgacttggccatgggatgcccaggcatttggtcagacatgattctggcatggctgtgagggtgtttctggatgcaatttgcctttgaatgggcagacggagaacagcagaacgtcctccctggtgtgggtgggcctcgtccaatcagttgaaggcttgctagagcaaaaaggctgacgctcccacaggtagaaggacattacctgcctgactgcttgcgctgggacatcattttttcttgccttcagacttgcactgagacttcagctcgtctcacatcttgagcctgctggtttttggactggagctacaccattggctgtccaggtcttcagcttgccaactcacactgcagcctccatcatcaagtgagtcaattccttatcacaagtgtgtgtgtgtgtctgaatatacttgtatgtatatgtctgaatgtttattttcccccaaagttcacatgttgaaatcctaactcccaaggtgatggtgtgcataagtggggcctctaggaggtgaggttgtgagggtaaagcccacatgaatgggattagtgctgttatgaaaaacatatgcacaccacatcctcttcgttctgcttctctggaaagtccagactaatccaaaccaaaagagcaacatgaggggccgggcgccgtggctgatgcctctaatcccagcacttcaggaggctgaggccaggcgggttgcttgagtgcaggagttcaagaccagcctgggcaacataatgaaaccctgtctccaccaaaatacaaaaaattagccgggcatggtggcacacacctgtaatcccagctactctggaggctgaggcacaagaattgcttgaacctgagaggcagaggttgcagtgagctgagattgcaccacagcactccagcctgggtgacagagtgagaccatgaaaaaaagagaaagagagagagagaagaaaagctacttaaaattgtccctgaggttgaaatgactgtgtcaaattgttcatggcaaaatgtcttgtattgttctctatccctcctatgttccaactaaatgggaattttccattcccattccctaatttctgtgctccgacagtactctctgcctggggcgcccttcaccattcacccccagggttgcactcagatgctacctcccgcatgaagtcttcctctgcactcccacacaccctgcttgtgtctattaggaatccttctggctgcaagcaacagaacctctgactagcagtgacttaaacaaagagtggtttatttttccttaaataagcatgggggtaggtggttgccgacatgagtgtggtggctcagagatgccaggtctggctctctcagattcttgaccttcccctcatgattacaagatggctgcagttgcccagagcatcatacactcccatcaagtccaaggaagagaagtgagggagtggagcaggggagagctttctcatttgccttcctcttatctgggagaaaaaaaaaccttcccaggagcttccaacagatgtgcccaaaactaggccacaaggcccccctcacagaccgaggatggatctgcattcctgagatcaagggagctccactgaggcctacacgaaatggggttctggcagcagggaagaagggaaggggaggcttttgaggaggcagcttctcccacattgccagctgtccctttcctatctcccgctgtagatcacagggctgaccataaaaggcacttaaaacattctgacttcattttgattacagtctgtgagcctcaaaaggccttgagcaggaagaggtgtgttctgacatgcggttcacatggctccctccggccacagtgggctgtatgcagggcgagagaggaggaagcgggaggctgctgcggaggttcagtgacaggtggagggaggttgacaggacttggcagcaaggctggaaacaagtggagctccgggaggaccatgcgggaggcagatccacggggcccactcacttatgggcaggggagcccaggagagagtaaaaactgcctggggattagaacagaggaggagtgtcaagagtttggtttgggtcatctcggatttgaaatgctgcagggctgtcctggagtcttgtccccagtgggcaggacagtggctctggtgctcaggagagaggacagggctgagacactccttggagtcactggtgtgttgatggagaaaaggcaagagaagacacgggagaggacaggctttcccagggaggctgagaggtgggtgaggaacaaagccttcaaaagcacggatagcagctgggcgcagtggctcacgcctgtaatcccagcactttgggaggccgaggcgggtggatcattgaggtcaggagttcgagaccagcctggccaaaatggtgaaaccccgtatctactaaaaatacaaaaattatttgggcgtggcggcgggcacctgtaatcccagctactaaggtggctgaggcaggagaatcagttgaacctgggaggtggaggctgcactgagcccagatcgccccactgcactccagcctgggcaacagagcgagactccatcaaaaaaaaaaaaaaaaagcaccaatagtgggtgacagctccaacaaggagactgagaaggaggccccccaaaaagagaggagatggcagggcaggacagctcccaagcaaagggctgacacagcttggactttataactcacagcgttctcattcctctaattctggtctccaagaacctacagtaaatccaaaatttactgaacttcactgtaagttcagctctatggatagaacttagctctaaaaggaaatatttcagctgcttctcctgaaccacagtagtcagtgtggtacacgcttgagccttttaaacagtcagtctttggagagaagaaactaatctcaatatctaccttctttcagtgttgtaagaaccgtccccagttccttaggttcctcaactgagactatttcacaaatcttttatatacacaagccaacagacacagctaatccatttttggatgaaaacattttgatttgtggttcatgcaaatattaatatattctgccagccaggcgtgttggctcacgcctgtaatctcagcactctgggagtctaaggcaagaggatcgcttgagcccaggagtttgagactagctggtgcaacatagtgagaacccatttctacaaagtaaagataaattagccaggcatgttggtgtgcgcctggagtcccagctattcgagaggctgaggcaggaggatcgcttgagcctgggaggttgaggctacagtgatctgagattacactactgcacgccagccggggagacagagcgagaccctgtctcaaaagtataaatgtatggctgggcatgatggttcacacctgtaatcccagcactttggcaggctgaagagggcagatcacttgaggtcaagatttcaagaccagcctggccaacatggtgacaccctgtctctacaaatacaaaaattaactgagtgtgttggtgtgcgcctataatcccagctactcaggaggctgaggcaggagaatcgcttgaacctgggaggcgggggttgcagtgaggcaggactgactactgcactccagccttggtgacagagcgagattatgtctcaaaaaaaaaaaaaaaaaaagaagtggccaggtgcggtggctcatgcctgtaatcccagcactttgggagactgaagcaggcggatcacctgaggttgggagtttaagaccagcctggccaacatagagaatccccatctctactaaaaatacaaaattagccgggcgtgatggcgtatgcctgtaatcccaggtactcgggaggctgaggtgggagaatcacttgaacccgggaggcggcggttgtggtgagccgagatcgcgccattgcactccagcctgggcaacaagagcaaaactcctccatctcaaaaaacaaagaagtataaacatatttattactgcctaccagaccatggatccaaggtttagcacagaggcgttgatgcacatcagtgtggctttccagaactccgctttccctagccttgctttggggtgaagatgaggccctggggtgcctgcctcatagccacatccactgctccttgctgggcagcaaggagctcaggcaagcaggctgggtcctgaggtacgcgtggtaattcgtctgaaccgattaagggaatctctcctctttgcagatgaagagtagtgggatggggccagctctgcctgagatctgaaagtcaccaggggccacagaaaagtttcctgcctgagaagaacggaagggatgcacaaggaggaaacctcctcccgggagctgaggcagtgacagtggccctgaggaaaggcaggaacctagcggtggcatccaaaactgtggaattaaccaacccgggccctcgtacctcagggttgagagtcacgtgtgctaataaacctgtagggtaagacctaaaatttaaacccaacactatgtgctgccttgatctctgctccagtcggaagggccaggtgtgaccgagctgcaagttcccctcctcactcttttctctcagataaggccccccagccaaacatccctccttacccaggggaccaggcagggctcctgctcacccaccagctgtgggtttcacttccttaccagcctgtggaattacttaaacaagtcaatcatattctccggtgggaaccaggggtcaccacaccctcttgctactaccaccaagcctgcctcccacagcccctgctggctccctctgttcctgagtgcagttcccatggggccctgtgtggggcactgtcctcctcccctgagctgtgagttcaggttactaataacctgctgtcaatcgcacctgtccagtatcaggtgctgtgtgtttggccattgctacaatcccagggcaggaatccttctctcattaacaggtgaataggaggaaattaaaactgttatttacataagctgctttaagtcaggtgttatttatggctggacgcaacgtgtcatctaagcccaggtgctcctgtaataccagttactcctaccctgaatgtctcccacttgtactcgcttgacacggactcaggaaagcatcaagccagtgggtttatttcctgcacccatagcgtgacagatcacagaacctgatcaccgtgtggcacatccatgaatccaggtagcactggcacggctactctcaacaactgtccaggaaatgagaggccgttctgtttcctaaaggggccaatatattatttttattttccctctggaatacttaaaaacaatttgtattggtggttttttaaagggttatattttctacattctaaatgtgcagaagaacgtgctttctggcagacagggagtatgtcacacatttttatgtcttctgtgccagaaccttaaaatcgttttctttttaaaatcagactaaaacgttcattaggacctctgaagctccctagaaaccatgcagtctaatgtggcatgtgccgggatttcagaggacagagcaaaatgtttccaattctttcccaacctctccagctcacctcctgtcttgcctccaccccacggctcatcttccaaccttgcccatttacggggcctgttgcagaacagcccatgcactctcacacctgcaaactgctcgttgctctgccagaaatacctttgcccctctgatgcccaagaacacctgctcattcttaacagctcgtctgttaattccaggtgaattgacttctccatcaccaccaagcagctgacattatttccccatctgtttgtatatcattctgtataatttattacactcacattgtaatttttgttttgtaaaccaatttaagccaaattgttcactgatctacttgtctgcctccccctaaacacacatggacttagggaccagggctctattttagaggcaagtaaatgcttctccctctcccttgccttacaattctagggaaagaagtgtcattccattcgtatctgggtgttgaggcccttgtgtatttgtgatggggtttattatgggaagagaacgttaagctgatctaccatcttgggtaaaatcttttcaagctcattcacataatttacaaattacttggaactggctcctgtctgaattccaattaccctccatcctccccacacttacagctttctctaagtgagatttggcagggcagggggaccggcgggggaatgaggcaccaactctgaccagctgcctctttgagccgtcgctgtctggcagggctggagctaatgatttctatggttaccccaaattatgaactctgatcgttctgcgatccttggccctttgacatgccccttttataatcatgctttttgagtttacagttccagccccatccttgctgttcagtacccactcctgctacgttaatccacgaggattccggaaagcagctctgaaatttggaattccaacaatgcctgcatttgctcatttggaggcatttcaagcagctatttttattctttgttcacatcaccaggtttcaagaaagcacccgagacactgtgccattaagtgttgagtcaggacaggagatctgcaaggcaaaaacaaattccccttccatttccacctgctgtgcacactcccagcttctggacccttgctgacctacgcgtctcaacatttacaagataatctgacacatgggattgatatcatgtggaaaaagtcttttcccttcttttgaaaacttaggagagctagagagctttgggacttgaacagctcccagttaagttataataataataaataatctttggcagtggctcatgcctgtaatcccaacactttgggaagccagaacaggaggattgcttgagaccagcctggacaacatagcaagactacatctctaattacatttttaaaaagtaaagcactttttttttttgagatagaatctcgttctgttgcccaggctggagtgcagtggcatgatctcagctcattgcaacctccgcctcccgggctcaagcgattctcctgcctcagcctcctgagtagctgggattacaagcgcccaccaccacgccctgataatttttgtatttttagcagagatggggtttcaccatgttggccaggatagtctcaaactcctgacctcaggtgatccgtccatgggttttctccatgttggccaggctagtctgaaactcctgacctcaggtgatccgtccaccttggcctcccaaagtgctgggattacaggcatgagccactgcacccagccacttttttcatactgacaaaaattactggtacttaacactggagatttgtatctaaccatccacttcatgccccagattactagacagaaagtggaatcatctcctttaatcaagcaaattcccgtctcataatggggctgtgggaatttctctagaggacatcatttagggaaaaacaaagaaggcagccacttccttggcctttgggtatgtgctcttgcttcttgtgccctgagagtgagacccctttataatctgcagctcaggaaagaaatgtctggtccatcaattgacaacttgttaggaagcaatgctaaatgaacgaaaaaattaatttcattgagtataaactcaccttattggaggaaataggccttatcttctaggtaaatgcttgcaataaatgtagacatgaataatatcgttgttaagagggaaggaaagttgtattcgaaacttaattccacgtttcagggaaacagaatgagaccgcagttagttagctgtccaaggcaggttcggttctttcgttggattgttccctgtgctgcccgtggggccattcacagaagggagctacgacggagggaggctcgcagccccgccagctgacatgcccataaatggctccagcactgctaggcacgtttagaagtgggtcaggatctactgaagctgaacgcaggcatacgctgtgacccaccaacgctattcctagtcacacacccagaagaaacacatccatatgttcaccaaagacacatgctagaatattcatagcaggactacccataatagccctaagctgggaactacgatatcacgaggacagacaatccaccactacacacactacggatgatctcacatgcaatattgggagaaaggaaccaagcacaaaatagcaggattccttcacatcaagcacaaacacagcaacctcgggggtcagaagtcaggagaggggtgatgctgggagggagtggctggaaggaaacacgagggggcttctgggtcttgacgtcttttctcgctttgggtgctgtgcaaatgggtgtagtttgtcaagatagtgagctgtatgcatacgtacacttttctgtccatatgttttacttcaataaagtttttttaaggctgagcatggtggctcatacctgtaatccctgcattttgggaggctgaggtgggaggattgagcccaggagtgagaccagcccgggcaacatggccagaccccatctctaaaattaaaaaaagtttttttaaaaaagccaaaacgtggtgggcaatcccagctgtggaggctcctgacagcagccagcccttttgtggggcttcagtggcctcatcagtggggccccatctgtcccaggaggcctgctcacctcggcttcccagctggctgcgacaggacctgtctgtagggttccaacacttcacccagcggcaggagctgtggcaggaaaggcccaactcaacgcgacacattttttgcaaaccagcttcctggcttctcagactcgtttttgtcttgggggtcgggagtgatgacttaagagctataatcatccaaggatagacatcactgtcatatcccaggtgacttttaaaaatgctttgaagcatacatctccaatgcctttacccacaggagtggccttgcaatattaaaattggttcaacgctgtgttactcctcagtcagaggcctttgccatgagagcctgtggccaaggagaaatgacaaatgagtggttctttctagcttgttcacagagagacgccttgaacttcacccacataacccctccatactagtgtctgcagctgtcagtgtggtgacagaggctatctcgcactctatgatactgtcactgtcagctgggccacctgggtggggagcctcagccagatacccccagcatattgaaaccatagaagctggagctggaatgacctttgaagacctaaacacctcactttacagctgagaggagagaaggctaaaatacaactcccggactcagtgcccaggtgccacggtgtccttgcccacactgcccagggctagggtagcaatctcatgacaataagctccaaaagttactgggaactgaggggcttcacaaatcttttcagcatatagtctcttagggtctggcctctttgccataacacaatgggattcagcctagaatgaaaacatccaagaatacagaaggctgggtcagctcatgactgcagtggcaaaatgcattcccctacagcccctttccgctgtacaccaagggcttctcagttgaaaaggagaggagaggtaacagacattcagtctatttagaaatgaggctggcaaaaaaggaggtgacaagttactctggttcagttgatgaaccttcttttcacctgagccttcttttcacctccctgacatcagagaatgaaaacaaagacatcatacagaaaagtgtggccattaaaaggatcacaccctttacactaatgtgccagcaagctcctcacaaaccacagactcccagatattcttagctgaaaggcacctgcctctagggacctccagtgaggggcaggatggtcacaaagtgagaacaccaagtccttttttttttttttttttttttttgtagagacgggatttcgtcatgtcacccaggctggtcttgaactcctggactcaagcaatccgcccacccctcccaaaatgctgggattacagacatgagccaccatgcccggcctgagaacactaagtcttatgtctgtcttcagctcttcaaagccccaaagcacttgcaccattgtgtagttttgcagtggtcccagtactggttcctgcagtaagtacgcttaatactaaaatgcacagggcatttggtcctggaggaaaatagcacgtacatgcagctcgttcatttaccaacaggctgttcactggctttggacgcctccaatgaagaggtcaccaagctttccgtcatagaggagcagcagcattcagggaaaggatggcggatcgcaaaacactccccttggtgacaggctgaaatgcagaaggaccagtatagaacgctcctcaagcttttagaactgagcgtattttaaggtcagaatcacaaccaagacaaaagaatgcaactcttttcatgtcgtatacctttggtaaattaagagcaactggtaaaataaatacaaatctcatttgaattaagtatttcatgtttttatttcaaaagaaaaaaggataccaagaagcagaagaatgaagcagttaaaaccagcaaagctgcaaagtaggaaagaaagctgagggagagattgatccgatttcaacgatgtggccacttaatgcaaacacaggggtctgatgctgcaaacctaagtcacatgagtccagtgacttcagcaggtccactgatccaccacagtgacagggccaggccccttcctgctgaatcctaactttacacattctagacacatgtcatgcacatacaggttacactttatggttacatgaaattgcatgcaattcacacagagaatcattttgaaggcactgtattttgcagcaggagctgctactttctggcaagtccttcctaggttggctcacaagtggtcctcctttttatttattcctatatgaaactttggtccaaaaatcaggtgcagtctgatcctaccctcccagctgttttagtttcatgtctcaccttctcttccacgttcccttcttaaacgtagatgtcaagcttagaagatgtttcctgacaatgagatcctgtttaattcagattttcaaacaacttgagtcaagcaagcaggagcttatagtatgttgatttaaaacaagttgttaccagtttcccttacccttgaattcggcaaggcccattaattcacaaattccatgataagatacatgaggttctgtatgcatagtaaatgatttctagttacaattaaaatacagccttgtatatgtttaagtcaaccttaacttttaaaacatgacttcagtatacgcaaccttaggctcacttccagattataaagtcccattcatggggtgcaaatgtttacattgttagcaaagaaaatagctctgcataatcttttgacatacatgcacacttctagttctaaaattcagagcaaagcaagatgacaagagattccaattccagcatatattatgaaaggttatggactgtgactatccatccttttggaccataagaaattcacttttaaattttttctactgtgctgttctactatatacttttggtctatcaacttggtaggcctgaaaaaaaaaagtatttaaccttctaaatctcataatagaaattatgtacgttgttctttaaccagaaaggttcactgctgactcccccacctctcaaaaaacaaacaaacaaacaaacaccaccaaagctttccgccattcatgcacatgcttattctgaccccaaccccatccctacaaaggggcagcagacagcacaatagtcaaggacaaggtttttatttatttatttatttattatttatttatttattttttaaggagacaggcctcgctatgttgcccaggctggcctccaactttgggctcaagtgatccttctgcctcagccccccgagtcgctgtgcctaggagcacgcaccaccacacctggcttaagtagaaggttctgaaatctgccagaggctgagcaacagaaagcttccaatgagaactcagaaggcattcactctgcctgaagttgtgctctgctcacagcacgagtgtggctgtccctctctcgctcccaccagctacataatagggactttcaggatgctcctataaatacagactccagagaggtttcctcaaaaattaaaaaaaaaattctatgcaaatatgtaagtactgtcattgaggattacagaaatactttgcatcaactacagatgtctcaaaatagaattctttctagctcattcagttttgttagaaacacttcatgttctccaaaaaagaaaagcacctaacgaaaagcatgtcctattcatgctagcaagaaatgaatcccaaaggacacgcaccaagaaccaaagtaaaagaatgtcagcaaaacaggacccatcttttatcatcccaaactgctatttccatctctgactttctgccaaattatctttatcttcctaagacgaagcaaagactcagagccctcaaatggcacggaagcggcacctggtctgccaagacattgctgttaaacagagtcttttggattaaaaccagggaactcggaaggaatgactacatggatatagatggataagatggaagatataaaataagaagggcaggagggtaagattattccttttttcctttcaaggctgacagtgatagaataaacagcagcacagcaggttcagatgatatgaaaaccactgaattctgcccaggaattgaaagaagggcttcttcacttcatcgagctctggaaagtctgtttacttagaaacagctcttgaactacaagagtcaaatggaccttctgctattcatataattggagcatggatctcgtgtggtcccattacatgattggaatcagtctttctgaacggcagaatgtgcttccaggttgaagcacaatggagaatgtactgaagccaccacagagatgctggtaattcaaactgtgaaagcacgtggcgcagaggaaactgacacagaacagcacaccactggtgctttatgcaacaccactgaccccaagatggtcactccattgatttttccgcattgtttacatccaggatgcatgctgtccagtgcaatagcgtctatgactataaaacaactaaaagctgcacttaagatgggagagccaaactcagatcttttttctccttctcttcaaagatcaaaagaagaataaaccaaaaaagattaaaaaaaaagaataaaccaaccagtagctgccgagaatacagtgaaagaggaaattcagaactcaactttatcggggatgggcacggtcgcttatgcctgtaatcccaacactttgggaggccaaggtgggtggatcacctgaggtcaggagttcgagaccagcctggccaatacggtgaaaccctgtctctactaaaaatacaaaaattagccgggtgtggtggcgcatgcctgtagtcccagctactaaggaggctgaggtaggagaatcgcttgaacccgggaggcagaggttgcagtgagctgaaatcacaccactgcactccagcctggatgacagagcgagactgtctcgaaataataataataacaataataataaaaagctttatctatccttgcttgtatagtggcaaggaaaaaataaaaacaaaacaaaaagaatttaaaaaaagaactcaactttagaggtagaaggctcagagagaatgactgactagccccacagcctgaaaactggtaaagtcagtcccagtccaatgacctgcccacaactccacacacaaaaaaggacagactgagagagactgagggcgggaggaacacagagaaagggaaatcaagtccaacaaggtggcaaagacatggactcaataacaatttttaccatgttttctttcagaaacaaggacattttatgtgaggatcaaatattctcccttcaaaaacttctgcaattgaaggccgaggcgggcagatcacctgagctcaggagttcaagaccagcctgggcaacatggtgaaaccccatctctactaaaaatacaaaaattagtcgggcatggtggcacgcgcctgtagtcccagctacttgggaggctgaggcaggaaaatccctttgaacccaggggggggaagttgcagtgagccgagatcgcaccactgcactccaacctgagtgacagagcaacactccgtcaaaaatttttttttgcaattgaaacttaaaatgatcaagcccaaagtacctctgggaaggacaccaaattgtaaagtcctgactcaggcctgaacctcccatccctctagtaataaagaagaaaggaaatgctacctagattttaacagggctttcttctcaatatctaagccttcccaattactttcctcagataaactataagctattcttctcctggaaatttaagtggcaaagtcaacgtcttttaccaaccatccatgggctattgctgagttgcggaactagcctacagctaactcaaattcatcacctcagactcactgtgatgcccaaccactggcactggggtggccttatgacttacgacaatcaaatggggtttgtgaatccatggttaagctagcctgccaccaaggatggacaaacctcagacttgatcaatgggtggagggaaactccatatttaaaatgcccagtgcctcggtcagcagaaccaaccaagtgacacctgagatcaactggtagtaataatgaaaagctggtatttctcacataaaacacgttgaaaaacatttatttatttagagatggaatctcgctctgtcgcccaggctggagtacagtggcgcggtcttagctcactgcaacctccacctcctggattcaagcgactcttctgtctcagcctcccgaagagctgggattacaggtgcccaccactatgcccagccaatttttttgtatttttagtagagatggggtttcatcatgttggccaggctggtctcaaactcctgacctcaggtgatctgcccacctcagcctcccaaagtgctgggattacaggcgtgagccaccatgcccggccatgaaacatttatttttaaaatgcctttaatctttaaaaaaaaaaataaaagaaaaagaaaaaaagaaaagaggtttcacagatgtgactaaagcatggactgttaggcgcttaagagaccaaatttttaaaagcgttctgtaatgtatctctcttatatggttgcaacaatgtgtattttaagtgtaagccaagaaccttttctctcagtttctatagacttggatggaaacttttggacttgatgggaaaattaactctcaatctaaacactagccaatgtagactttttcttctgagtgctttttcctatggaattcaaagtaccaactattcaattctcgattttctaagccttcttagaagaataactatttactaaaacccaaccaaaccaacctataacatcatccatctcctttattagttatttctttatgcttttagaattgtcatctactgctgaagaaatctttcttggaattgaagggaacagttaaatcagatttacatgataaactatgggttgtcatttgtatatagaacttttacggaataaatgtagtctaacaaactgggctctctaatgaaatatgtaagcttttctaataatttctatgaaaagctatattctcttagaattttttttttttttttttagagacaggttctcgctctgtcacccaggctggagtacagtggcatgataacggctcactgcagccgcgtcctccctgggctcaggtgatcctcccgcttcagtctcctgagtagctgggattacaggtgtgcaccaccatgcctggcctaaatttttaaatttttttgtagaaatgagtctccctgttacccaggctgatctcaaaacttctggcctcaagcaatcctcccgcctctgaccagtttaccgagctatttagatgtcctaactactaggaattatatgtctttaaaaactgaggaaaaagaacagcactactcaaatggtatattctttttactctcagccaccaactggggcccctaattttctccctctgcctagaattcctgtgtcctacaccagaagcgtctacgggccctgctctctgctctttatgagtatttaacatgcttcacagaacgggggtgcagctcagtgactgtgattctttggttcaaacacttaattggggcttcatctttgattttttctgcatgttaatctgcaaatactcaaggcctactatgtgctttaaatgatactaacacttccgtttagaaggttgtgtgcatcacagagtatctgtaacggggacagtcctatttccctttctcaattttcagatgtatcgattccttcagatttcaacagaaataaccaataaatgtggcagacattcttacaacatcctaagtcattatgacagtcatttatccttttacaatgtttctgttactttataaagaaaactatttagaaagacaaatttagttaattctttagcagttgtcaaatgtgtctcctcaccaaaagattttactcttatgtgacttgaccattagtattccacaaataatttatcctagaactccatttatttatgttgatggtgagtatctgtaaccatcctaaatttactgcattaatattttacttttctttctaatcaattttaggttttaatttgaaggtttcatctttccagtattgatattttaaaaaatcttgatgtctcaaaaattatcgagagataacataaaggggaacacaccaaataatccacagcttttgatgttgggaacagaaaaacctgcatcacagacctccaacagttcttggcttctataaacggactttcttgaggggttactgacttcagctgcttagtcaaatctacaaatcctcaaaagaaaactcttctttaagtaattgtcctctactatgtctttacatagccaaagctacctacatcaatttcattccttcagagtcatggagattccttataaatacctgtatgtcaagttttgactttaaaaatattaaatggcttttagtgaaaaggcagaggtattaaacatcagtaatttcaatatactaggatccttttctcattccttagagctttggagagatgtacagatatgaactcatctttctattaaaaacaaaagtggtgctaccagaaaaaggtttggagtttggaagtgaatgagagtaaatgtcttcaggaaagtgaattttatgatagctacataaaggaattaagagctcctgcagagttcctttgcgatgtttgctttatatagttacttttacgctgcttataatcggtagaatttaaagggtaatggtgttataaaattataatggccacacaggaattaaagagaccttgtagcatacctttgcacactgtgcttcatagggtaatactacttagaattaaaaggccaattcttcacaatggcactgaaagtatatataaatttacaagagacataaaagttgtagctaggtaaatttaaaagattatcatgttacttaactcatttttgaatgacaagtgacttttaatttgtagacaaaaatactgacttacatatgaagagaagcaagaacatgagacaggctagagcaaaaaaaaaaaaaaaaaaacagctgaaaattttacaactgtaactctgtaatggctgcaaatgttaatgaatattgggaacacgcggtccacgagaagtggagaggagaatggaggggggaaggggaaaatttgggtctggtcaaagaaaaaatacaaggattgtatttttgtatttctaatgaagacatcagaattataaaatggaactcaaaattaatactttataatagagaaaaagtactactgcttatatgtaggttttaagaaatcagcatcatgtataaacactatacatattttgctatacttaaaattcattactcaataatgccctttaccacacaatgtcctttaccatgcaaactacataaaggataattctaactgcatgaatgagttttaagtacctgaacgtgttgcagaacaaaatggaataaaaattaaacacttaatcatcatcttgactataagaggaagttactgtgtcaaggtgggcagagagaaaataagaagagggaacacccaacagttatttcaaacaaaaagtagacacatcatcacatatttcttttgtatacattacttagtattcacgacttctatgaaatctgtaaagaatagtgacgtgacatgtaaacttttaagtagtaaagtcttggactttaaaaggtgtttttcacatccaatataacttactttaaaacaaattatttcagaagattatctaagtgtcacaaacaagcaacatatatatactgcaattttatttcaatcgcacaaacgaagttagcgtgtaggaaacttaaatgaaacaaatttaaacgaaatagttacggtaaaaatagcagaaaactgaaaattctaaaaaggaagtacacctaaaagcatgagaattcaacattcattagtgtttcatcttcagttttgattgacacttgatgcttgcaaatttttaaacaaacttttaaatcatgatgactattctgaagagatttcagcaccagcactaagatttgtacattcagtttgtttgcaattgacttgtgagccatttacatagtggatagtacagacttgtcacaggtcagatcacagtgttgaggaaagcagtgccttcctgtcattagaaaggatcccctaaactgtactcagcttaagacatccaacgtacaagagcacaaaaaccatcataataatgtggttccaaggaacgtggttttgataaggtaaataacttaggcttctgtttcccattttaattactgaaatctctaataatgacacaactgtcatgtatgatagcaaatgtatataataattcattcagacttcttggaaagaacatttagcaatctgggatgatgggaaatatagcatgattcaacactggtttttttttttttttttttttgtcagtttacacatacatcatgttaatattagaccaaggcacaaaacgtttagtgcataaacccagtttcttttaagatttagcattttattttagtctcttatcttagtttggaccacttgtacccagtactctacctactacagactatttaacttacccaacaaaatcaaaagaggttgctgaccagatttataggggacataactgtttatattatcaaagtgtttgcataaccaaaagtacaataataaagatgaaaatgcctcctatttcttttagaaaataatacttaataagcttgctgcatctttgatgtttttactactactgcatgacaatgaatatctgatagaaaaaagaaatgtatacttgaattatgatagctcatccatcacagtttaatctaaaaatgaaatttctacagaaacaggaactattttgacaaagaaaaaaaaaatccctcatccaaacttctttgtagtggtaaaggctgcaaatttgcagcgtttagaaaactacactatcaacaagctttgctttatggactgagatgtacaaaatctagaaagcagatgaaagtgaattatttcaaagttttagtaaaacttctgataatcagagttcaaagcaaatatggcacataacaactcaagcataaatcaagatggagagcctggagagtttcttaaattttccaaaaagctatcattccaacatgtaggatttctcccctattttaaccttaccagtttcaaaggaaagaaaagggagtggcttccatatagacagcacgtgcgcgagagcacacacacgcagagtggcaggcagagtgtctaattccttcttcccaccttccttcttcccaccacccaagtctcactttacttattaaaagaaaactgcagaactcctcattggttttcctttacctaatgatttctgtgaccttaattgctgccatcattgttatttcttgcatttcaacataacaaaattcaaaagcagcttcattcaggaacacgtatctaaacacctgtgtaacagcgggggtacctaggtaataataactgccaaattcagtgatcaaacttttgagttccacagttaagatattatgtgaagctcagaatcatgtttcagaccattgaaattactggttaaaatacaaatagctgaagacatgatgtaaaagattaagtacttggttttgtaacatatttaccaattaaagtcacaaaatatttctcattatttattcatgcaggtaactgagaaaaagatagtgcagaaatcaactttaaataaaaaattattcctccccttcctcccactcccctatactctacaaaatgttttccctgggactaggccttgaaaaggccactacatattagtgtgacatgcattactgtctgcaattaaaaaagctaaccttgtggtgattgtaattacattataaaaatgtccacatgcataaatctaaaaaaggttgaaaacctacagtaaatctacaatatagtgtttacatttgaccactggtttgtgttatgtagaagtcatagatttggtaaagcattgtaacaatttaggaaggcatctaaatctttaagttctggacaaattttatgttttaatctacaaaattgcatgaaggctaactcgagaaacttcctatcattctaaaatttctcaagctgaagaaacatttttcggacactttcttataaatattaccctttgaaagcacttacaattccatttgttccacatattatgatcttaacttacatagggctgatctcaattattcatggaatatcaaacatgataggaagaacaaacctgagagaaacattacaatacaatagcaaacttgctcaattctttaccagcactctctgcaaaaaaacttcctaagcctttctcctctttattttagcaatgtattgtggaaaatgtgcgactttatcttgatatgaaaatatttcaatgcgtggtgatcttgcctgatgggttttagtattttctgcataactgttacaggaactcttaaatgattctcttccattctgttgtaaaggccagaaaaaagcagcaaacggagagggaaagagcttatcaccagagtcataatgtctgaaggctttcagagtaggttggtttttccctccttctgtttgtctccattttcttcttacagctcataaatgtaggggtttgctgttgtgaacagttgttgtttgtaggatatttttcctccagattaaagtcctatctctccttagtctgttcctctatgcagtatttgacttgctcagttcctgcctgattgctggatggaaaagaacaagtattgaaaataaatataatgataaagtaagataaatgagtgattcattcctaagaaactttaaggattgtgctcaaactcacagtaataagaagattaactttgcatctttcattgcacacatctttaatattagaaagatgatactaatttctatatatttattttctccttttgtatacaaaatgaaaacactgattatgtgggctcaaaaacaagaggacactgggataggtgagtagaggtaacctagagaaagatctgttcatgtggttttccatctaagaaaagacaacacctgaaacttagggatattgtttaatccctatttataaaaataatttccattatatgaaggagaaacctcctccccaaaaccctaatcctaaaagggcaggactatggaagtcattgccctcaactaatcagctgggtatttccttatttgcattttcttaaaaatggtcaatcttaaacattgttttataggaatagtaaatttgtccagacacttaccatcaatgagctcttcttttagctttgttaattcttttctcatttcatctaaaatgtcctaaaatattagagaaaaataccagaaatacagaacaaaattaccactaaagagattcttactcataaaattttaagaatgtcatgaaatatgatgtgtagttttttttgtttccagagccacaattctatttcttggaagactagccttggtgaattttgttttaatattctgcccttcccaatcctggcttattctagcctagcaatatgtgaaatagaatgcttcctaaaattaagataattactctgtcatccagtgaaacgtatgagtcagatagtttctagaaatgataacagctgtgcttttaatctagtcctctgggaacagtctgagaggtgatgcaaaggaagtttagaggaggaagatattacagtaaactgaaaaactggctcttggcaaatctgtccttttgtctgaagtatgtatggagatttctcaggaatcaccatagctgccaaaccatatttcaaggagtctaggatttccctgaagggacctcagggattgccctaatgggtaggcaggaaggtggatgaggccctggttgacccatgctgtccaatacggcaggcacgaatcatatgcagctgctgagcccctgaaatgaggctaatctgaaatgagatgtgctgtgaagtgcaaaacacacaccagattccaaagatttagtatgatgaaaataatgtaaaataactcgttagtaatttataaaaattgactacatattaaaacatactttaaataattaagttttaaaattaatgtccttttgttttgtatttttaaaatgcagctacagccaggcacggtggctcacgccactgcactccagcctcggcgacaaagcgagactctgtctcaaaaaaaaaataaataaataaataatgcagctactagaaaaattttaaaatatatacgtagcccacattatacttctatttaactgtggtgctctgggccctccttcaagaactgcagatttggccaggtgtggtggctcacacctgtaatctcagcactttgggaggccaaggcaggcagatcacttgaggctgggaatttgagaccagcctggccaacatggtgaaaccctgtctctacaaaaactacaaaagttagccgggcgtggtagtgcacacctgtaatcccagctactcaggaggctgaggcaggagaatcgcttgaacccgggaggtggaggctgcagcgacctgagattgcactactgcactccagcctgggtagcagagtgagactctgtctcaaaaacaaaaaacaaagaaataaaaaaaccccctgcagattcaagatcagaggtcccatgacaaagtgacacaattttaatgggtgaaaagtaacagctgtcctttggaagaattagttttgaattgtgtgactttaacactgaataccccaggaaaaattaaattgctctgttaaagtttaccttttgaaaagcttctcatgtttaaaataaaactatcaattagtttgtcttcattttaacaatggaaaagactgagacacagaagttattaaatagactcacagatgccctgatccaaattactctttacatctcatcccccaaatcaaatctattcctgttatcctccaattcttcatatgaccaagaactgaccatgttttgaagcgtgtggaagtgctctattttaaaatatttttcaagaaagccatattcagtacacggcaaaacaaggcttgattttcaatggccacgtgctcccctttaaaattttataactcaatttaacttttccaatagctttgcagtatgaaaattcagtttatctaaaaaatgtacttcacctcttctgtgaataaggtattttaaatcacaatcttatcacttactactttttcctgagtacataggtattaactataaggcatatgaatccaaacgtggacagtatctttttcttttttataaaattgagataactgtacacatttgttttgttacctaacacaggcaactgttcacaatttactattaagcatactaaattatgatcccttgaagcctacagagcctctactccacccactatacatttgtatacttccataatattttctttaaataaattcctggaattcatatcacagaattcaaggtaagacatttatttttcaggcttttgattctgtttttccaaactgctttttagaaagcagaagtatagaagagtgcctgtttccttgcactcttgccaaaatcagatttgttgggttcaattttgccaagacagtcactgaaaagtaaaagcccattgttttctttacaactgcgtaccatgcacttacatttacaccttatgctgttatcactgaaccacaaccccaccctccactacctctggaccttcatgcaaactcaatgaaccggaagtgtagatttgcaaaaatgcagtactactaatgccactgtttaatttgtataacaatagctctatcgtctttctaagtacattcaggatccatgtcaaagatatgcatatgggatattttttaaaaagaaacaagtacaaataaaggaaagctgccactgagcacccacctgcttcagcctgtcatagtcaagtccttccgtctggactccattggcactgggctgtgataagggtgtggattttggtctgtataaatgagatttccaggacaggtaaacaacattcttaatacttaatgagttcataaataattgcaaatttaccaacccaacaccagatttaaatacatttctttaaaaaagccattttcttaaaaaattatcaaaattgtagggctgattagaacataaaacaacattttttcacttttctcagtatttcttatttataaaggaactagaaaaaggtgacaagatggtgagacttcttcagaaaagagtagaagacagtattctttgggcatgaggtaaccaggtaacgtggcacgttgaccaaaacagtgatgaagaggccagctgaaacatctgaggctcaaataacacaatcttgttttgtctttcttttgaacttttacattatctacttaaatacctggacaaaccagtgaaaggagaaacataaagacttgaatgttttacactaacataaatcagcttacaaagctgatgccttggattgcaggaagaaaacatttttagtgagcatgatttgctttatacatattattccatttcaagcatcaaaataaaaaatgttttaaaaatgtttattagattagactatgtgactatttccttgtgaaatttttatggagacgtcatttgaatggtgtgtttcaggctaactacttccataaatttattttattaaataaaaaggatatgccagacagaagcagattgtcaattattattgcactttcaaaagtttagtttctattataattcttaataagtcaatgattaggtatattttaaacaagtttcaacaccaaataaaccagtcatggcgccctctccaagtccggcaataaaagagtccccagtggaaaacctagagttttaaatgggcactcctccgggttctggtttagtctagtaaatgccctcctttatgagccacaaataaatgcaatttaaaaccatcaggcaaatcatatattcccaattttgcagagtaccaatgttagcaatctgaagcaagacccaaaaggcataataaatttttcaaagttataatttataattcttataagacataaaatactttaaacccataggcatggttcctgaagattaaacactgagttaatctgctttttgttgttgttgttgctgctgtttatgagatgcagtcttgctgtgtctcccaggctggagtgcagtggtgcgatcttggctcactgcaacctccgcctccccggttcaagtgattttcctgcctcagcctctggagtagctgggattacaggtgcaccacaatgcctggctaatttttttgtattctgagtagagacggggtttcaccatgttagccaggctggtctcaaactcctgacttcatgatttgcccacttcagcctcccaaattgctgggtgtaggtgtgagccaccacgcccagcctgttaatctgctttactatcaaaacgtattactgcttaaaagactgttaggaagcaagtcgtccaattttactttattaggtatctgcttatatgaatagggggaaaaataacttccagaaaatttcattcaataagcactgagctaggcactgtagggaataatatttatatgaaatatttcctttcctcttgtgaggctacaccttcttactttgctagggaagactactaaattccaaggtcacttaagatttacttagatccataaaatgcagagtcacttctggcaaatattcttaaagtttaggatgttatttcatatattcactcatgctacctattcctgttctctagaattaaactataattcatactctgcttttcttttacatttcccatttaagtggcccatttagctagttattttctcaagttatataatgaatacctctgaaattcacatgaactacagcctgctatttaattgggcaagtatgttatgaatatatccatatttactaggcaatgcaaaaattattgttatgtaataaacaattgtggaaacatgcaaatttttaaaaatttaattcatgctaacatgcaatccatcaccaccaccaccaccatgataattaactaaaggggggaacttttcatactgaaggaaagatgtaatcaccactttttttcttaacttttaccaaaaaagtttatcaataacattatcccagggggtactatgtgtgaaagcagcaagataactgagcagatttactacatttaaaaaatatatgtatttttggacacagggtctcattctgtcacccaggctgcagtgtgcatgatctcagctcaccgcagccttgacctcctggcctcaagtcttcttcccacctcagcctcccacaggcacatgcaaccatgcccagctaatttttgtatgttttgtagagacagggtttaaccacattgcctaggctagtctcaaactcctggactcaagtgatcctcctgcctcggcctcccaaagtgctgggattataggcatgagccatggcacccagccttaaaaatctcattgttaaatgctacttttctatgtactagcaaattttctaaagaaatcttttggccaaaacaaaccacctcaaaaaaaaaaaaaaaaaaaacacaaaactatttcactactggaatataaacattttgtgaagatttaactggctgacaaaattaacttgtcaagtattttgatcattaatagcataaaaataattttagcaagtaagaatttggccagagtctgcttacagaactcccaactcactgcaatagacatccactatgaacaccacttaattcatattcccagtgaacttgatgtatatttttttaaaaaatagatgtgtaaaataacataaatatatttcagttatttctaacctatgggttttcatcataattgatcacaaaatgagggtttctcaggtttttatttcacttttttttttttttcctaaaagagggtctcactctgtcacccaggctagggtgcagtggtgttatcatggctcactgcagcctctaactcctatgcacaagatatcctcctgtcttagcctcctgagtagctgagactataggcacaagccaccaggcccagctaatttttttttattttttgtaaagatggggtctcgctatgtttcccaggctggtcttgaactccgggccccaaatgatcctccagccttggcctcccaaggtgctgaaactataggtgtgaaccaccaggtgctgggtcagtttttatttttttatgatgagagcgttgcctttaaacatctgcctataaaatgactgtactactatatttaagtccctattctgtcaaattaattgtgtaagtaactgaaaagcattgcaggattatttttagctgtcaatttttttaattaagaaaaaactagttcttaagtcttcttaattaaaaaatggtataatagggctcatcctagaaaacaatctactcagggtgttagatgttaaactgtccaagataatttactacaaagtatctaggaaacagagattttcctcaaataatcaattatccacaaccatggctttaatattagtccatgttccagtaacagatggaaaaggatcttctattcaacttttttgaaaccttgtcttataatcataaggcgaacagcctttaaaagaaaacgcttaagctacaaatggcctagataatacatgtggccttagattcccagtctagtatttctaatatgtttaccatttgtatttatccttgaatccaactgtgaagtgatggcagaatttttaaaaggtattcaaaataaagaaaaaaaaatctcccttgtggtgattaccaatccaggtagaaaaagctcagccctatcctgaacatgttatttaaaagtctcaaatcacaacgtcacagcaggatgatacctgtgtaatgaatcataggacctgttgtcaaaaacaatctgatttttccttggagaatcccgtctatgaaggggaaaaccattgaaagggatacacaatagaactttaaaaaataattctcattatgttactgttttataggttgttaatagcaaacaaaacaagaattgagtctattaaccttaaaataaccaatttttccccaataaaagatattttaagattacttttagttatgtgaagataccagttacagaaaattttaaaaatcattacacaatggctactttttatataggttgtaggcacagtaagtatataaaagtatacaaaattaactcttctcaggaggcatgtaaaggactagttttcccatcttgaatacaagatctgtaaggtcttaataaccacagatgaatgcaccaacttcccaaacgttataatccagtcatagtttaaagcatttttaaccaaacagtcttgcttttactctgacatattcacttaacaaatacagcaatatgcaatatctcatgcatattatgggacattaatccatcttaccactaacgtaattttgacaaagctattccaaagagaaatggggaccttcactacaatgcaaggataagacatacttaatacacttgctttccgaaggaacaggagagataacttaggaagaaaagcaatatagttcttactcttttaaacatattttaaaaatcctttatggtttaaaacagcttttggtgaaattttaaaacctatatatcagtagttggatcaaatctatcaaaagatatatgagtggtcaggaaataatcaggagttccagaatttctattttgggaaagggaaggaaaaccacctaacagaattggaacatgattatggtgcactactggatattaagaatcaagattcaactcatctatataaaattattttcaaaatggtgacctttagagcacttattaaatttccaagtctgaaaaaaaaatctttttttccctaccctggaattaggaaaaataaaaaaatctttcaaagaacaacttttcctttactaaatggaccaaatacatcaaagaatgtattccatttggagaacctcgtccatgtcccttctaagacatgacttctgccatcaacgtaggcttagcttttagttcactgtgaaatgcagatcaatgaagcatgatgaagagaaaggacaaatgacacatgacaggtctgcagactggagtgcaatagcgcgatatcagctcactgcaacctccgtctcccaggttcaagtgattcttgtgtctcagcctcccaagtagctggcatcgcaggtgtgcgccaccatgcccagctaatttttgtatttttagtagagatggggtttcatcatgttagccaagctggtctcaaattcgtgacctcaagtgatctacccaccttagcctcccaaagtgctgggattacaggcatgagccaccacgcctagccagctccttgttatgggcttaataaatcagcacttcataatgtgctactgaagaaaatccgtaactagtagagatgtgttagaaggccatctcagttaggagtctgagaaacataaatgtgcaatttttctactctactgaaaacacatgtccaccaaaagcaattccccctttcttctaaagtaaaatatgatcatctttcaatcacttagaaactaaaagcttttatacattccaaaaggcctagtttctttgtggagcttaaacaattgtgtcactaccaaatcttctttcctactagcagaaagaaccacataggaagccaaatccaaattcagacttagactaacacagaacaggtctgtgataatataaagtctatccctgtacttatctttattaggtttctataattagagtcaagttgctttttacgagacaaaaataaggcaaatagctcagaaagaaaagacaaaataccttttagtttctaaatacatactttttttttttctgggaaaaatacaagtcctttaaactgtctcataaaccaagaaaaggtttcatctatgttcaggagctgtgatataaatttagtcatgaaaataaagtatgcctagctaaaggaagaacaaatttgcctaaatatgcccacatgtacttgtagaaacaagtattaactagccttgtttctggatactatcttttctaacttgattacacttacaagtttcaaatgagatagggaaatacatgtttctactttacaaattcaaagatgtatgttttattttgctctcttttctctccagctgatattcaggtttaaaaaaggctccaaaaattatatatatacataaatatatatacataaaatctatgtcattggaactaatggggaaatgtgactatatactatagtagataatattattgcttaatgttaaatttcttgagagtaataatggtattgtggttacatagcagatgtcctggttcttccaaaaaacactgaagtatttagggtgaaacagttcttatttgtgaattgctttcaaactaatcagaggggaaaaaagtgtggataggtagatatttaagacaagtggggcaaaatgttgacaactgttaaacctaggaaatgggtatacgcatattcactgtactatccttttaatttttctgtagttttgaatttttcaaaatacaaattgggaaaaagaaagctatcttaaaatctcagatcatctggttaataaatgtagggtagaatttatcaatcactagtaatgtagatgagtaatatataatgaggcttggtggttgtccaatactaggaggatcacgagagttttatgggctcctctgtataatttcttaccattcaatttttttctacactaagaatgcattaatttttttttatacaaataaaatataaaacttagagaaaaaaattgatacctggagataacaggtgacttgctgccattcattgtatttgttctttcccaaggttttcttgttggttctttaaaaataaaaaacaaaagctattaaataaataaatgcttccagagttattataaaacaaataacaaaatactaaatctcattatacctgtttacatagtagtaatataaataaaaatttaaattctaaactttaattgaaatctgtaaggactctaatttgcacaatgccagaccttaaaatgagaagaaattataagctagtacagtaagtttccaaggaaaacttacattgttaagtctaaaatattatgattctataaccttaggatagtaaggagtttctctaacaaagaaaggacagtaagaataaagtaggataattttaaaattaggatagttcaattaattaaaatggaatagtattaccgacactgttttaaattattttttagtgccaatgataaaaacagtaagtataacttataatatgttcatgtatttcaacatttaatctaaatccaaatagtccctcttggggaaaaaaataggaacaactcaaaataaatatcagaatcctgaaattctattgtacttccttgattcttaaacaattaattcttgggccttagccgattattccagttaaatataaacaagctcgctctaagctcttattacaaaagacactatgtagtcagtgactcactagttggctgtctattgtgcttgaattgtttttctaatctgggctgactcactgatgctgtcactggcctcactacatgactgggtaaaatcagaagtggaatcttctcatggaggaaagaatttgggccacaggagaatgaagtctattcatgaattgtgatctcattgtatagttttaactaaaactgctctgagttccaatgcagctcctcagctggcttttgcacattctcaggtagcttaccgtctcttcaaagtacacttaacgcaaaaataaactcacactcttccatgaagccctgcttttggttctggatttcttgttgcatgaaggcattagatgtgaaaccttaaagtcattattgatcttgctttactcctcatcaactaaattccttcttttttatattccttcttttgtattctaacagctaacacagcctctcaatgaccgccacagtggtgtcaagttccacacttgaccaggaagatcaaataatcggatggggtttgggacaggccgaatcagaaacatatccaagtgacaccagcccaagcaggtgaaaaaagggaagtcctgaatgaaactgagggacaccgggacagggaagggaacggtcatcggacactgtcactaaagaggcggcgggtggaaggatgagggagtaattccaaagtggttaagatgtagcaagtgctaccttttaacagctggctgaggtcctttctcaatcagccaaaccagaactatcttttagtcttaaaagggctcatctggttcagctggccctgtggaagctgagaagcaagggcctcttctctctaaggagctcgggtgtgtttcaggaggggcaaggctgggttcccttcagaggatctttactggcatgcgtatagagcttcctaattggtctgcctatcttaatcctccctagtttcaatgggaaaatcacaagtgccattttaatgtgcctcaaacagtttcagtggattaaatgtccactgaactcagtacttgcaggataaagtctaaactcttgataattttataaaaggctctcaacatttttgtttctaactcatattttcaaccttttccctacaatattcctcaaaaagaattccccgttctagtctatttcctatttcctaatctcttcttgctcatctccaactccataccttgctcatgctatacttacatcctgaaatatcacaccttcccctcactttcagccaaactaaatactcttcaaggaatactaagatgtcacttttccctacaaagttgactcaggtgactcgtatgtgtcatttcctccctctgtgacacactacttagtattcaacaagtggttgtaaaaaggttaacttcacacctgtgtgtctcatcttcccagctgtaccatgagtttttttgggcttaggacctgtacctttcacttcaggtgcctgacacaatgtcagtttaaaaacggaatgaaacaagtgagaaaacaggccctgccctttttgattttatatatatgacacacacacaaaacctgtgccttagtttttcatattttatataagggattatatattagataaggaatttttaacttggagtccatggataaccttcaagaaattcatgaatattctgaaattatgaacaaatctgaataaaaatacaattttcctccctggaaagaggatctatagctctcatcatattctaaaggttctgtgagcccaaaatatggttcggatttacaacatctatgcggtactaatgagagtacatacaattaattttggcttacagaaagaaggataaagctaaaataagtgggtcacaaaccagtgaatttttaatgaaaataacaaactgagtcctattcagagggaaaacaaagccatgatgttaattatggtatagcaatcaacctactgaagagtcaccatttaataataagaatgaggaatggggggagtggtgaaaagatggattacaatcacaaaaacaaaaacttcagaggtacttaaaaaaaaaaaaaaaaaaaaaggaattctaggtggtgcactgtggctcacgcctgtaatcctagcactttggaagactgagacaggtggatcacttgagctcaggagtttgagaccagcctgggcaacatggtgaaaccctgtctctaccaaaaatccaaacaattagccaggagtggtgccatgtgcctgtggccccagctacttagggggctggggggctaaggtgggaggatcacttgagcccaggaggtgggggttgcggtgagccaagactgcaccactgcactccagcctgggcaacagagcaagaccccatctcaaaaaaattaaaaaaatgaaaattaaaaagggaactgtagatgcagctggttgtctttaaatcaaaactgtaggaatataagcatttctctataatggtttcttatggaccactctagatattaactcatcaagtttatttatgtcatttcattccagaatagataaggagttcaatagatagtccagcccttagtctttaatcaaatatgaagaaataacatgtgaatatgtaatgagttcgtattctcatcttggatacagtactcatcaagtacttctagtgaaatatacttttgttaatattctaggtgatttatcagatgctcaagaattctcaatgtcagaaatttcactgaattcaagaacacttccccaaaattttaaggagactttttaagtttacaaatcagaaactttattcccttaattatcaatatcacccaaatgaatggctaggacatccttctcaatttgagaatgttctgaagcagactgtagtactaactaacatgctcactttatttttacctctagaaaaacaattatgaaaaatactcttgtcatctaatagtacattaatattttccttgttttagtaagtaacctcaagaaagtaacagcagcttccaggaggaaaaaagtgaatgctttcaggtgggaacaaagaactctggcattttagtgtccagtcacttggtccaaatatggggaaagggggaatttttaactggggagtattaatatttagagaaagtttataaaggttaaaatatttatcttgaacttaccaggtgtacttgttgaagaggccttagaagttacaggctctgaatcttcctaaatatacagatatatattaatatcacatctaccagtcccctgttgctatatacatttagtgttttacacgaacacttctaatattctttctgccactccccactttctctttcatcggtcttctctccctttcatttcagcttagactttcttctcctgtcttcaaccatcttcccttcaaccctccccacagctcctttcctcatgtgttctccttgagaactttcactagccaatgctacaaagccagacacgagagacagatttgaggaatggcatctaaggtggccagatggagcagggggaacatattatttgttgcacaccaatatacagcacagacaaagcagagtttgcccagctgaatcagggaggagggcatgaaggttacactctgaaggggcacagccaataaccatcaagctcctaagggaaacatatgaatttaggcgaattccttccttttaaattaatgcaagggaactgagattctaagagatgaaaaaagtagtgaaatgtcattcactcatttaaggaacagaattaaactccacaggtttgaacttcaatgcttttcccataatttcacatattcaactcactttactaagactgccattaaaaatttataaataacagtcaaaacaagccacttcacatgcatagttaaaaattagcaaatataagttcaaactaattaagcccaaattaaataaatgctgacactatttcctgaatgagctgtgcctgaattccatattttaaggtatggtagactatctttattaacttacacctttgtcctctttttgttctgtttctattgttgatcccttttcagcaattcttctcctacaaagaaggcaaatccgatttttaaaaatattatctgattcagtataaaaaccacttctctacgaggaaagaagtgcatctagttagttgtatttggaatacaattaaaatcctctcaattctgggcatgtccattataatgaaattccttacctcctggccagcagggcactcatttcttccattaaaccactaccccctaaaggaaggggtccatttccacggcctgtatctgttttagatgaggcggagttcacaccaatagcattccctccacttgggaaagaggtatcctccatcttaatgagaatatacagacataatcaactcctatgttagacaaccatatttttattaatatattacatctaaaacagaaggaaacatcagcattaattttaaaaaacctaaatattattttttaagctttaagaaccaatagattcttagcatgactttatatatcaacaagagtttatcaaaactactatcaccaagaatgcaatgaaacagtatcatgtatctcttcctgtgctgccatgaaaagggcatgactttgctctgataatattcctgctaaaacaacccctgcataactagaatctaatcttgaggaaaaatcagataagccaaagtgaaggataacaggcaaaataattgtcctacagtcttcaaaaatgccagtattatgaaagattgaggaactgtcataaagtatatcaaagagacattataactaaatgcaataaatgatcttgcactaggaaaaaaactgtcactaaagatgtcattggactatagatgaaatttgaataatacatttgtagattacagtattctatcatgttaactttcctgattttgataattatattactggttatgcaggtaaatgtccttgttcttataaaattcacactgaggtacttaggaaaatagaagcttgtgtctctgagttactctcaaatcattcaaacaaaagtgcatgtgtaggccgggtgcgatggctcacacctgtaatcccggcactgtgggaggctgaggcgggtggatcacctgaggtcaggatttcaagaccagtctggtcaacatcgcgaaaccctatctctactaaaaatacaaaaattagctaagcatggtggtgggtgcctgtaatcccagctactcaggaggctgaggcaaaatcgcttgaacctgggaggtggaggttgcagtgagctgagatcgcgccatggcactccagtctggataacaagagtgaaactccgtctcaagagaaaaaacaaaaaaagtgcatgtgtaaagaaggaaacatatccaaagaaggaataaaaaagcaaatactggtaaaatgttaatgggtgaatgtaggtgatgaatttatagaaattatttatactattcttacaacttcactataaaaatttaaattatgtcaatttttaatttttatttattttattttttgagacaaagtcttactctgtcacccaggctagagcgcagtggcatgatctcggctcactgcaacctccacctcccgggttcaagcgattcttctgcctcagcctcccgagcagctgggattataggcatgtgtcacacatctggctaagttttgtatttttagtgagatagggttttaacatgttggccagcctggtctcgaactcctgacctcaggtgatccgcccaccccagcctcccaaagtgcagggattatacaggtatgagccattgcgccagggtaaattatttcaattttttaaatcaatgaagttcataacatttcataaaattagaatacaataaattcaacattttagatatttaggaagaataagacatattaaaaaaatttttcagaaaggtatttacccgtgacactttcctaagttttgctccggcaattgcagctgcaagtccagttaaagggcgattgtcttctgacatggatgccaaaaagaatccagatgcagggaggggtggggcaggaggtggtggaggaggagggggtacttgattagggagaggagggggaggagggggcggtggaggcccggtggatgggagtggaggaggtggagggggccctgggggaggagggagggctactgaagcctgtgcaggccctggtgggagtggtggaggaggtggaggtgcaagtggtcccaagacaatgcctgagagagagaaatgttaagtaagaccatcaacaatagagctgagtgatattattttatgtgggaaggtacgcagaatgccatgctaaattaaactgactcatgtatttacttaatgagtccaatttatcatagttgtaaaagtctagatcagtttttgaaagatactgaaatgtaaggtccaagtatatataactacttactttaggttagagctttagtaatagaactatgcaacagatcatctaattaagacttttttttttcatggggatttggtaaataagcaaaataaatacttataaaatttggaagagaggtaagcgtccctgaaaaaacaaactagtatataggatggcagttagtactacttgaaatatcagacccaaaataatccacattaaccttaagtgttgagacagtaaattcagtaacagtgaacacatacatttaattgtttacagtcaaagtggctgtattaaaaacatgaaggaggagtaagtcccagcttcagcattttaaaaaatacttcacatttaaattcaatggatagccaaggctgagaatcactgaagtaaaggaatttactagtacaaagtaaaacctcaaaataacgctcggaaataattaaataccataggatttgaagtagagttgtttttatcccacaaaatggggggcaagaagagaaatgttcaaatgttataaaatcacaaagggagtgaacaagaatttatttaataacagaatcctgaaacagtaggtgctcttttagttaaggtttaagaggggtgttttcagaacgaataaaatgctattttgcacactgggtggtaattgctaactttttcagcttgagcagttacacaagcagaaaacatcaattgttaaaagaagcatctagaaatagtctgtcccttctgtaggggttgttaagagttctgagggtacagcaggtcactttgtcaggctgactgtgcccattttgtacagtataactgtcatggtgaaaccaaactgaacgtcttagaattctgactaaccttttaagcaaatttgtaagtcaacaacaacaaaatatatacatatacagcaataacaagccttgcaatgtttaagtacaaatttgttttcagttttctttctgtagtcctccttaaatcatattttaaaaactagggttgccaagcatcttcttatttacttacagaaccaggtccttttctacttacaaataatccacttagagattacatcctgccttccctgttaccataacaataaggtagggacggggagaataactacagaggatgctattctctcttgattaccccttcaagccactacttattgtaattttggaccttggaaccctttagggcatatatgaaccctgccatcctctctactcctcctgcaaagtcataatgctccaagggttagggtgacacctatcctggaagtccaacatggggcatctaatataggaaaggcaagaaggaaacagggcccaagatcagaactgttccaaaggaaactctgggatgacgtatctaatgactacagttgggcactaaatatatctctctaagtctcccagaaaaatgaaggaaaacaatttagatcatgtatttattgtgtggtagatcaacgtgtcaagcaaagttttcccagtgaaagacatgtattagctgggtgcggtgctcacacttgtaatcctagcaactttgggaggccgaaggggcagatcacatgaggtcaggagttcaagaccagcctggccaacatgacaaaaccctgtctctactaaaaatacaaaaattagccaggcgtggtggcatgtgcctgtaactcctgctactcagctggctaaggcaggagaattgctggaacccgggaggtggaggttgcagtgagctgagatcgtgccactctactccagcctgggcaacacagcaagactctgtctcaaaaaaacaaaaaaaaaaaagaaaaaaataaagaaatgtattatgaggggctcttaaatactagaaaacatctttaactgcgatactataaaagatatcaaaacctagttcaataaggaaattcctccaaatgcaattaatccaacaggaaaaacatttttctactttaatttttttaattaaaaaaaaaaaaagcatggcattatggcatataaatgttcaaggatcaaaaccatcctacccatccattcaggcaattaaagtcactgctatataacattttcaagtgattagctgttagtagcaataatgaaagccttaccctgttgggatggagtctcggccggctgagaggctgcctgcaagcctggctcagaagcagaagagtctcccagcacagagtttagaggagtctcaacagaggcaggggcagctgcagagggagaagggagaacactaggcttggatgagggagttgaggcaataggggtgcttggaggaggagaagcttgagatccacagtgtgagagtgatgcgagggaaggcagtggaggcggcggcggaggagctgctggccctgaggtaggcggtggagacactggatatgttacagagtcaaccagcccattgggtgctgtcggtgatggaggcatttggggcacaggagaagaaacacaaacagggaggacaggccttggaccagtagctttgcctggggggctgctaatcattattggaggagatggagggaggggcgaaaaattggaagtagaccaggcacagggcttcgtagctggaggctgagaagagggtgtgttcacaggagaagaaggtcgagagtttttgttcagaggacgaggaactgtagcgtaatggggaagaacagggtggaaggctgaacctaaagatgttgcaaaacgtgtcgctgagtgtcgcagtggtggtgtagggggtgtggaagtaggtggcaaagcagtcactacagcataatcaggagtggcatctgacactggagctgagatgactttagcgtatgatggaggaggtgctgaaggaggctggcaactggaatactcaggaagtggagcgttatacagggagctgtctgaagatggagctggacagaaggtggaaagcagcagcaaaagacaggataaaaaaggagagagaaaaagggagctagtgaagccacaaaaccagcattcagacacaatgtataaatgtagactacagttagtatcagagaattaggcacaaacgcaaataactattttcacccaagaatattttaacttgtaaatacattttgagattcagaaggggatgaaataagtttccttttatctaataagtggattaataaatttaattgactaatttcttttacaagaaaaagctagtattagtcttaatttttatttagtctacaagaaaaaggacattaaaatcacatgaataggaccataaacagaagaataaatttagttgtttttttaaaaacaacaaatagcaaaactagtaaagctggcaaaacatttaatatgaagggttcaatgctcctattcaatgctaacttgtggaaaagttttgttttgttggccataactccagaaaataattaggtagctaaaaatacataaattaacttaataaaccaaccaaccaaccactgtttaatcaaaccacattaagactttttaattaggccataaggaatattcttaaatcctataatgaatgttaattttaataaacgttaaaatatctcaaactttcagccatatattaacccttatgtctttcagtaaattccagattccataattttcactaatttttcataatactagaaagcatatttaaataactagtcttagagaatatttctctaaaataattcttcctccaaaatctttagaatgcaatcaagcaaatttcttgctgaatggtactacagtactatagtatttgagacaatttaagtgatctcatgagggaaatatatttgaagttcatccagtataaaaaatttcccataaaaacacacttacactttatagccattttatagggtgttagaagaattagaatggcagaataaaaatttccaagagctttctttaagtctccaagcaataaaagcaatacagagagaaataaaaagaaaatgttaaagtagtaattgctgcatatttattcataatttcaaattgtatggcttaatcccaaacatctcaaatgtgaaatattttaacacatgactgcacaagagacatcatccaagctcagatacaagaacacagaagagtttgtaaacttcttaccagcacttgatattctgcgctctctctcccattccagctgttccctttctaactgctcttgtcgctccctttcttgcctctcccgttccagtctctccagcctctctcgttcttgtctttcttgcctctcccgatccaggcgttcctgccgctccaggcgttcctgccgctccaggcgttcctgccgctccaggcgttcctgccgttcccgttcttgtctctctctctccagctgttcttgttccagtcgctccctctccagcctttccctttctaacctctctctctccaacctttctctttccattctttctcgctccagcctttcccgctccagctccttttgccgttgctgttcttgtagttgtctggaaaaaaaaaaaaaaaagtaaaaacatgcatctatggctactcatcatgaaaaagcgattcttttcacctatgtaaactatttctgagtcaaataaaagcaatgtagagcatgcaaacatctctcctcccacatgaaggctaccttggatagagactgtttcatacaaatgaaaatcatttctcctattagcatcatattggctgaatgcttcagcacattgcactaacatttcattttattctgtacttttcatgagtagtgttgcaagtaaatgaattttccaaataacataccactttaataaccaagtcattattttaattatttagtgaaaacatttgtaattgtaatatccttaatatcaaatttaattgtacaaataatatttcagaaaatacaatgactggccacagcaatagctcaataaatatttactgaatgggccaggtgtagtgactcacacctgtaatcccagcactttgggaggccgaggcaggtgcatcacttgaggtcaggagttcgagactggcctggccaacatggtgaaaccccatctctaccaaaaatataaaaaattagccgggcatggtagcgtgcgcctataatcccagctacttgggaggctgaggcaggagaatcgcttgaacctgggaggcagaggctgcagtgagccgagatcgtgccactgcactccagcctgggtgacagagcaagactccacctcaaaaaaaaaaaaaaagtttactgaatgaaaaagagtcaagaaagaagaaataaactttaaatgattgaaatctcatatccagaggcaactatcatcaacatatgtatataaagacacacatctatatatacacatacgcgcacacacgcacccctatatacctctagacttccccttgtgtaaaaatacacatataaactttaaaaacaaaataaaatgtaaccatttcccgctactgtgaaatctgctttcctttctctcacttaatatattgtgaaagttggtctgggagcagtggctcagctgtaatcctagcactttgggaggctgagtgggaggattgtctgaacccaagagttcaagatgggcctgcacaacaaagcaagacccatctctacaaaaaattttaaaatcagccaggcatggtgccatgcacctgtattcccagctacttgggaggctgagggagaaggattgcttgggcctaggagtctgaggctacagtaagataagattgcatcatcacacatcagcccaggcaacagaatgacaccttgtctccaaaaacaatgaaagaaaagaaaggaggaagcggggaaggaagaaaaagaagggaaggaagggaggaagggagggagggagggagggagggagggagggagggagggagggagggagggagacataagttagtaaaactgaggatatctgggatgagaacctgcctgtgtgtacaactctggatggacacacgcacgcgcgcgcacacacacacagagttatcctaaggcacttagttcagcatctttattttccatgagtgcataataatattcgattattttgctgtccacagtctaagcagtctcctacagtaggatattaagttatcctaacactattggcaatactgcaataacatttgtcttcatctttgaatctttttctgtttctataggatcaataaggacataaattttgctaggtgaaaaggtatgaatttaagatttttgatacatggttccaaattgtctttaggaaaagttgtgtcaattaaccttccctaaaaaaaaagttatctttgccaggcacggtggctcatgcctgtaatcccagcactttgggaggccgaggtcaggagtttgagactagcttggccaacatggtggaaccctgtctctactaaaattacaaaaattagctgggcgtggtggtgtgcgcctgtaatcccagctacttgggaggctgaggcaggaggatcacttgaacccggggaatggaggtggctgtgagctgagactatgcccctgtaccccagcctgggtgacagagtaagaccctgtctccaaaaaaaaaaaaaaaaaagtatctttatcttacacatacgtatttcatagcactgtggggaagattaaatgaagtaatacctaaaagctctttaagaagtacttgaaacataagaacgttcaatgtgggctataacgatagtttttttgttttgttttgttttttcttccccgagacagagtcttgctctgtcgcccaggctggagtacagccatgcaatcttggctcactgcaagctccacctcccaggttcacaccattctcttgcctcagcctcccgagtagctgggactacaggtgcccgccaccatgcccggctaattttttgtatttttagtagagacggggtttcacagtgttagccaggatggtctcgatctcctgacctcatgatccacccgccttggcctcccaaagtgctgggattacaggtgtgagccaccgcgcccggcccaacaatagttattatttggaaatttcaaattgggactttctggactggctaataaactgggtgggtctagttagagacaaagctaaatgacagcacatgcatgctatccctttgttccttccagcggtaccaacacaccagtaagatctttccaaaaatctctctccttcatgtttcctaagctggctatacaacaaaagaaaaggcccatttgacaaatacatcaaccccactgctctcataaaacacacaccctctcctggacataccatcacacttaacaatgactgcaagagaaaaacacaagaaactgactttatttatgagtagttatttatttatgagtagttgtttgagatactgactactaataaaatcagattttcaggatctagtacggacttcattatgctatttgataaatcactagctgccaaagtttttgagggataacaataactttatctgcagggatgaggggaagaaattagatgtattcaaaagaatgtttttaataataaacagaggaaagtcagggttggttgttgttgtttctccagtaacctgcagttaataaactcagctggagcctgtattaaatttcagataattcaacctacatcaaaaaatatgggccattttacatataatgctctaagcaatctgttgggcccaaagggcaaaagatacacccatattattctaattagaacaaatttaaatacagaagctaaagagaaacatttaagagcacagtagctgtcccaagaaatctatgatgaaaagatctaagtttttagatctttgagcatttgttacttcttctattttaccaaaacaacataaatatatagtttttaaagtttataacaaaaatcagtagttcactgcctcaaccctcccacccgtttcctactcttgcagctgtttcttacattttagcttttgctatctactttctaacaggaagatgccttctacaactccctcactacactcatgcttctcccaatatggaaaatcaatattcacagcttacattattaacatgataatgtaaatactgctcacagctgaaccaaatagtattctatgactacatttcatttctcattcaagttcttagtagttgggtttttttttaaccaccaagttaatggctgtttctctaagcaatacaatgcttttaacacacaaaaagtaagcttaagtcacaagcagaaggccaggcatgggtgaggtgaatctgaaagaattattggtaacagcatttacagctaggttgtattgacttaagaagtttgttccacatgtcatcatattccagggttttcaggctataaaagataaggagtgtctactgatataggaaaaggacacaatgctggagaatatttctaagttcacagacagatgattcaagcaggcaattcatatagctgcaggagattcttactattttcttgttctgaaggtaagaaaagaaagtgttgaacactttaagctaatttttagcttgcttgctgaaaagatgcccatctaaacggatttcccaaaatagtgattcaagcagaaaatctctggcttccgaatcttgtgtggcatgaataattcccacctaaattggatggtttataaatttgactctcatgttttgacctctaaagcaagacatttgtgtagctttctaggaggagtttccaaatttataaactttgcttttcctcagaattatcgctgccaattcacatactggaaatgcacatggctcctcttcctagagttctctctccaactgttttcttcagtcattaatagaatcgtctgaggacttttttcaaagaaagagtgccttaattctgaaccatgaaaaatcctgacggactactttaatttttcttttaagctaggcatatatattctacaataatttgaaagtttctgagaatataaatttttttcagaaacaattatagtgcaaatcaccaatattattttttaagcatttaaaaaatatcagacacagttcctccaccacccaaatacctatttctctccaaaacagctatccccaaatgtaaatagatgcacaaagcatcagcccacattgagattaatagctttttaaatatatattcattatttagtttatgttgactcaaagacatttcttgaagcaagtaaaatgttaagtaacatcagttcaaaatacatttcacccagctttacctataatgaatagtgttactaggtaaataagaatgatttcaattttaacaaaatgaagtaggaacagtctaggaaaaatgttctgagttggtaatatttagtaacactgttattattgacatttctcagaaaataaaactacacagatacagtttgattgtataacatgagcatttcacttcactatcagtaaacaaataaaaaatggataaaatgtaataagacagctaagttttaatattacaaagccgctgaggcaagagttgatactcacaagagaaggcggtcaacttttggtccatccggcctccgaaggccaataggagggctatacactctcattgttccaacattgttccaactgctcagttctgtgccgcaattattattccccttttataactttcagatagtactggtgatttgcgaactatttatagatattaactatattaaggttctatgtggagactaacataggactgactcatgtttcttagaatatgtttcctcatcatggccaagccaaatattaattatatgagtaggaaccaaaaactatttaataaatgatataataataaagggtattggactaataagaatgaacacttagacatgtgctctattgactctacatttattaaaaataaaaaattaaacataacagtagtaataaataacttaaaaagccaaattatattataagacttagaacagtaatcctcttactaacgctcaccacttctgattttgctccccagaagcaattattttcaatactctggtacttatcacatgtttctaaatacagtaattcatttagaactattacttctagacttttcatatttagatgttatctactgacttcctactatacaaatgatttaattcctatatctctagctccccaaaactttttcttctccattttcccaataaactcataccaccactttggatacaccaatattcacatatcacataattcactgctgatcacatttactttctagaacaatttttttcttactttggtgctaaaaagtagtacttttaaaaatttgattctttttctatatacctgtccctacttcaccccaaactctccattagaactgtaatccctatcaacatggtccaacatagcagaaccacggtcaggtttttctattcttttgttttgctttccctcagaaactacccgtcgggagccttcagccctcccagcgcccccaaccggatgggctattccctaggttttgctttgaccttagtcgtgcgggaattacctatctctttcctaagttggattccttgtctcctggatgctgtcatgggttcatcattcttgctttactccctcatcttaacagaacacatcttccaatagcttcttaggaagttgtgcagaagaggagattttagactggaaagagattctcttaggattttgaagctcccccaccttgtcactcccaccaccccttaccaagcatttgaaatcttacttattctaggacaacattctaaaataccatagtgagaggtcttggtgggaggtctttgtttttttccccacttactgggctggacttttggtgagcttttttgacctaaaccagaagctagcaaactgtatacagccctagggccaaatctggctacaaccatttatttccgttttgtctatggcgagctacaaaggaagagtctagcaaatgacacagatggcccttcccagaaaaagtttgcggacctttgatctagacgatcaatgagttccagcaaattttcttgttatttatttgcaaattcaatttcttcacgtttttgttctccttcccactcccccagaacttctattatttggatgctgaaccttctaatctgatcttcttactttactttctttctcatatgccacctctttgttttaggactattttcagagaataaattcctcaaccttagttctcaaaacttctatttctttctttctctctctctcttttttttttttttcttttgagacagaatcttgctctgtcgccaggctggggtgcaatggcacgatctcagctcattgcgaccttggcctcccgggttcaagcgattcttctgcctcagcctctcaagtagctggaactacaggtgcatgccaccaggcctggctaatttttgcatttttagtagagaccgggtttcaccatattggccaggctggtctttaactcctaacctcgtgatctgcccacctcagcctcccaaagtgctgggattatgtaagccacagcacacgcccttctatttctcggcggggaaaaaaacagtgaggtggtttttaaaaaaagtttccaagtttactttcttgttctctgaatgatccatttaaaataactacccatttttatttcatcaatgaaatatattctcctagttctctgaagctattgcagtatatttttaggttttcttccgctccctgcattgcatctatttcatacaatttcaactctttgttttggtccttcttttatagaagttggcctgaaaggtttgatgatccttggctgtctgttcatatttataagcagcaccaaagttgatcagaggcccttaagtaaatgagcttcactggcaaggacgagtgtcaacatctctgtcttctcttggccatggcaattttcccacagaggaatcttagtttcttgctgggctctacaggtctggctgccagcgtctaggagctgagcaagggaaagaagccaagttggccaactttcacctaatccctcttttcatttggcacctcacccacatcctcacagctgtgaatttataatgcaaactgataatgtttttcactacacgttccagtaatagtatagaaaaaggccagttaaacagccaaagttaacaggacaatttcactcaacttatgaagtaaaaagttggcctgagggtattttattgtgcctctgaagattaaatcaagttttaaaaaatgatttttatataaataaccacatgaaataaattttggaaatataatttctactgggaaccaaacttcacactagactgtgctatacatccttcccgtttgctagcctacacaaccagatccagccatgcactactgtcagctgagagaaagtgaaaaccagtactaagtgtctatataaatatttagtagatattttagagttttgtagtatctttttccaagtatggtttaaccacaggcaaaaacagattgtacgggatatatgtcaaagaaaaatgacaaatatctcttttataattgtatataaggcccttacaaggtggacacaacctcatctaaccataccactggtcctggagggggaaggaggaagcgtactcacattgcacgtgtgtttgcatcgccttgcctttacacacctactctttcttcctggaatgcttttcccttctatgactggaaactcctactttattgcctctttaggcacagctcaaagagcacctcctccgtgaacctcccaccaactcccaaaaaacacagaaaatcctaggcagcaagaaaagagtgtgttatcttaatcaactcaacaaccttcctaggtaatgtcttccctagcacctgggaagtctctaaaaggccatttaccagctaaacatcagtaatttctcctctaaacccataggcaaaagtgaagaaaattaccacattaaaggtcaaatatatactttctgtcttataccccaaaacctgcatataaattaattcagtaccagaaacttcttaactttttattagaaattttattgaggtttctactctcaaattagcccataatgttcactgtggaggtaatactcaaatgtaaaataaacacgtaggaagaaaatacaaaacactgtgtgattaagttacaggaattcagaaaacaagaacatcagtgtgcctggagaagagtctacagaaaatgacaacgtagaaaggatatgagaaggacatgtcagaagaggtgaatgctacacacaaacacagagcgaaagatgagtatggtgtacacagagacagtcatgagggggtgaaacacaaacatggggtgagttcctaaatgccaggccaaagaagtaaactgatgtgaggagaggcagccataaggaatgctgagcagggagatgacaagacaggagtgtctggactcttattcgggttggtagattgaggagtcctgtaatcttccccaaaattctactaaaattccagaaacatcattaaaatgcatataaataaacccatgaccaagtagaaaactgaaggtggtggtcattagtagggcaaatttatcatgagatttccggaagacagaaagggtaggagttatatgtttagaattcttccttagtctcctagagactaatattcaacatctctacttacatgtccagtaaaaatctcaaccaaacatcctcaaaattcatttttgacatcccccaacaagacctgctctacgcagtctttcacaactattgatggcaactccatccttcccactagcttagcctaaaaacctcaacccctctccttccctcatccccaccatacaatccaccaagacatataaggatctgacttctcaacaaccacttctatcacctgggggaagccaccattatctcctgcctagttcactgcaacagcctcttaactggctttcttgttgagctgctgtcacaacactgcacctgcctcaagtcgtctctcaatagtgtaggctcaacagagcagactgactgattctgctaaaattttaagtcagatcatgcctatgttcaaaactgtacaatggttctcctttctctcagagtaaaggttaaattcttcacagtagcctgcaaggtcctgcatgatctgacctctactcctaatactctcttgtgctccagcctccacggcctccttgttttcccatgtacacacaagcatcatccttccttaaggcctctgcacagaatgcacttacataggtatctgcttggttaattccttcttttcatctcaatgagatctaccctgaccactctatttaaactcacaagtactgagactgataagtaatggacggaaaaataaaataaaattacaaccagcacttccctctgccccttcacaacatataatcctccttactctgttgcatttttccccatagcacttaccatcttctactataccatgtcatgtttattgtctgatgagtttcaggctttttgttccctccactctccccacccttcccaatataagtacttagaacaaaaaatgcctgtgacataaataaatggagcagtggaggcatccataacccagaacacatactgaagacggtcaaagcagacatgggaagaggaatctgggaaagatctaacctgaggtcagcaggtagagagaacgggaatgagcagtgccacaataatcaagctgattaataagtatatacactgtctgaagaacagctgtaccagctcctcccctgtcctccccaaccccagctcaatggatggaatggcatttaccacagaagactgttctctaaagaaactgaacaagctgcctcagatgagttggggcttccagtggaacttttagtagctcagcgtttgtgcggttctgaggcctgcctgctcaccatcctggtactccaaaggttagcctgtcagcctacgtactctgaccactttcagagaactcctagtcatggaagaatgctgcccagtagagaatgattttgtattctactactaaaccctatagtaatatctgaagatcaatgtgttacagaaacagccaacaatatttcaactttttagttaaatttgtcacatgaaaatcatagtactcacagatcactttataattacaaaagtaagacttcttgaaccataagaagattttgaattctgttaagcgtatttacaatattttaaacataccttaagtataatttttacaaaaaaaaacacatatgaaattttataacatctcatgtccagcataacaagtatctggtaacttactaatgacagtcacaaaacttactaatgtaagaataaaagttgtgactcttaaacagctgataagacataatctactttaaacacaggatgttcagttttgtcttctgaagcataaagaaaaagtacaaacaataacttgaaaatttaccttctttgaatttccaattcttcttgggatgggccattttgaacttgagcaggtagttgtgagttttgtctaggcaatgttggccctacagagggagaaaacattacagatgaacattattttcatatctagctggacagaggagataaaatcatgagaataacataaaaccatcacatatttacaaacgtgtcttctttttgtctagcaaaataaaatataagctttacataacacagagcaaatgaaagactgcaacataatactgtcatcatctccagaaggcttacttgaaacaaatggaaaacatcaacaataaggaaaaagaaacatttatatatgaagagcttgagtaaaacaagtgttcgatgagcatctgaagaggcacctaagcttgacagtttctaagacaatgagacattctctttggggtaattattcatgaagtggagagggagaacttaaatgaaaaatcagaattcaaaaactcacctaaatagaacactggaaatgaaaaacaggagagagagagagcatgagaaccttattactagactccagtatgctaaagcatttatcaaatttgcccaatttaagctgccatttttgtctaatagcctagcatttccagcactggtgaaaacaaacatttgctaaacttccatatagtaattaacctactgaactgaatttttaatgtaacaggtaattttaagttttcatttagggtaagaagaaaaaaaaacttgcattcatacaacatggttctgtcatgagacactaatgaccatccattcccacatatcatgtacaatgcagacctgttttttgcatcttagatagaatgccactgaattatgggacatcttaatgtcattggatataaaaatcaaatctgtcacaaaatgagataaatactggacctaatatataatacctagggttaaaatagaacaatcttaaagtctaatccagtaaacaagaaagtaaagaaacagtagttatcttccactcttggagaagaatatatgagtaatgacacactacatatatttgtgaattctagtgtaccagcaaatgctcctaacagatattctgaaagatttgtagacaacttaggaaaataagttacgaaataaatgcttctgtgcactaaattcttgtaatctatgggctaattgtgcaaagtattttatactagtggagtagatttcacaaccggaagtaaagatttattaggatgtaatgcagtactggtgtatcccaagtgtggaaaaacagaattaatttgatctgaacttacctactaactttttttctcacctctttacaaatgtttttagattaatcactttatttgtcctctaaagacaaattgatgacaactgcagtgatatatttcattagatttcctaagagtctgctattttgagaaccaaataaatattataaaaaaaaattaatcccatgtaatcaataacaaaaaaaaacaaaacttttgaaattaaatacacacgtaaatgtttgtataaatgaaaatacatgattgctgtctagtaaacagactagaattcttttcttgggaaattaaaataatgatgtaaaaacagactctcctattaggctatacacaaatgtttaatactttacagagaaaagacctctcttctggggacacacaagtgtggggaggggcgggtaaatctgaggtagcatgaaattatttagggaatgtactttatatatccaaagtactaaatgtgagcatttagcatgggcaactcacaagaccattatgttttaactattttttaaaataatgtttacttgagtatttaagttgaaagcctcaggctgcttaaataatgaaacagctgaatgtgagtaggttagacctgtttggcatctacctcaaagaagaatgcaattataccagtcacacacctaggacaggtgttatatatcaaaggtaatattaatggattaaatttgccaattaaaatctcagttttaattcaaatatatagattcaaaaaagacgtcaaaatttcaactcaatcctatttattttatttaacaggtttttaaaaaactaacacaagtttaatgtaactcacaaaagctgagaaaagaaaatcttttagcaatttacagaacctgctttggaatatttttttaaagctttttaaaagcttactaagcaaatctgttcagaaaggagatttttaaaatgtgggtaatattttgtggctgttatcataattataaaaaaaatttactacagtttattcctgcagctgagatgaaaagcttcaaggaagttccttttaaaatggggagaattttgatcctagaacaactcttaacaattcttttctacatggttctttgtgatgataatggatttttgggctttttgtctttccagacatcctttaaattgggtgtgtgtgtgtgtccgtgcatggaatcactccctttggcactttttcacatctacatttaatctggttgttctgtttgtttcttcttcaaattgtcaggttgcagtaactagcacattgaaatttatgtgcatttaaaaattaatacaaacatactataaacattaaaagttccaggtaaatataaatttaaggtacacaattacatttttccttcttgtcaaacattctaatgggctataaaattggtaagtaataccaaaggcaccccacatgacatgaagcagcaactaggatcaggcaaagtctgtcagctgccgctgtatgttcaggaatataaacattactttacacaggtcacattcctaaatgagtgtgttctcataaaatgcaaaataggtactttcataaccatttcagtgggaaaatgacaatattttatgagcatcatgtggtggttaacagccctttggggaggggaaaaagagggaagaacaaccaaggttaagaaactagtgaacctgctttgctctttctatgttatcataaagaatagcagctgtttgagagtttgttctctccctcacagccaaagatagtggctgatcttaatttgtcctggctacaagaagaaggtatatagcaaagtctgtgagttactgtttgtaacagagaaatgtggcaatgtcactgatacagtaccctataaatgattaaaatcagatcaggagactctataataggaactgtatgtcagtcttgccttcaatattgagttttggttaaagcacattccacttactgtcacattttaattttcacaaatctattttcacaattagccacagactatttaaaaacacaggactaaaagacaaatcggtgttattatatacacaatacaatcaagtttaaacttagcaacgtgttaattatattgtttgcacacagttaaattaaaggtaataatggggggaaatctactttttaacacattattttacaactttaaagattcaccttcacttaggtcaaatcaatattttctctgcaattgggtaaagtatccattattctgcgtatggacctcaacatattaaatagaaaggcatacaacattggatgggttttcaaaatgagctaaagagagtcctaataacacaaatatcaataatcactcatgactagttcaaaagatagcccggaaaaacccccaggaggaggcagaaaaatgaggagaaaaagttactgattacacacttaatctgcagtgtttcattgtgggatctgggagggagaggagggatttatgaacagccacacaataggctcactgctgtaactgtgtcctctggaacaatcctaaaatataactttaagtgactaacaaatacattagccttttcttttctttccttttttcttttttttattttaaagaaatttgcaacacgtacttctttgcctaaaccagaaagtacatacattttaaaataattctcttcataggtaaaaaaaaacagtatcattagtattgaggagtcacattaaaaattctgagtcacataaagtacatacacagagctgaacactttatgtaaaattggagcaatactgtatatcatttaataactttatctctctcataaaataatctggctagcaaggtacacatgaatcaaaaaggcatatatgaggtttcttttcaaagctcaagtaattaaaagtaactctttggaacttgggtttttaaaacaaagtttcagaaacaaatggaaataaaaagaatttagacaaggatatgtatctatctgtgtttatagatagatacgtatccttagatatatatcttattctctctaatttggggtggctaagtgacatacctggtttgtccatgcaaacaatacatatatgtgcacacatgtgtatatgagagtgagagtgaaagaaaacactcaataagcctaaattcactcttaagtcacagatttctaacctactgaataaaggaggctgtcaatcagaaatcaacctattaaagcaagtaatagcttacatctgcctcacaacatgcacacctaaaattaattcaagttaagcaaaagtttcctttgcacaaggcacatttacgttcctcaaatcatattaagatggacataaattttttccttaaattctaaatcaaaaatttgctcccaaacaaaataattaaaaacaaaaaagtacaaacaaacaaaaacccctctcatttgtgttggaagaggtggacaagaagtgttttaagatcctaattctaactaattctaatgctcgctaacaagccaactcaaagctgaccaaatcacctacatgaaccacaacaaatatcacaacataaaaacaatagcttgctatatatcccaaatatcacaaaccagactatggcctaagaaaacaaaagttatggaaatgcgcaagtagcatgtaccacagcttgaaaaagtaatgtaaacataatgttgcttaccacagaaaatacatcgcaaattagtgctgtcctgggtagcagtaaccttgctctgggctgcaacagacaccttggtgttagaagcttcgaaggacaacggggccatctgaagaacttcacataaactaaaaggtgctttgaaatgttcaaaatgtatttatacatacgtcctatctagatcctcatcctggaagctctgtaatttaataaaaacgcatcctctttaacataggctcttaaaaaaatttatgcaatcgttttttggtggaaaaaccctgtaagcagccatagatcaaatgatgcacttataacttagttatttcctaagttatacggtcaaagagtgcaaccagcattttagggttatatatttttaaagtcaatgaagataaggtagaggaagccaagatctgtggctattagtgttaatttcacaagatctatattctcatttaggagaattgaatctgaaaaaaatttaagcttggaagtgcttaagattaactcattcctactagttggaaagagaccaaagccattataaacggcacactgcaataaagagttttatattcactgatacaaaataagaatatctttggtttgctaaaagtcagctattcattttttaccaagccacatgttactattttttttctcaatatatatatacatacttgacaaaatgtcttattaaaaatgtgtggccagatcaaacagccatttatttaggctatttacattaaattttagcttaagtgtcaatgaagtaaattctctttaggagaaaaaactcaatgagaaggtgatgatctatgaaaaggggaagggtttatatgaaatcaaagtgacactcaaaattgagatgagacaaacaaaagtaaatttttttttttactattactttagtgacatccaaaactttacatcaataattttctgtaaaatcctgaagaaattattttcagcatgggaaagattttctttttccgttggtattaaccaagaaacaattagtggttaaaatgcactggggcttaggaaagcccacataaaggcaaacaagacagtgttttagatctcccctaagactgttattatttaaaacatacaactcatgctaactaaaagttttagaaaaatcagaaccaaaccaatttataattaaataacacacatctaaaaatggtaatgtcttaaataaaagagaatttttcatcatttttagaaattatttaacataatccaattgtcttgctttgaaaatattacatacactgtattttttttgcaaacacaaaataagattgataaatgtcacctttgctaagtacttccaaccacccaatctattaaagttgcatgcacaatatttatttacagtaatgacataagatatagaaagaccacaggcgtacacataaaatgtctaccaagctaatgagatcattccacaggagataaacaatttagaatattttcaataattataagtttaaactgtttttttaaaaatctgtcttaccgacgtttgcaaatggctacttctataaaacctttattaaagaaacatgactagtcttcaggttttacccttcagttcctttattccatatttaaagagaaaaaaaaacccataaggacaatttttaaaacttacaagaaaaacctgagaaattatctcttctttgacagcaaagatactgccacatcccattaccaatcatgttggcaaaaagtcatctgacaagtgtcagaatgcaggtaaaccattattgctgcgtaagacaaaacatttccaataaaaaattcccagtctttctcacagtttaaactattaacattcttcacttggtatctttaagcatcttctttccactgactttaatttcatactatcatgtaaaatattgatctaaattctgataggttgcttaaattctactgcagtttgcatttcctgaagatgctaaattattcatgccatcatatgcataagcctaacagaacttcctgcttaatactgataccattaactctttcttcattcagtcagggcaacagagcagaataagggaaagaacacttattgtccaggttgagtaaattcagtaatacgatgttttcagcatactttttaacactagcactgatgttacataaaccttacgttttacctatgaaaggacatttctctttaagttaggcctattgacttttttttttttttcacggctgtccctttatcgctaatgcagttgtcaaacagccatccttcaggcttacccctgcctttaacatactttaccattaggcgttttgtacaagcagggaaatgtagaaacgctgggtaagttagcagtagtggaaaacgacaggctgtttagatttgattggcatgactgtattttattactgtatataattactacagtagactctgcattcatgattttcacaaccagcagtttctcctattagcaattagtcccaaggcaattgataatgtggatatgacccatctcagcattgtttcttacgattaaatgagatgtttgcttaaagactggcttgaatctgatttgcattctctggaaggctggtcagttgactgggtgagtgatcacaacatcagcatctaaattagtggtgttcacacttcggaccatcagtaatgtccccaggtatttctctcatgattgcaaagttctacgcaatacatttttgagacagaatgaaagcaaatgagtttacgtttgctcaaaggtatctagaatagaagggaggcagatactgcagtggtacagttgctgcattaaaaaaaaaagttaccacattgcagggcactgtgctaggaggcataaggattacaaacagtaaattttattcaaagcaatgcatttttaaagtggcattttgaaacattttcaaaaatattatttcaaattttgttttaaaatgtgataaaaaaacttttctatatctcaggaaatggagcatcgtgcatatatagctacacatgaaaatgtaccatcataaacatcttcccccccgccttttttttttcactcaaccttaaggcaaaactgtatatatgattgggtttttttcccatcctttatttcttgcaatcctctcccaacttatgacccgaatgcattttattcccttctaagccaatatgaaaatcacttctatcagttgataacttgctgaaaaattatttgtctgcactggcaatagtcttaatatgttcctcagtccaccatgttttgtaagccgtttatttttagtcgtgaaatgaatggccctgcctctagctaaagacacttgaagaggcaactggaagttgaggggcctatcatttaccaatgctgtcataccctaatgcctccaaaggcaagagtaacctgtgtcctcaggttcattgctctgcttcctcttcctgaacacagatcaagacttgcccatcaaatgccctcctaccatttgttactaagggcattattgagtatatgctcagagaaaccaccacattctggcagaatgctactttaacacaattagcatctatcagagtgttggttgactctttaatcagagctcttatctgttcagttacacaaaccagaaatccactaccttttcttttactcctatttaaccaattttcaagtcctgttaatgcaacctcctaatttctctctccaaactctctccattgctactgttcttgttccatgatcccttgcttagtcatgttcagggtggggcaacaagtatcccagaagcttaacatacatcagttggggcagggaaaaaaatagtagcacttccattcattaatttttctcatccattttactgttttttaacgtcttataatgtactcaacttgtcaacaacaaagtacatatatataaatgataaacacacatgtatgaggggataagctcaaaaactgagagaccaccaacctagacaattacattagcatcatctaattaagttgcccattccaatcgtggtatctgtccccttccccacagtagccagtgatactttaataattaacccaaatcatcgctcttagtaaaagctcttcaattgctgcccactgctcttaagataaataccaaaatccagtgcttgccccccatgatgtgattgccacgtatctcatccaattcctactctattgctctctaggctctaggtacaccggtctctcaatttctcaaatatgctgtatcacctttcctctgcagagcctttctgaaacatgcatgtgccttctacttctaatattattctcttgctcaactggcgtgcctctttttgtaccaactagaactttctggcagtcaacactcagagttactattagccctcagaaaactaaaataattagttcttctttcacttggaatctcacttcctacttcaggttttattgtatatgcttttttctgattagccacttcaagagatttgaaaggagagaagtataaatataaaattagataatatcagatttcctaggaaatatgagaaatctgtctaaagactctcgggagaaaagttttagaatgatattaaaattaagcaaaaaggttcaaacttatatttgggtacaaaagaaagagggtttgttttcgtttctttcactctggatgcgagtgggcaacagagagaaaataaacctggaatagcctaaaagctggaagtttcaggggaaaatgataaaggcacccaattccatagcgttcaagataagaggatacctcacatcattttaaggaaacacaatttcactctcttatccacatgtaaaaaactgaatctcctttaaccaagataggtgtttttactctttataagtaatttaaaaagactttcaaagaccatgtctgttttctcccacttttataggagaaaaaaagaattaagagaaatacaaaggcatgaggtttctgataactacagtaacatacttaggggtggggaaaaaatgaaggcagtgaagatagggcaattctgggcaagaaaactgagcctggaccaagagaataaacctcagacatttccacaatttggtcaagaattcatccctgtttacattcaatctggcattgaaaatgctacacagttctcctttacataatttaccaagttttaaaacgtttatttaaaaaaaaaaaaaaaactaaagaatctgaggaaggcttcttgctttgattttaatctttgctttaaaaattcttaagatttagccattacttttcactatacaccacactcacacaattaaaataagagccagtaactaaaactaagaaagcatgcctagatacataaatacatgttttttaactaagatttgcttttcaaaatgccatgcatgataaatgctacaagatgtatgagccctgaaaacagtacactaattgaaagccagtcacaaaaaaaaccccacatattttatgattccatttatataaaacgtcaagaactggcaaatcttcagtgatagaaattatgttagtagttgccagatgctgggaggtatggaggaattggggtaaagggacaatgacttaagggtagagggtttctttctggtgtggttaaaaatgttctaaaattggccgggcacggtggctcatgcctgtaatcccagcactttgggaggccaaggcgtgcggatcacgtggtcaggagatcaagaccatcctggctaacacggtgaaactccgtctctactaaaaatacaaaaaattagccaggcgttggtggcatgtgcctgtaatcccagctactcaggaggctgaggcaggagaattgcttgaacccgggaggcggaggttgcagtgagccaagatcgcgccactgtactccagcccgggcgacagagtgagactcagtctcaaaaacaaaaaaaaaacccaaaatgttctaaaattgtggcaaaggttgcacaaccctgtgaatatactaaaaccactgaattgtaccctttaaatgggtaaaccgtatggtatgtgaagtaaagctcgataaagctgttacggaaaataacaagtgccatgctgtgcatctgttcttcatctcacaattgtttataacacaaagtttaaaaatatcccaatgcctactgctttttccattttgaaaagtattagaggtgattggtggaattttcggtatttttattttcttcttcatgcttcctatactgcttaaatttttataaatagcacacgactttatcatcagaagaacttattctcacttgaaaaacaaaatgctgtggaaattacagttctgttaacaagagtggttctagatggacagagctctaactggctctagtttgttttttgttttgttttgaggcagggtcttactttgattgcccagactgaagtgcaatggtgagttccagtgaagtggaacctcaaactcccaggctcaagtgaccctcccacctcagtctcttgagtatctgggactacaggtgcataccaccacaaccagctaactttttaattttttggaagagacaaggcctcactatgttgcccaagctggtcttaaaatcttgacctcaagtgatcctttcaccttggcctcctgaactgctgggattacaggcatgagccactgcgcctagcctagctctagtttctaacaagagaactggacataaagaatgaagtgactctatgaataacgccaacatgaccccaaatgtttggaaagactgcaaagccaggacctgaatacccttttccaaacaccagagctggttgagagaaggcatacagtggctgttctgccatcacactactttccaggaggaatcaaacccaaaggcattttttaggtcatgactctctcagtacatatccattcaggatggttcatcaaaaaccaggactgtcctagttaaacaaagacagctgtctcccttttccatgggaatcctattgcccttgccttctctatctctctgcgtgacaattcctggtatttcaagaagctgcttaccaagaagcaacctctatctaaaacaacacaagacagctaatatttaaatgacaaaattgtccacatttactttttgaaattcaaaaatatgtaaaattctattaaaatagtttggttgaatacataaaaattaaataaactgggtttgtctcacatgggatttactaaatagaattaaagatggccaggagcagtggctcatgcctgtaatcccaacactttgggagactgaggcaggacattgaggccaggagttcaagagcagcctgagcaatgtagtagcaaggcctcatctctacaaaaaaattaaaaatgagctgggtgtggtggcatgcacctgtagtcccagctactcaggaggctgaggcaggaggatcctttgagtgcaggaattcgaggttacagtgagttatgatcgcaccactgcactccagattgggcaacagagcaagactctctcttaaaaaaaaaaaaaaaagttctgtactttattctaagattgataggaagccattgcagggttattgctgcatactacaatagttatgcaaaaacccactctaccatcttcctagcaatataaggctaattccattagttatctgcagaagagactggagacacatttcctaggcacccatatcattcatccagtcttcaaagtgggactgatttcaaggcttgaggaaaactttaaatcaatgggaaaccagtgagtatttctgaataggaaaaggaattctctttgttacaatattaccacagcaaagagcaggataatatttgcaaaataaactccttcataaaaaatgtatttcttcctacatgaatgacaatgtaatagccaaatactcttgaaattttccagaacacagaagtcatttgttttctcatgtgaatcatttcagaaattacaaaagctcacataaatagcaggtctaccttgtaagaattatttttggtacctttacatgagtagcattctatatttgtttcctaactaccattctgcaccattcatgttacttacactgccttgtggatatttttgaccatgacttatactatctacacaattaacagcctccttaagaccaaaaattttgaattatttgtttctctcatctcatgtaacatagtaccttaacaggaatacaaataattccagttaactacagcatttcttctcttagattagaacagcatctaccccttaggaattttttatgtattaatgaaataatgtcacaatatttttcatatatgaaataccaactaacttcaaagatactgctattcaacaccatcttcaaaagactccttagaatttttctaccttacctagattatgaaaacaggaatgcccaatgttaactcagaggcaatgccccaaaatatgcacatgggcgacctgacagggcaccatcacgcttccaaatgcacgaaagcacagccgagattaagctgtaaaaatcgtggaacaggtttggctgctgctgtgtgttgtgaatggtctcatcagagtggaagtggttcctgcaattcatctcttatcatcagtggaaaacaagacagactattaaagcctctctttattcttgttttaagaggaaaatgttccacacagaggtatcacaatttttgactatttaacatccagcaaaatgcttcttcaatttatgagcaataaaggataaaaattcatgaataaagataaagtaattacatgcaaattactatcctcatgtaagaaagcatgcaaataatcacagatgacatcctcaggtcattgtagcaccactgaataaagatcaagcctattgtaaaataagcctggaagaactgaagtcactagctggacatgcatcagacaatagattataaggtgcctaactgccagagaaacaaggaagtagagaaaagggaatgaaaggcagacagaatatagtgtctgtatgacaacaaactccaggctaaaataacttgctatgagacatgaaacccatatttatcacaaaaatagtatctgcctctttttagccatttaatcattcccaccttggggcaggacaagatgtcttaagtcccacaacgtaagactaaaagctgcgctcatgaaaaatgaggcttcataagctaaagcagctttcccagacagttagtgaacaagaacttaaaagtcatagaagttaatatattaaaatgtatttattgtaatttagtatgaacaatttataaatccacatatatgaatatgtaattcagatataattatgaaaaaatcacaaaaaaaatcacaaaaagaaaaatcacaaatgtactgactgagacagagctagaaacagctagtaacaacagttactgctattaaatagatggtggttacaaagctaattgctgggcaatttttatatattaagcatcaaaaaggccatcagacctacattttccctttcattgacagatgataacagcaattaggaataatttttgccacttctgtgacttgcaaagtcccacttctggccagccctccataatgtcctcatgggggaggagagaagatgaaatacagaaaggaaaaagacaggaagaaagagttctctgttacaggcaaagctaggcatgtccatctacattgaagagacagaaaatatggaataatcaagcccatctgacacacggcctttaagatttttttgctttgctaggctgtttggaaaagataaaaagactatagaaatcccattcttagtgaacagctgtccctcctaagttatggcagtagttttcaaagatcttgttcctaggatccacttatattcctaacaattattaaagaccctaaagagcttttgcttatgtgggttacatctatcattatttactgtactaaataactaaattacatgttttaacttttaggaattcacttttaaaacaactaaaaagcagttatatttaaaataacattttaatgaaaaataactatttctcagaacaaaaatattaagtgattagaatgccatggttttacaaatctctttagcatttaacactaaatattaaataataatccagacagctagattatttcaattgcttttgtattcagtgtgctgtggcatgctgttctggctgaagtataatgaagaagatccttgaaacggtccagaaggggaccctcaagagttgccatggaccacactttttgaatccctgagttagaggtttaaattcaagattcccaattttacacctgatttagcccaaaggaaaattaaaacatggagaaccagcaagtacatagtaatttaggccttattagctctaatgattaggacatctgtaaactttttttttttttttttttttttttttaaagacacagggcctcactgtagcccaggctggagtggtgcagtggcgtgatcatagctcactgtaaactcaaactcccaggctcaagtgatcctcctgcctcagcctcccaagaagctagggctatagatgtacgccatcatgcccacctaatttttaatatatgtatttttaaagacaggctctcactatgttgcccaggctggtctgaaactcctgacctcaagagatcttcccaaagcactgagattacaggcctgagccagcatgcctggccctaatgagaatcagcctggcctgaggtctgtaaactttaagaggataagctactatcaaatattcactcaaattttctttttagtgactatgaattattagatataatttcaagcattaatcaacacaaatattagaagataaagctatagtcattttctggtcccaattccaacccagaactttgaggttgttcctgtgtgtaaatgggggatcacaaaacagaagcataaagagagggagagggcaagggaagagaacagaagagaagcatccttccaagagagtctggccctaacacatccatggtaggtaaagaatacctaaatacagtccttgggagaactgatattagttactcaaacaattttccttagagcttaactgtctcacagccctggttgagaaaggctaaggaagcggctgaaaattgaggctttgaggtataacaggtaggccacaggatctggaggcctaattcagtagctcccaaccttttcaacagctagaaacccttttatactgtaattaacccccttgaactcaatatttagagtcaatctgcccaaagaaactgtatttatcattaatcttaagaaattaatgaagtttcttttgccacattgtgaactatttaaagccagaattgtgtctacgtacctttctttctaaaacctggactgaggctcacagtgaaactcaaactgatgctgaattacattttcatttttacctgtttctcccaaagtactgattttcttcatacagtagaaataattttaggtgtcacacacattatattcaaacatatatgatactttcccggagacatctattatttgttgttgttgttgtttttgttttgtttttttttttgagacggagtctcactctgtcgcccaggctggagtgcagtggtgcaatctcggctcattgcaacctccgcctcctggattcaagtgattctcctgcctcagcctcttgagtagctgggattacaggtgcgcaccaccatgcccagcttattttcgtatttttagtagagatggggtttcaccatgttggtcaggctggtctcgaactcctgacctcgtgatccacccacctcagcctcccaaagtgctgggattacagatgttagccactgcacccggccaagacctctattattaacatatgagaataggtagccagaattctttcttaatgaaaaagttacctaagtgaagtacaatcagaaccacattggtttcctgtttaaattcacctcattctaccactgtttgaattttcttctctatttctgcctccactcaggaactgaatgcttgacttacagcctccagtagctcccttttcaaaccacagctagctttctggagtacagctttactcacattatcactcttgcttgaaaacttacactgaatctctatcacccaaaggtctcaaacgcccttcttgatcacctacctttctgaatttattcccaccaggccaaacaattccctgctctacaaacacagctcattcttcccactttttgtacaggtatgctattcctcaggcctgatatgtctttccccctcatcttcccatgcctacagtatgtccaactttcaaaatccagacctgaaagtcagcttgtcactaatatgttcccggctgctccagtgagaaggcggctcgtccccttcacacacccaatacagtatgttatctgtcctcagacagggtttctcttgtgtgttatggttgtgccttacctcccctgtaagaggagaaagaagatctgtgaggacaagacttgtgtctaatttgcgctggcatacagatgcactcaaatgatggatgaattaatttgtctatagaaaaaaagaaaacacccaaaagatatgtctttaccgggcagttaagacaaagcagatgttggagaaaatttgaaagcctactttttttttttcctctaagttaatccatatagaattttcattttcttttttttttttggacattagcattcaaaataacattttctagtttaatactatgcctttgccttgtttaattcccatgatatcctgacataaatattctcatgactcacattttataaattaggaaatagctttagagaaagcaccagagggagagacagaactagagtcttttgactctaaactcaagttctttctactaaatcacaataaagaccttaacagtttacttaaaaacacaaaactaaaagtaaattcaaatttttgctttcctaatttctcactctaaactgacttccctcaaaggcgtttttaaaaatgctttgaagatcttgaactgaaggccagacaaacgcagtaaaaataaatggcctgaaggctcgaaaacccaatcccctttgtgcctccctttctaggtatggacagcctggggaaatcccagctctccatgtcaacctttctaattggaaattgggagtgacaacagacatattaacctcacattactgtgattcacaaaagggaggactgtgagaggtaagtatgagaagaaagtagagcaggcagacctacgaaaagactgtccccacctacccaatccccaaacctgttactcacttaatacttagtgaacagattttttttttttttttttgaggcagagtttttactcttgtcacccaggctggagtgcagtggcacgatctcagctcactgcaacctccgcctcccgggttcaagcaattctcctgcatcggcctcccgagtaattgggactacaggtgcccgccaccacgcccagctaatttttgcgtttttagtagagatgaggtttcaccatatcagccaggctggtctcgaactcctggtctcaagtgatgcacccgcctcggcctccctaagtgctgggattacaggtgtatgccaccgcacctggccaaacagataggttttatagggttcaaaatgttaattctccaataagattagttgtttcggaaagctaaactaaaaaactttgtccagggttatctttgggattcttttcaggtccaaatttttaagatttcatgaaagcattaataaagaaccgcaaatggagtatatccagaaccaaatgtgttatctgcagcacagtatttcctcttccatcctctttcactctgtctctggttaacaggaccatctttaccgggggcccaaactgacacacctggtcatcattttaaaacactgttctctccttcccggcctgcccattacatcttactgacaaagagaaaagaggttgagttctaagacctcggtacaaaagccactaatgccactgtctagctgtgggtcctcgcatcactacagtagtgaccttctgtaagtgccaatctcatttctaaaacaaggataataccaccaaccttgtagggttgttataaagatgattggttatgtatacgccagattaagaccaagcacacagaaggtgaccaataaatagatcattattcctgcctcagaatggctttaatttctatgtgaggacaaaggtagaaagctagaacactgccgtggcaggtatagccagcactaaatgaaagctggtcacctcctcttcattctgctcctctcctctctctactttgtcagttcaggcctcatctttctcaccggtattattacaacagtgtcctgaattgatcttcatgcttgtaaacttgcatgctcaccacacttgtcctaaagcacaaacttgatcatatcaatcctttatttagcatccttcaatgactcttcaccacctccatgataacatgcacactcgtcagcactaggcccttcccaaccttatctcttgggatgccctgctcctgacccccaccacataaattctcatgtccaagccacatcatggcatatttgttatttcccaattgctccatgctctcatgcttccaaacctatctagaatgttctatcactgatgagccctccccattcttcaaacatagctgaaacatcaccttctcttcaaagctttccctgaccctagaattttctttggtattccgaaggcctttcttcacactacattcgcaagctgtatcctaattttgctggccttgtttctggcagctgtagcccgactgtgacatcaggcaagggacaggctttatttatcatttttgtattattcccagtgcctaacacagtttataaaaaatacgctttactgaaaatatttttgtgatataagcttaatattgtttgcattaatatcaacaatctggaagactaaaaaacaaaactgtcactataaagtatttctagaaactactgagatttttttaatcctattaattccaaacataaagagatttttaaatgctgtgataaaactcatacaaatgtacatactggaaggtatgtcaggccaaattatcattaaaaaatgaaatctcaatattataaaacctctagaaaatttcaaccataaggaaggtatgacttttgaccatgttctcatgttcaatagattaaaaaataaaacccagcaaaagtagtcttttagataatggtaaaatacttattttggggtgttctttttgaaaaggcatgcttcatcttggctgagaacaaaagcagtgggataatcttactggttatgcatataattttcttttttttggatttaaaaattatttcctattttcaaatgatttaaaccttttaagaaaataaaagttgggcaaatttgcctccaccaattatcacaaaaattaactttgtagtttatataatccataactattacctataaaaatctataaatgtactggataaataatagagaaatcaaaaatatcactttaggtaatacacccatttaaaattgaatccatttccatggagaaaggaaaaaatacactgtagcatttggtataaaaggaagagcactaattcagctctttttcaaaaatgttagaacatgtgatttgtgtttttttaacttccaaatataactcactgtatttagcaccttctgtactttccagtatattagataattgcataccaagttaaaaacaaaataaaggaaaacatttctgccacccaccattttcattaaaaaaaggaaatatcacacaaacacacagagcaccttgtaaaggttggtatgactagccccccagaaagctgttttttataaatttaaaaaatttgaggacgtaggggacacggaagaagaggaaaggaaaattatgtgattattggttttagcacaaaacgtgagctagtaattttcaaattcagttctagagaaccatggaggcatctcagtggttgcggatccggaaccctatatcaatcagagaagctccatattttctgtccatttatacactgaactaccaaagatctcatttgcacaaaaatgtccataactttttaaagtctgaaaatcactgagaaggattagccgatgacaacagtggataatattgatattagcacctaataaataaaaatacaaacagaaatgtttaatatggaaaaatgttttaacaagtggtaaaacattaagaaacaggcaagactaatatttgtagttgctttatcaataagtttgttctgcttctcatcagttttatcaggctacagtttgtaaagggaagggagatgtaagttaagctttttcaacttggttttggaagaaagacagtagatgatttcagcagccaattggctgtgaatccaaagcaaagatttttggcagggtatgatcaaactgagaggtgacattattgggtatgtttgtttagataaaggggaggtggcccatataatgttggggtagggtacataccttttctacactggagaatctgcgtaagaaattatatctattcccaagaacactcctgattcttttttttttttttttttttgagacagagtcttgctcagtcgcccaggctggagagcagtggcacgatctcagctcactgcaagctccgcctcccgggttcacaccattctcctgcctcagcctcccgagtagctgggactacaggcgcccgccaccacgcccggctaatttttttgtattttttagtagagacagggtttcaccatgttagccaggatggtctcaatctcctgacctcgtgatccacccgcctcagcctcccaaagtgctgggattacaggcgtgagccaccgtgcccggccctgattcttaacatcttactctctcccatgcttctacttccacactaattaaggccatcaaaaataagaaatagtatttaactacagtaatttatgaaaacagtcattttctaagtaaatcagactatttagaacttagccattctatatggttttttttccatgatgaaaaactacagaactaaaagcttccttgccagtgactgatccacaataccaggaggcagctgtgatggactcatttcttccaccattatctctctttcctcagcccctagtatgagtggttgagattgtgactgagaataaagtatcaaaatcatctaacaagaagcctttttcccacactaaaatgcttgtgtagcttgtaaaatgatggccgattttcctatttgccaaactttctataatgtggaacattgtttcttaatgcttattaccttacaatagagaatgtaattgagtctctccacattaagattcattaatttgaaaagatcaagatttaaaaaaaggctgtgcacggtggctcatgcctgtaatcccagcactttgggaggccgaggtgggcagatcacttgaggtcagaagtttgagaccagcctggccaatatggtgaaacgccatctctattaaaaatacaaaaattagctgggtgtggtggtgagcaccggtaatcccagctacctgggaggctaaggagggagaatcactcgaacccgggaggcagaggttgcagtgagccaagatcgcgtcactgcactccagcctgggcaacagagctaggctccgtctcaaaaaataaataaataaatttgcattttgaaatcaaaccatatgactactcattgagagaaacaatcctttccatttggctaaaaactaaaaatcaaaagtcaatgacaagaggaataataaaattttaactacttttaaaaaaggaacatttagtttccaatataagttcctaatatcagtaacatttagtttctaatatcaacggatacacttttgaaagtttagaaataaaaataatgctagtttgttctaaaacacgggatagtcaaatgtctactctccaaactttggtaccttaattatttatcacataactgacctatccaacaagatattaagaaaaaaaaaaaaagaatcacaattctagcttcttccctatggtaaaactacagtaaatgaaaagcaattctatacctatgatagcatgccaataaaatactgacacctaggagagaagtacagagacttagagaaatgacctacatacaagactatacagactttcctatgctattttctggacttagagacacaccaggccaagttctagtggtttattttctcaaactagacaaaatatgcaacctatgtataagttatgtattgatattaatttcctcaaaagaagatctgatacaaaacatctaaaggcataacaactttaagtttctgcaagatcccaaaatgtcttcttgctctgaaattagtatttgacagactaacacaccagctagatgcttcaaccctttttagtataaggcaacatatacattgtttaatgtatttataacagattttgaacagattttgatattctacactttcaacaaagtatcaaattttcatctgactgcaactctttcctcttaaaatatatattgtttacagtacatttatatcattaaaatcattactaaatatacaatataggcaagagtaatcatatttgtgttttcatgtataacaattatttcctgattataaaatctctctcttcaaagaaataaccacacactggtacatttttctattttttaaaccaagacaaaactgagcttatccttgacatatgtacagtttttaaaaattgagatttttttaaaaagtgatttctatatatatttctaaccaatatgcactatcagaggagatgcaattcatgactgataccacctgagggcactcctaaaatctttaaaaaaaccgagaatcacatttttacctactgggaaggagacccagtcctacttcaagtccatgctttgaaaaatgtctttcagaaaacatgtgtttctttacacaaagatgataaataagcataattcctatccactgcatattctctgggcttcatgtacttgcaacggaagtgtttctaaagcaggatgaaacccatctaaatacttcaaataaaagggttacagaattaaaaagaactaaactcacaggattatctttctagattatacatttatcatcaataaaaagttcacatttctatagaaaataaaaattcaaaaactacttcaaatatatacaagatctaaaagttaacaaacatttgttttaacatacacatggcacttcagttcaagaatacaagtaaatcttcagttttgctttgtctctggaaaaagaaagaaaatacaaataaaccatgggcaccttacctgtttcctgtgaatttaacacttctaaggcatgcatcatggcacttgcgaagacattggcatcctctttgctgccaaagttgagaccatacacctgtctagcatctcgccactggtggaaggtctgtgtagcttgattgtacttcaaccctttaggaatggcacagtttatcacgacctaaaaaataataattctttataaagtcaaaccaataattggcaaaatcaaggatgtcaacaaatgctgattgtatatattcattcaaatgtgttcctaacagaccttggcaaaaattgcttaaacaattatctgggtaaaatctacacaaatatcagtctgatagaagttaagcttttcgctgattacaaaggtctgccataaaacagtaaatcagccgggcacggtggctcacgcctgtaatcccagcactttgggagggctcgaggcaggcagatcatgaggtcaggagattgagaccatcctggctaacacggtgaaaccccatctctactaaaaatacaaaaaattagccaggcgcagtggcgggtgcctgtagtcccagctactcgggaggctgaggcaagaaaatggcgtgaatccaggaggcagagttagcagggagccaagatcacaccactgcactccagcctgggcgatagagcgagactctgtctcaaaaaaaaaaaaagtaaatcagcaaaacaaaaaaaaattttcctcattaaatatattttaacttgtttgctgaagttttacaaatacaaaaaagtatacacaacctaagagtgtatctctctgaatgttcacatgaagtcagtaccctgattaagaaatcaaacagcaacaccagaagcccctcttcttaactcctcccacctcccaaaaggtactagccacacttctaacatcataaattactacatttatatgaaatccaaaaactaacatatcattctgaggagggtcttgagtatctatataggggtcttaagtatctttcattagatttatttcctattattaatcgagttttgtaggtttttggattttatataaatggagttatacaacatgtattaaacgtatctgctctcttatcctcaaaattgtaagagccatccacttgttgcatgcagctgtggtttgttcattttcactgctctatggtagtcgtttgtataaatcatatttatttaaccattctcccattaatgaacaattggattatttgcagtttgggctattaaaaattgcgatgttatgaactttctactgcatgtcttttggtacaaacaagcattcatttttgttgggcatatacccaggagtggaaatatcacaggacatgtgtatgttcagctctagtagaaaattccaagtagctttccaaattggttctagtaatttacatttccacaagagtatacaagagcttgtgctacttctacatactatgcaacattacaactggtactgtcagtctttattttagcaattctggtgggtatgaatgctttatcactgcagttttagtttgcatttccctgatttttattaggtatctagatgtctctttttgtgaatatctgcttgaattaagtctcttgtccatttttctcctgagttgtcaacttttttcttctttgatttctaagccctttatatattctagatatgatatcattgttggttatctgtgatgcatatatcttatgccattctatgaatcgccttttcactcttaacggtgtcttgatggatgtaagttcttcactttgattctgttcaaattagcaatcttttcctttatagttactgctttagtgccctgtttaacaaatgtttctcaatcacaaggtcatgaaaatattgtcccatattatcttgtagaagctttattattttacctttcatatttctatccccaatccaactggaattgatctgtgcctatggtgtgaggtagggatcaagtttgctatttgtttcaatatggctgtccaaatgatccagcactatcactgtgctgcaggtttgcctgcagcacataaatcaagtgtctataaggctctattttcacctacagatcaatatgcctttttgccaactctacaatgtcttaactgttgtagctttatacgaaatctagatgaccattagagtgtgtcttcctgtttcattcttcaaaattgctttggctcttctcagtcctttgtgtgcagctagttttacattctgattatcagtttctaccaaagaaattttggggactttgaggttgcatgaaagctaacatatcaatctgaggaggctcttaagtatctttataggggtcttgaggatctttcattagatttattattttctattattaatcgagttctaagtattagaatcttctaatattcctaataatttacattaaggttttttcctctaaatacacaatcatgtgatcggcaatggacagctttatttcttcctttccaatccattcacaatgtatttatctccatacactggctagaaataacaatacaatgctgaaaaaaagtgttcataacaagtatctttattttctgattttagaaggaaagctttctcaattaaaccgttaaaagtatgatctttcacaccaggcaggtggatcatgcctgtaattccagcactttgggaggccaaggcaggtggatcacttgacgtcaggagttcaagaccagcctggccaacatggtgaaaccccgtctctactaaaaatacaaaacttagccaggcgtggtggcatgtgcctgtaatcccagctacttgggaggctgaggcagaagaatcacttgaacccaggaagcagaggttgcagtgagctgagactctgccactgcactccagcctgggcaacagagtgacactctgtctcaaaaaataaataaatatataaataaataaatgacttttcatgtaataattttattgatatcttttatctggggaaaaaccctactacttgacagctaagggtttccatcatgattgaatactgcattttatcaagtcctccccaacatctcttgaggtgactggtttttctgtttttatgcagtaagttacactgatgattttctagtattaaaccaaccttacattcctaggataaacaatcttggtcctcatatatcaatttttataaatctctagatttttgtttgatattgctctgtttgaaatttttacatgtacttttatgagtgagattaacctgtaatttcctctctattgtattcataccaggttttgataccaaagtaatgctggacttaaaatgaattggcactgtagagttgacaaaaagataggcatcctctttttgtattctctggaaaaaagtacgtaatactggtgttctttaaaggattggttgaaaagaacaccaccagtagagccagctaaacaaagttttcttccttttacttcttttaatgatagtcttaatttctttaaagtgttttcgtaggaatttctacatctacattttcaaaattactaaaataaagtagctcaaaatatctccttaatcacttaaatgtctgtaagattcacagtgatgtcccttctttcttcataatggttaaaccattttttttttcaagagctgtccctcacaaggactttagagacaaacctctcctccttagtgtgtttgctttctactgcattaatttctgccttttttttttttttttttttttttgagatggagtctcgctctgtcgcccaggctggagtgcagtggcgcgatctcggctcactgcaaactccgcctcccaggttcacgccattctcctgcctcagcctcccgagtagctgggactacaggcgcccgccaacacacccggctaattttttgtatttttagtagagacagagtttcaccatgttagccaggaaggtcttgatctcctgacctcgtgatctgcccacctcggcctcccaaagtgctgggattacaggcgtaagccactgcgcctggcctgtttctgctcttatctttattgttaccctctttctattaatattctatatggctttaatggcctattatttaatttcttgagatgcatcctgagttctggctgaaaagtcaacaatacttctttttcaagataaacattttagcctctaaatttcattttaatcacaagtttagttgcattctattagtgttaatatgtggcatgttcatcattattcagctcaaccaatttttcttatttcatcgtgatttcttctcggactcatggactattcagaaaggtatttcttaacacctacacctatgggattctctattatcttatttctagattaattctgctgtgaccatacactttgtatgattttaatcctttgaaatttgttgacactttctttagggccaagcatatatacaattttgaaattgtgacgtacatttcaaaggtatgtggtatatatgtcaattaggctagggaggtaattgtattgttcaaaccttctatacattcttacagacctttttttctgactgcctgttccatcagttactaacagaagtaagttaaagtctcctgctgtgactcataaatttgtaaccagaacaagaggaactgtgaaatatctggttccaaaatggcagcgcagaagcaagctatggcaaaaaccaccattacttttgcaccaacctaatagttccctactctccctgcaccccaacaaaacaaaatcaagtatacagcaccagcaatatcccacaactcaaataggagtaggagacagttcctggagacacagagaaataaaaaagctctcagcagacagtaagagaatcagacctccatatccacaatggccctccccacagcctgttggcaccaagcacgcagaaaatctcccccaactcacgccttctacactggaaaaagtgagatcaaggtaaacaacaaacttctccaccatcctgggttcacggcaaaagactcatctgtcatctcaaaccatgggaagcattgggagtgccagaagggagaaatatccctgagaacagccaaagtggggaagcaggactagcccagaaagtctgctctgtaacttggccaaaggagacaccgagtcaaagtggctgttcagcagcaccatagccagccttcccacactaccaggacatccccattgggacttcctcaatttgggatgggtagcactctgtttactagaacctaggcaaatctgaacttttttttttttttcctgagacaagggcttcctgtgccccccaaggctggaggtagctcatggtaattccagcactttgggaggctgaggcaggtagatcacttgaggtcaggagttcgagaccagcctggccaacatggcaaaaccctgtctctactaaaaatacaaaaattagccaggcatggtggcacatgcctgtaatccagctacttgggagactgaggcaggagaatcacttgaacccgggaggctaaggttgcagtgagccgagatcatgccagtgcactgcagcctgggtgacagagtgagacaaaaaaaaaaaaagattaaatgttatgcacattttaccataaggctggagtgcagtggctattcacaggcacaatcatgggacacgacagtcttgaactcctggccctaggcagttatcctgcctcagcctcccaaatagctgggactataggcacaagccactgtgcccaccctcctgatgtggtttttataaatattggggtgggggtgtcacaattccttagaagacactagaaacccaaagctactaaattttaacattatcagaaaattagaagacccattttaaggcaaatcaatatccctgcttggcaaacagcttaaaatggcaaacaagagaaaagatgtgttacatttactttttcaattgttcataacagaatgctagaaaaagttgtggaaaatattactaggatcaaaattacataaactactgtttcctttttccaatataaaaatttgaaatctggggttgggcacagtggctcatgcctgtaatcccagcactttgggaggccaaggcgggcagatcacgatgtcaggagattgagaccatcctggccaacatggtgaaaccctgtctctactgaaaatacaaaaattagctgggcttggtggtgcgtgcctgtaatccctgctactcgggaggctgaggcaggagaaaagcttgaaccagggaagtcaggctgcagcgagcagagatcgcaccactgcacgccagcctggtgacagtgagactccgtctcaaaaacaaaaacaaattttttttaatctgaattaattctttcactcatctaaccattgaggatagacagtactgcaaataatctttaaaagtattaaaattaaatattttcaggctgggtgcagtggcttacgcctgtaatcccagcactttgggaggcggaggcaagcagatcatgaggtcaggagatcgaaaccaacctggccaacatggtgaaaccctgtctctactaaaaatataaaaattagccaggtgtggtggcacatgcctgtaatcccagctgcttgggaggctgaggcaggagaatcacttgaaccagggagttgaaggttgcagtgagttgagatggcgccactgcactccagcctggcgacagagtgagattccgtcttaaaataaaataaaataaaataaaataaaataaaataaaattagtatgttcacttaataactacttattggatgtccactgagcatgctgtcaggtttggactacatcataatcctaaattctgtgcttcagaaccagtgagcttgagtctagactggtggtgacgttccatctcacacatgcctatacatttttagcctgaccataacagagtaaacagtgcagtaaacacccacagttccttgtgacctcgctcactatcttatcctgtctatgaggtcatacatgaccctttctcctatcttctcaacaaactgatgatgcttttatgccctcactgtgctctattttacacttatcacaactgaaacatttaactgtggttctttgcttatgtgcttaacatctccatcctgcctcagcctcctgagtagctgggattacaggcgcgcgccactacgtctggctaatttttgtatttttagtagagactgggtttcaccatggtagtcaggctcttctcaaactcctgagcttgtgatccactcacctcggcctcccaaagtactgagattaaaggcgtgagccactgcacccagccaacattcccattctttactgcatctttgattcaaggtcaggaacgatattctatataaaacccaagcacaggccgggcgcagtggctcacgcctgtaatcccagcactttgggaggctgaggcgggcagatcacgaggtcaggagatcgagaccatcctggctaacatggtgaaaccccatctctactaaaaatacaaaaaattaaccgggcgtggtgacaggcgcctatagtcccagctgctcgggaggctgaggcaggagaatggcatgaacccggaaggcagagcttgcagtgagctgagatcgagccactgcactccagcctgggcgacagagcgagactgcgtctcaaaaaaaaaaaaaaaaaaaaaaaaaaaaaaacacacccaagcatagtacccataagcacttaataaatgttaggctggaaaatgaagtatttttttatataacatatttatataattgtacatattcaattttgtaagtaaatggtgggtggttttaacagctcttactatagaaagtttagatatttagtaaattataacaacatgtgcccacttagaacagactgataaccattaagatatgtaagaatgatggccagccacagtggctcatgcctataatctcagctactcaggagactgaggcagaaggatcacttgagcccaggaggtcaaggctgcagtgagctatggtcacaccactgcattccagcctgggcaacagagcaaaactctgtgtcaaaaaaaaaaaacccgaaatgcaagaatgaaagacagaaaaccaattatttattagatttattcttagggatggtgtttccttaagtatcattatattaataaaattatattttctaatcgtttattgcttatacaaaaatgcgagtggcttttatatactgatcacgtaaccagcaacctcactgaaaatcttgttagttctaatagtttatccgcagatactcctgggagatttttatgcagacaattacatcattggtgagtaaccagctgtttctttcttatcaattcttactgcttctatttcttaaactttgtatggctaggttatctagtacctcctctgtatcactaaatgaaagtgattagagctgaaatgctcaatttattcacaagtttaacgggaatgctcttgacactgtacaatcctgtaagatacctgctgtatgcttctattatctacccatatcagcttaacaagattaattttatgcctaatgtgatgagaactgttatgtattgattcaaattttatcaaatgctttttccagaacctcttgcttttgtaggttttctcctgggaaataacattagtaagttatctaatgttaaccatccttatattactaaggcaaacaatgataagccctatttgatcaagaagtgcttttgttttgttttttactcattactacatttggtctgctaatatcttattgaggactattatatctaggtatatattcataactgaagactggctcctctcccaaacgtgttctgtgttttggatatcaaaattatacaagccttataaaatatcattctctacaatggttgcataaaacagaaaatatcatgacattttagatttcatttgtaaatgctctgtactctcctgcagctttttaaaatttggggggcagattatttactatttatttatttcatgattgtaggtctatcacgttttcctactcttcagttttagaaagttacgtttttctacaaaatggcccacttactggcataaagttttttataatattttatttccttcagtaactatagtggtattctttttttcattcctaaaattggttatttgtactgttccttttttttgtttgattctgcaagttttttttgtttgtttttttgagacatggtcttgttctgtctcccaggttggagtgcagtggcacaatcacacttactacagtctccaccttccaggtttaagtgattcttccacctcagcctctcgagtagctgggactacaggcacacacatcacacctggctagttgtttggggttttttgtttttttttgagatggtgtttcgctcttgttgcccaggctggagtgcaatggcgcaatctcggctcaccgcaacctccgctcccaggtacaagcgattctcctgcctcagcctcccaagtagctcgaattacaggcatgcaccaccatgcccgactattttttttttttttttttttagtagagacggggtttcaccatgttagtcaggctggttgcgaactccagacctcaggtgatccacccaccttggcctcccaaagtgctgggattacagacaagcaccaccacgcctggcctgtttgggttttaaaaaatagttttgtagagacagagtctcattatgttgaccaggctggtcttgaactcttgggcaagcaatcttcctgccttggcgtcccaaaaagctgggattacaggtgtgagccaccacgccagctagtttatcttttcaatgaagcagcttttgtattaacaaatactatttattttcatttaattaatatctttttaatattttcttctgttttctttgggttaagctcattattttttagtttccctttttttcctactacatacaattaagacttgtccatctaaggacagcttagatgtcctacaggtttctatatgtaatatcactcaggtctcagtgttttcttattttctaaatattttttaatatacataataatttcctcttaatgtcacaatttagaagcacagttttaaatttttaaatgttttaagaaacattctattttccaaaatctaagtcataggatagtttacttctcctagaaataaaaattttggtatttcatatgcaaatttcctagcttaaatttctttccgagcctggcgcggtggctcacgcctataatccttgcactttgggaggctgaggcaggtggatcacctgaggccaggagttcaaaaccagcctgaccaacatagagaaaccccatctctactaaaaatacaaaattagccaggcatggtggcacatgcctgtaatcccagctactctggaggctgaggcaggagaatcgcttgaacccgggaaggagaggttgcagtgagccacaatcacgccattgcactccaccctgggcgacaagagcaaaactctgtctcaaataataaaaaaaaaaaagaatttctttctgattatcttcaaatattcttttttgtttctctaaatgtaggattgttcatcagtactttcaaataaccaattcactaaatttaccaaaaacgtagtttctttacagctattagtttggaatgttgtattaagaaggttcaacaatttctacaaaattttaattgtccagttttctttttttttccccataataacatcttggggtgtatttgatttatctctggactaagtcgctgctggaacaaagacaaagatgagacagtgctccccagaacctggactacaaatgggacaaagggggctcttggtaaaaagcctgggagaccagaaaaaggctgtgcaacacaacaaggaaactggagcctagaggaaaacgcaggaagactaaggagggaaaagaagagggcggggcacaggggagagacagacagaagggagccagagagggcagaaagagaggcaggccgaaaccgtctgtataaatggataaatctggtaaattcagagaattgctctttccacagattgactcagagctgtgaaagttcatctccacgcaggcaccacatttgtttttaccacgtgccccaacagtttcagtgctctacaaccagtgtttcctaatttcttggcttaagttgcttaagtgaaggagtttctcatttctcgggggagcttctaagccagctaagaaagcaacacactcctttgcttccctgtgctgatagaaggatttctcttgtcttctttctacggggtgtagcccctctaagattgctagtttttttgtgtgtttttttgtttgtttgtttgttttgccaaaataccagtttcacagcccaacctctcgtaggcccacagcccctatatgcatacatgacaaatcttaccaatccataatcaccatcctaaaacccagggctaatgcagcatctgtttacaccacactaccacacaatgtaggggaaacctaggaacttacctttcttcataagagctcagctgggcaatgaagaagaaaatttgttacattctttccgcatgtgtagcaggatgatttttaaagtcagttgattccaacatctttggtaaatattttttcccaaagtattttgtaaatctactctttataaaagttcttactattagtatatagttaatgctagtaagagcttatctgccttttcctctatctactgctgttgatctgttaaggcccaagaaatcaagtaatcagataatccagctactttctaagaaatccagagcgaggaattagtaaaagcttagctgtcgccccagacatgaactgcaaaagccaaactattccagcaacctcaatacctactatttttctatcacatgtgaatttaacagtattttctgaaactatctatactttcaactccctcctctaaccccatatcccaaacattggcaggaaattaattccataaacatacaatctgccacttaagtagagttttgtttgtttgtccttaatttgctttagatttcaaaaactaattgaaggccagaaaatctaatgaaaattcatcataaaagaacttgtatttctatttttgtacaacttgttctaaatcttcgtttaagttcaggcttcataaaaggtagaaagggtggagagacaattttatattcagtttttcccagagagagactattttgattacagttttaaaactactttattttacggaatatgccaagtccttttgtaatactaaatcatttttaacaacaattgtagtaaagccttacctgatggtcctgaatcttcctgcccaccactctgaatgtgttgttgcctgtatggtgatagatatgaactctgctgaatccagttgagccaccagctggcacccacttcttattggcatcatcataaaccatcacagcagctcttgcctgacagatactctgttcactgtaaaaaataaaataaaatattcaaacttgcaatatttaaaatatgctaagtgttccacatagccacacaaacctaggagtcagtcaacgatcagtgctgttattgggtgctggaaacaataatggacaagacagaggcttcctgtctttatgtgtacagtctaatggtgaagacaaaccaaaaaaaataaagtataattaaaagaccaaaaggagagcaggatccacgaagaacacttagataagcaacacaagaaatggtttcttctaaatttgagtatctaattcattcactaaactgaatacaactattatgttggttcaaaagtaattgcactttttgctattttaatggcaaaaactgcaattacttttgcaccaacctaatacaagtgtaaattaatcattatttgcttaattgcatacatgtttagtatactgatgacctgtctgtgataacaccttctttactgagaaaattacttttatcctcaggcttgccctaaagtctgtaactaagtctgataatcaaccatctgccccttgagacatggagtggccgctaacaaccaatggatggcagtgtaactaaattcctcattcgccttgggcaagataacatcttgtgcttcaaatttcttcatttaaaaatgaaaatgtaaaatgaggtaatttctaaagaccccactagattttaaattctagcctccaaagataaatattaaaggggaaaaggccaattctgtcatagaatctttaaacattagcttcatctaactcaattatttgttaccaagtgagactgagatacacaaataaataaaatagagacgccaggcacgatggctcaatgcctgtaaccccagcactttgggaagccaaggtgggagaataacctgaggccaggagttcaagaccagcctgggcaatatatcaagaccccgtctctatatttaaaataaaatataaagataatctcaatttcatcttaagcaatgggttcatctttcaaatattctaggatattagaataggcacatcaactctatgctattaacccaattaaaataactcaacctcaatagacaagccttctgatactcctgagacttaacagtcattaatggaaatcctctgaagtagctcgtgcaaccacatccttcacaaaagcactgcttattctatcaattttatctcaaaaattttaaacaataaatcatgtcggttctttcctaaaaattctcaaacagaaagtcaccctcacactctcccctcttgctcgtgcatctgccccacctcttaacccatccaagagggataatgaaatgcaactttgcaggagatggcatgtgttttattcttgtccttgatgacagaggatcactgaaggcctaaaaaggtcacagcactgagtaataaaattgcttcagaacaacagggttataattatttgtaattttccattagaaaaatgtttacaaaaactaacttgtaacaatatttgtgcagcaaacccaatggtaatgtctacatttttatgctgcactgacatttttggtaaaatacttctgggaatgaaaacaagccaatgactaaaacttgaattagttttaaaagatagattaaagggcatgtgtcagtagcagttgaaaaatctctccatcattcacaacagaaatattttgcatgtgatgacatttacataaccctatggaaagattacatgaaacaagccaaggcaaagtgcctcttacagcttacaattcaagcaacaaatttactgctaaatgtaaataattcaataaacaaatctagaataatacaggatagtagtttccagttttcaaataatatttttgcagctacattgtttctaagattcccaagattcaagagataatgtcttggggtgtggggagctgggggagggacagcgttaggagaaataacctaatgtaaatgacgagttgatgggtgcagcaaaccaacatggcacacgtatacctatgtaacaaacctgcacgttgtgcacatgtaccctagaacttaaataataaataaataaaataaaatcatgtccctttaagaagtgtcagtaagatcatataagctaaagcaacacctcattttgtaaacaggtcacttcatgcctcaaaaaaatttttttcttttaagtataagaaatctaaaacaaggaaagttagctttaatggccccaaagttttcctctactttttttctccaaatgaacatatccaagtagccaagaaaagtcaaaaatgcaaaaaattaactggttttctgaagatgaaaagaaatcttcaaaatgaaatgttaaacatttccaattctaaacaaagctgagaataaagagaagaaaaaataagctatgggtaagagctgaggtgttattggagaggtagtaattgccatgtgggtatgtggcacactgtgaagggattagctaaacccaaataactgtgtagccctagaagatatcaggcactggtggggcgcagtggctcacacctgtaatcccagcactttgggaggccaaggcaggtggatcacctgagtttaggaattcgagaccagcctggccaacatggggaaaccctatctctactaaaaatacaaaaattagctgggtgtggtggcaggcacctgtaaccccagctacttgggaagctgaagcaggagaatcatactcacaccatggactccagcctgggtgacagagcaatgctccatctcaaaaaaaaaaaaaaaaatacattaggcactcagagaagcccccatcaaggcccagccaggaaaggatggcactgcctgctagggtttagcgacaaatgcaactcagtcctcttattcctttccacagcatctgaggacctcttctcactagagacatcctgccatgtacgctgaccattgaacaacatgggaactgcgcaggtccacttatacatggattttttttttccagtgtttttcagtattttttccagtgttacactggaaaaactgtgcctgcctccccttccacctccttctcctctcccaccttacccttcctaagacagcaaggccaagccctcctctttcctgcccctcctcagcctgctcaacatgaagacaaggatgaagatctctataatgatccatgtccatttcatgaatagtaaatatattttctccttcttgtgattttttaatgtttttttaaataacattttcttttctctagattaagaatatgggccaggcgtggtggctcacacctgtaatcctagcactttgggaggccgaggcgggcagatcacctaaggtgaggagttgggagaccagcctgaccaacatggagaaaccctgtctctactaaaaatgcaaaaaaaaattagccaggtctggtggcgagcacctgtaatcccagctactcgggaggctgaggtaggagaatcgcttgaacctgggaggcagaggttatggtgagctgagatcgcgccatgacactccagcctaggcaagaagagcgaaactccgtctcaaaaagaatatggtataaaatacacataacataacaaaacgtgttgatcaactgtttatggatatctataaagcttctactcaacagtaaactattattagttaagttatgggggattcaaaagttgcacttgggccaggcacagtggctcgtgcctgtaaactcagcactttgggaggccaaggcaggcagatcatttgaggtcaggagaccagcctggccaacatagtgaaactgcatctctactaaagatacaaaaattagccaggcatggtgacgtgcacctgtggtcccagctactcgagtggctgaagcacaagaatcgcttgaacccaggagatggaggttgcagtgagccgagatcatgccactacactccagcctgggcgacagagtgagactctgtctcaaaaaaaaagaaaaaaaagaaagaaaaacaaaagaaaagttgcacttgggggccagagtccctaacctcctccacccctctactcaccttttataactctactgttcaagggtcaactgtatttggcctggggtcctgggtacagggctcctcaaagtgtctttggtatactaatgagatgattcttggctgaaggggcttctagatggcttcagatggggccaagtggccggaaatatcatggcatgactggaaggctggaactcaggcccacacttcccacctcattactgccccccgccaacaactggggaagggagacggactagagatcgagttcaatcacaatggccaatgatttcatcgatcatgcttatgtaatgaaacttccataaaaaccctgaatgacagggtcagagggcttccaggttgatcaacatatgaaggtgctgggagagtcgcacttggaaagggcaggaaaagactcaacccccgcaccctcacaccttaccctatgcctctcttccatttggctattcctaaattatatcctttataataaatgggtaatagtgaagcgctttcctgagttttgggaatcattctagcaaattatcaaatgtgggttgggtggtttcaggaacctcagtatttgcagttggctaagcagatgtgggtagcctgggcactccatttgcagctggtatctgaagtaggagcagccttatggaactgagcccttaacctatggggtctacgttaactctgcacagtgtcagagtgaactgaattattggacacccagctggtgaaatctcgagaagagactgttgaagtaaggaaaaaagctactcacatactaactccgattacaggtgtgatgcacaaaataaattggtggtaagcagttttagacttcatggagccatgaacatcaaaagcagactagataaatcaatacagaactggctgccaatattttgccctacttgacaggtatgcgatggggcggtggtggggacaaacataacttatttaaaatgatatttctggaatctaaaaataggaatatttcaaaacaaagacaaatcattaaatgcaataacttgagctttctagacaattccctctattatctgcagattttgttttctccccgtttctccctggtccagtgaaatgcttagccaagggcctgctttaaaatatggctggcctcagccacaagagacagtattgctgcatggacactggtgaacaaatactagagcaatgcatcattttactaccatcctatctgcatcatgacaagcctcaaaatgaatgcccagtcaaagtcttcaagattctgagtcagtgaagcgactacgcaaaagattaaattagtaaattaccaagctgtacttttgtgaagatcaggcactaaattagttataaacaaaaacttcatttttatgacccagtgcaattggtatatatagttaattatacttcatcttctgatgttaattttggtattttaaaataaaatatggcattaaaaggctagagatagctggtttaaaagaagggaaaaaaggtctaaaaaccaagacaccaaattacaattttgtagttttgtcaggtagttcatttctgaatattgtcaaattgactgagcaggtatatgtgatgagaacgcttgccaagttctattctcacaggtaccagtgaatgaagcgcttcctggtatttaagcagactaaggattgctaggctagtcttgtatatactatttattgagattgcagtaaaaccaagttgttaacaaatatcaatttcttttcaaagatatcacttattaatcattacttgtcaaagaaagcatgaatatgacaatatgtagcacacagtaggcactctttaaatgctttttcagcacttactgtaatctaacaaaatcctactcatcaagacctggatcaaatactattcctcttattaattctctctgtggttcccaaagccagaactaattgctccttcctccgagttctcagagtattcattaatctctcaacaaacaagactctctgaggaggcaatatttaagccatgggaaagacttgagttttactccaagtgtatactgggaagccactgaagggctttaagcagaacacggcctacattttaaagataactgtagctactatgtagagaaaaaattcaagaaagtggcagcaaaatcaagaacagaagcacaaataccagacgagaaaaaaaggagggagaggaaagcactggggatgtatgttgcaagtacagaagaaaggatctgtagatagacaggatgcaaaagaggaggcaatcaaaaggaggaaaaaaattatggatgcacctagcattttaatgatactcccagttagtatgtgatatgctgtaaagtattaaaatgtaccaccactgaaagtcatggcccaactcacttattcagaaacatgtcttcatcatctttgaaaatggaaaatatgtcatcccttcttgaatcccctatgtgcagcacagagcctagtctgtagtgagttatcaacatgtgcacaataacctctactatactatcagcctcttaagagaatatatcctaaagaaagagaattagcatcacgtctgttatgatactgagtcattctatgaactaagatgtcatttattcagaagataaaatactaagaaataacactaaaaactttggaattttaaattcaggatttccatcttattctctgatatcaatttattgggctatgtctacaatattatgacatttcaaagattaaagaggctcagagtaaacacaattgtgttaggtttcaactcgattccacaaatattgttcacatttataacacaggtcctggcatatagtaaaagtgggcgagaccagctcagttatataagattgtgggccaggcgcggtggctcacacctgtaatcccagcacattgagaggctgaggtgagtggatcacctgaggtcaggagttcgagaccagcctggccaacatggcaaaatcccatctctactaaaaataccaaaaattagccaggcatggtgcctcgtgcctgtagtcccagctacttgggaggctgagacatgagattcgcttgaacctgggaggcagaggttgccgtgagccaacagtacgccactgcactccagcctgggtgacaaagtgagactctgtctccaaaatatataaaaaaaaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaatatatatatataaaaaaaaaaaaagattgtgcattcagatacgaataataaacatattttctcaaataggaaagtgaacaataaatagcatgtgctatatactgtgttaagcactagacgagctttttcctagtccatagcaccaacaccaccactctgaaatcacaacatcctacaaatgtagggttcactccagaatcctccgtgaccctcactgctccacacacacagtcaccaagccctgtcaattctatttccaaaagactcctacaatgcatcagtaccctttgttcacaatgctcaatgctcaaaagctttaatttgggccctccctagttcctcaactggcttatttcaaaaatctccttacctgtatctctcactgcaatcttattcttccctctcaatgcttccagagggatatttttataaataaaatctgatcatgccactcttctggttaagatacctcaaagactcatttcaggataaactctggcttcacagcatcacgtacagggtccactataattgggcctctgtcttcctcaacatttattttttctttaaaatacttattaagcatgtaatgtgtgccagacattattctaccatcctagtgctgggagcacactggtgttcaaaatagtctaaaactacagcaataacacgccttcccctcttcctgacctatctgccccattttcatcttcccagataccttctaattctgatctgtccttgagaattcagaaactcacctcttcttgaaagctttacactcccccaaaacaagaacttatttcctgtgctctcacaatatattgtgcatatcatctctaccaatatcagatgttaaacccaggaaggactggcactgtctctctcccaattaaagatttgtgagagaagtggcctgaaaagtggtgagagatactaagtataaaaagtaaacatctgtaaacttggagtaagagccctgaaatacgacagtgaaagcttccttttctgacctccaatgcccaaatggacaatctctccactcctccccttcccatccacaaaccataccactagcactctaaatgctcagagctcctcaactcatcactctgcactgttctgctcccagaggttgagaatcagctgtgcagcctgggcaacatagcaagacccccacctctacagaaatgaaaaaacttaaaaatcagctgggcacaatggcacatgcctgtagtcttaagtacttgggaggctgaggtgggaggatcacttgagccaggagttcgaggccacagtgagtcatgatcatgtcactgcactccagcctgcatgacagagtgagactctgtctcaaaaaaaaaaaaaaaaacccaaaaaacaaaaagaatcagctgtctgtgaccaaatgtattcattataattgtacttgtaagtctgcaatctaaatattatataaattgatatgtgagtatacagaaatactataaaaattaagttaaatgttttgaaaagtctttatcaaggtaggtcactaaaaagatcatacaagtctaacagaattctgtattcagaatgctttgcatatgtctaagttctctctccacttcaaagaaaccaaagctgaaacgtcattatctgctggggcatgctttaggaagaaaaacaatatagagttctcatcaccagactaacactaaagaaaaagctttacagcaaaagactagagaattaacacatataacagagactagagtatttaaagagtgagaggcaccataggagcaagcacacagaggaacatccatatgaagaggcagcaagagggcggccatctgcaagccaaggagacaggcctcagaggaaaccagcaccagccctgccagcacatcaagctcagacttttcagagctgtgagaaagtaaatttctgggccaggcacagtggctcacacctgtaatcccagcactttgggaggctgaggcaggtggattgctggagcccaggagttcaagaccagcctgggcaacataacaaaaccccacctctacaaaaagtgcaaaacttagctgggcagggtggcaggcacgtgtagtcccagctattcaggaggctgaggtgggaggattactggagccttgggccaagattgtgccactgcactccaacctgggtgacagagttaagaccccatctcaaaaaactttttaaaaaacttaaaaatctgtttaagcttccaaaaataaatgaaaaataaatatttaaagttatatgtcatttttaaggataccaaacttgatttcaactaactaaccactatcaccagtagaccaaattagaaacttatctcctttgccattccattaaaaaaagaaagaaaaaatcttgctaagaatcaggagaaaaaatttgcttgctagttacaattcggttctgccacaatggctgagagattgaggaatacaacaaaaacactgtgaatgccactgacaaacagcagatgcaaataacggcagcctacaaagttattttctgcaaggcaagaaaaccatctggaatgcagcagcaccaaatatgcagaaaggcaaaacttcctctaaagaccacacttatgtttcattcatctttctgagaaatagaataataaataaaaggtaaaaacatcaatatggcactattaaactctttgtcctacaacacctatattcatgtgcaaagtacaaatgcagtctagtataactgatccagattcaccaaagaaaatggtcagtctaaatgaccatcaaaagcaagatggcatgatttaaaagaaaacatttcagcaaatctattgggtcattctgcaggatgaaaaaatctcttaaaataggggaaaacgttaaaggttaaatacaatagtatgtagaaaaagtactttagagaatgtacctaccacatgtagtcatgtgtgcttaggagtaatctttttttcaatagggagtaatctttttagggagtaatcttttctcaataattcttatggtactatttgacttcaatcatgaattcctcttacttaagtatagaatctgcaaaattcaataaatgtgactcaggcggtaaaaagaacctgtccctatctgcaacatacctggagacagagaataataaagacaattagaatgcacaatttccatattcttagaaccataagagagacagagaaacttgtaaaacttacaaaagctctggagaccgaaaaaaataaaaagaaacattaacaggctggatacagtggctctaacctgcaatcccagcactctgagaagccaaggcaggaagatcacttgagcccaggagttagagatcagcctggacaaaacaaagtgagactctgtctccacaagatatgaaaaataaaataaattagccaggcacaatggtgtgcacctgtagtcccacctacttgggaggctgaggtagaaggaccacttcagcccaggagtgcaaggttacagtgagctattactgagccactgcattccagcttgggcgacagagcgagacactctctcttaaaaaaggaagaaaagaaagaaatattaacaaactagtaagactgagattatctagggtgggaacctgctctgtgtgtgcaactctagctggccacataatgacaaagacagcctgctgctaagcagcacagaaaaaattcaagcaatgctctttcttgtaatatgaaagactaattaacaaagataaagcaaacgttacttggaaaaattaaaaccaacagtttcagaagaatgcactctacaactgtctataaatatttcagagtattgtttaactgtaggcacaaaaaatcctatcaatgaggaaaaatcttatcagtgaattactatctaatagagactaacagctccccagttagtcagttataaagaatccaaatctcttggtttatgttatgaaagacctaaatcccagagacaattaagtgacataagcagttactgagccagtgttgatactaataatactactaataatagtaaaaaataaggatatgtatatagtacttactaagtgccatatatggttctatgtgctttgcctttattaattcgcttatttcttcaacaaccttatgtggtaggtaccgttaatatccccattttacagataggaaatggagacacaagaagtgaattaacttgactaaagacatactgtagggagaggcagaaatgggacttaaagcagccagtctgcttccaggtctggacttgcaaccactctactaaaaaaagaaagattctgactataaactatattagttccacaaaattacctcttcacatattttctattatttccacattatacttcatgttatatttaatttgaagctaagaggaaagaatttatttgctgaaatttatgttctttttagaaataaccaaggtttattttaaaggtttcattactgaagatacaatgttaacctataacaaaaacatgtctagaatatcagatttttttaaggcagtaggaagaaacttattcataaaattaatactccagggaaagtttccttcaaatagaatctcaactttcttcaaagaattacatgaaagacaaaatctgtgggaaacattttagacatcaaactatagatacagatagagattcacacagacatgcacacagaaacatgaagaatagaatagcagctatcgttccattattttatttaaactactccaactttgttactacacaatgtatgagtttagcacattacaggacgcacatgaactttgaaatctattagccaattagaagaatatgtctttacatctttcaaaaagaataggtaaaaagaaataatatattttcagttataaatattttcatccaagtcagtgtagaaaaatattgactagaaaattaagataaaacttcaacctaaaactacagaaaaagaacctttcaatgtttaaagttttgttatgttcctttatttgagatgctttgctgttcttcctatgtaagacatcacatagcttcctagtggtaaactttgcttttaaaatttctcaccctactgtgtgattctggttcctactctaagtatacactgtaagaaataaaaatttattataccttcttcttcttccccacaccctcaactcatcaacaacaaaaaaatagctattaataatctccacacctcctagtattcatgcccagagacttacctctactgaacagaatatgggaaaaaaaatacatatatatatatatggaatgtcacttccaaggttaatttacgaagtgactctggcttccatctagcttgccaccaccttatggagaggcccacacgagacaattatcaggaataaaatgaggccctcagtctaacagctggcatgcaactaaatccaatccattaatgtgaatgagcttagaagcagatcctcctccccccgtgatgacttcagttgagactgcagccctggccaacattttgactgcatttatgaaagaccctgagctagaggaaccacctaagccaaacccagaatcctgaccctcagaaactgtgtaataaatacgtgacgttttaagccactaaaactttgtgtaatttattgtgtggctataagtaacacactaccccttcactccctcgtgcctgaccccaagaccttaaactacttaagattgggccgggtgcaattcacgcctgtaatcccagcactttgggaggccaaggtgggtggatcatttgagatcaggacttcgagaacagcctggccaacatggtgaaaccctgtctctattaaaaatacaaaaattagccagccatggtgtctcgtgccgtaatcccagctacttgggaggctgaagcctgggagggtggaagttgcagtgagccgagatcgcatcactgtactccagcctgggcaacagggcgagactctgtctcaagaaaaaaaccaaaaaaaaaaaaaaaaaaagccaagattacctcagatttcataagctccgtgacttttagcacacatataggcacacagggctcagattcttcgtctggccacccatctttttttaactggacttgtaattttcaaagatcaattcccagtgcaccagcaaacctaaaccgtcattcacagcatgagagttcacaaaaagtacagacatctagaaatggtcacagaaaaaaaagaaaaatgtgggaaaacacttcacttggcaacacatacttccctatcttaataaattctcccattaataagaaacttttctcagtaactgaatagattatttcacctgtttcctgtagttcttcttttcctcacattattttcatgaagttatatggcaaagcctctcaaaatactttccaagcaccgtagagttaaaaatatcaagtgtggctaattttagctataaaggcaccaggcagagccaagttagacagacgtggaaataaaaacgggatgaaagatggagtgggagtggagggtggagggtgagccacactgacttcttatatttttattttgcaaggttattaatttcaatgaatgaatagtgtcagcaaaagacaagtaccatatgagatcaagaaagaaaaactaaagcagaatactatagaatctcaatctatttttctcaaaatgtaagcagggagggttctgcttctggccaagtaatggccaactttccaaatgaccctcccatagataaaactataaactctggattaaaattaaaaagaatttttttctgagacagggtttcactccgtcacccaggctggagtgcagtggtgctcactgcatcctctacctcccaggcccaagcaatcctcctacctcagcctcccaagtagctgggacaaaccacaggcacgcaccaccacacccagctaatttttttttttttttttaatttttggtagagatgggatctccctatcttgccaaggctggtctctaactcctgagctcaagcaatcctcatctctggataaaatttatagaacaactatatgaaatgtatggtttggatctgtgtccctgcccaaatgtcatgtcactgtaatccccaatgttgggggtggggcctggtgcaaggtgacaggataatgagggtcgtcctttctgaatggtttagcaacatccccttggtgctattcctttgatagtaagttctcatgagatctggttgtcttccccccctctctctctcttgctcctgctccagccacaggaagtgccagctccccctttgccttccgccatgactgtaagtttcctgaggcctccccggaagccagcatcatgattcttgtaaagcctatggaaccgtaagccaattaaacttctgttctttatacattacccaagctcaggtatttatttatagcagtgaaaagaacggactaatgcaggaaggcactggagaatgagaagaagggagtcaactcttttaagaaaggaataatacggggagagttctctgatgtttacagcttttagcctgacaactggtcctggtctgtgctacatgggagagctaaaactccaacagaaacccccacagactttctagcttaaagataaaaggatagagttcagggcaatccatagctgctgcaaaatgagaggaaattcctgggaggaaaatgagccagtgggcaggaaggaaccccaaattctgtatataaactctgcctaaatctctggatgatccctgatctactcatgtgtagggcagtttccaagtaactaaaagagctgaaccaaaatatgacccactgcctaaaagacagaatttgctgttttgagtccaaccaagttatacagatctgtgggacagtatcattggggctaacatattaatatgtgtaagagtctgggacaactccccactctccgcaaaaaagagcaaagcatattcaatctaaaaacaaccacaagtaggtatatcacagttgaagacgaagatacttgaaatggctagagaaaaatgaaactttacataaagaagaacaataaattggatgaccacagacatcttcatattgtactgcagaaacaaaagagaacagagacaataaaacaacatctttaaagagctcaaatacaaagctgccaatctagaattccatatccagggaaaatattctttaaaaatgaaggcaaataaagatattttaagaaaaaagaggccaggcgaggtggctcacacctgtaatctcagcactttgggaggctgaggcgagcagatcacctgaggtcagaagttcaagactagcctggccaacatggtgaaacctcatctctacaaaaatacaaaaactagccaggcatgatggcgggtgcctgtaatcccagctactcaggaggctgaggtgggagaattgcttgaaccaggaggtggagttgcagtgagccaagatcgcgccattgcactccagactgggcgacagaggaagaccctgtatcaaaaaaaaaaaaaaaaaaaagagagagagaattattcaagttgaaagaaaatggtaccagacactcaaatagtctgtaagaaatgaagagcattaggctgggcgcagtggcacatgcctgtaatcccagcattttgggaagcagaggcgggtggatcacctgaggtcaggagttcatgaccagcctaacatggtgaaaccctgtctctactaaatacaaaaaaagttagccaggcatggtggcgcatgcctgtaatctgagctacctgggaggctaagtcaggagaatcacttgtacctgggaggtggaggttgcagtgagcccagattgcaccactgcactccagcctgggcaacaagagcaaacctccatctcaaaaaaaaaaaaagaaaagaaagaaagaaaagaaatgaagagcatcaaaaatggtaaatgtaggccgggcacagtggctcgcacctgtaatcccagcactttgggaggccaaggcaggcagatcacttgaggccaggggttcaagaccagcctggcaaacatggtgaaacgccatctccactaaaaatacaaaaattagccaggtgtggtggtgcacacctgtaatcccagctatttgggaggctaagacacaagcactgcttgaacccgggagatggaggttgcagtgagccaagattgtgccactgcacacaagcctgggcgacagagcaagactctgtttcaaaaacaaaaaaggtaaatacaggataaatataaattggactgtgttcttttaaggtaaaacttgtaacgttatcttaagaagtttcaaattatgcagataggatatatcagacaaatacagcaaaacaaactggggggaacaaacctagagagttgcaaggtttctacattttatgcaaagtgctacaacattaactctaagtaaatggtaaaagtgaaagcaataactaacaggagagagaaaatgcaaagaggtatagcaaaaaagtcagtagaaaaattaaaatagaattctaaaggtattcaatttatcccccaaaaaggcagaaaaggaataacaaaggactgaaaacagaagggacaaacagaatacaaatattaaaatggtagactgaagtccaacctctccataattacatgaaatgttaatgactaaacactctcattaaaaggcagacattagataataaagaatcaattacatgctgcccacagagatgcactttaaatatacagaaagcaggtaggttcaaagtaaataaacattggtaagcaacaagatcttcaaagtaacataaaaaaaggaacaaagtaaataaaatattatatgtcatgaaaacagtacccatatagtaatatcagaattgacacattagtatcagataaagtagacttttaagcagaggaatttttcaaaattataaaatggtcaattcatcagaaacaagtaacaatcctgaatgtacagccacctaatcaccatctctaaatacataaagcaaaaactgacagaattaaagggaaaaatctcagcactttgagaggctgaggcaggtggatcatttgaggtcaggagttcaagaccatcctggccaacatggtgaaaccatatctctactaaaaatacaaaaattagccaggcagtagtggcgtgtgcctataatcccagctactcaggaggctgaagcaggagaatcgcttgagcctgagaggcagaggttgcagcaagctgagctcatgccactgcactcccatctgggcgacggagtgataccctgtctcaaaaaaaaaaaaaaaaaaaaaaaaaaaaaaaacagagaaagagaaaaagacattttcacagtattagttgtaaattttaacacccccttaaactgataaaactagacaacagaagtacacaaaaaaatttgcaagcacatagaataaatgaaggttattaaccactttgactcatttgatattttaaagacactatacataataactgcagaatacacattcttttcaagtacatctataatcaccaagatagatgatatgctgggccataaaaaaaaattgaataaattgcccaggtgcagtggctcatgcctataatcccagcactttgggaggccgaggcaggtggatcacctgaggtcgggagttcgagaccaacctgaccaacatggagaaatcctgtctctactaaaaaaatacaaaattagccgggcgtggtggtgtgcacctgtagtcccagctacccagaaagctgaggtgggagaattgcttgagcccaggaggctgaggctgcagtgaagcatgtctgtaccactgcactccagcctaggagacagagtgagaccctgtgtaaaaaataataataaataaataagaaaaaaatcatgagatgcagctaaagcagtgacgaatgggaaatttatagttgtgaatgcatatatgagaaaagaaaggcctaaaagcaaagacttgagcttcgttcttaagttagaaaagaatgggcatggcggctcacgcctgtaatctcagcattttgggaggccaaggtggaagaactgtttgagcccaggagcttgagaccagcctgggcaacaaggtcagactcttaactctataaaaaattttaaaaattggccaggcatggctgcgtgcacccgtagtcccagctacttgggaagatgaggctggaggatcagctgagccaaggaactcaaggctgaggcataagaatcgtttgaacccggaaggcggaggctgcagtgagccgaggttgcaccactgcactccagcctgggagacaagctcaaaaaaaaaaaaaaaaaggaagaaaaagaggagaaggagggggaagaaaagaggggagaggagggggaaggaaaagggaaaagtagagggaaaaggaagaaagaaattgatatatgaagctcctcacaaacaaaactccaggcacatggtttcactagtgaattgtgtcaaatagctcaggaaaaaacagccctgatattatataaactctcaaaaaaataaagaagaaaacatttccagcttgattcatgagaccagcgtgatcccaacatgaaagccacacaaagatattacaaataaagaaaatcatattatccttaaataatacacaaaatttcttaacaaaatagtatcaaagttggcaatattaaaatactaacacatcatgacaaagtagggtttattccaggaatgcaagattggtttaacatctgaaaatcaaggtaattcaccgtaacagaataaaggagaagaacaacgtaatgcaaaagaggcagaaaaaggccgagcatggtggctcacccgttatcccagcactgtgagaagccaaggcaggcgaaccacttgagggcaggagttcgagaccagcctggccaacatggtgaaaccctgtctctactaaaaatacaaaaagtagccaggcgtggtggcacgtgcctgtagacccagctactcaggaggctgaccatctcaaaaaaaaaagaggtgggggtggggttggctgggggacagaaaaagcagggataaaatgcaacatctgtcttgacaaaaactctcagaaaagtaggaagagaagtgatttcccctaatgtgataaagatcatatattaaaatatctagaacatcatacttaattttgaaatactgaactccttccccctaaggtcaggtagaaggcaaggattaaccacttctattcaacattgtattggtggtcctagcctttgcactaaggcaaagaaagaaaaggaaaaaaaagaaaggacagaaagggaaaatagcctctacttgcagatgacgaattgctgcttatggaaaatcctaaggaatctacaaagcagcaaattagtaagtgaatttagcaaggtcacaggattcaagtttaatttaaaaaatcagttgcattttttatatagtagcaacaacaaaccagaaaaataaagttttaaaaactgcatttgcaatagcacccaaaaaagaaaatcttcataatatcatgcgtaaaatctttatgctgaaaactaaaaaacactggtaagagaaattttaaaaaacttaaacatatacaatgttcatggattggaagcctcaatattgttaagatgtcaagtctctcctaaattaatctacaagttaaatgcaatcacaatgaaaatcccatcaagccatttttgtagaaattgacaaactaattataatattcatatggaaattcaaagagcacagaatatccaaaacaacaacaaaaaaagaataatgatagaagactaatagtatctgatttcaagattacaaagctacagcaattaagagggtatggtagtggcctcaaaaatagacaaatatatcaatgaaacaggacagagtccagaaatcaacacatataaagacaactaattttttaaaaagacgtcagtggagaaaagataatcttttcaataagtggtgctggaacaactggatatgcatgcagaaaaaaaatctcaatgcatacctcacaccatacaaaaaaattattcaagatatatcgatttaaacctaaaagctagacccataaacttggagaaggaaacctaggagaaaaatcatcacaggaaggcaaaagctcttctcaataattacagggaaaaaaggcaaattaaaattttctcccataaaaagacacttttaagaaaatgcatagagtatataaattttttctcaataaagctgttacaggaagaaagagagggaggaggggaaaagggagagaatgcatacataggcaaggcacagatgaagaaaaaaatctacgaaacataaatctgacatgaatccaacatttctgaaactccaacaaccaataaaacattgggcaaataagttgaacagatgtcacaaaacatgatatataaatgctcagtaaatttgtgttaaatcattaatcatcagggaaacgccagttaaaatcacaataagatgccactacataaccagcaggatggctaaaacatggtttaaccctaactcccacacagcaatggtgagagtataaaatggttcaacaaactttgaaagaaaagttggggccgggcatagtggctcacgcctgtaatcccaacactttgggaggccaaggtggacggatcacgaagtcaggagattgagaccagcctggccaacacggtgaaacgccgtctcgactaaaaatacaaaaattagctgggcttggtggcgcatgcctgtagtcccagctactcaggaggctgaggcagaatcgcctgaacatgggaggcggaggttgcagtgagccgaggtcgtgccactgcactccagcctggcaatagagcaagtctgtgtcaaaaaaaaaaaaaaaaaaaaaaaaggaaaaaacttggcagtttcttacagaattaaacaaacacctaccctctgacaagtcaatttcaatgttaggtattgctcaaaactggaaacagcccaggtatccatcgacaagacgatgaataaattgtggtgtattcacccaaagattcatcagaaaacaagaaaagcaaacaactgatatacatgacatgataaattgcaaaaacattatgctgtgaagaaagccttacacaagagtatatattttacggttcctagatgaattctggaacaggaaaaaaaagctaatctatagtagaaacaaaacagtatgggcagcaggggaggcaaagcgaggagtgacatgggaaggagcttcagggaattttgccatcacccccagaacattctgtaatcttgaaaggagtttgagttacacgtttgcatctgttaaaactttcccaataatctgtgcattccgctatatatatatcacaaaaggaaaaaatatatataagcattattgaaccctaggtaacgatataaatactgacatacttaggcaatagtgtgctgactacaacttactttttatttagaaatgcatctaaataaataaataaattatagtcagccctcagtatcctcggaggaactggctgcaggactcccacagatattaaaatctgctaatactcaagtcccttacataaaatggtatagtatttacatataacctatacacatcctctggtatactttaaatctctggattacttataatacctaatacaatgtaaatagttgttatactgcattgtatttttatgcgtattattgttgcattgttttttaatattttttatctgtggatatgaaacccatagggggccaactgtatacagagaaggatggagagacagatgtgtgataaagcaaatatagtaaaatgttaatattaatagtaggctctagattgtgggtatacatatgttaacagaaaaattcaaccattctgtattcttgaaatttttcataataaaatgttgaagggaaaattaagcatgtgtgcactccccgtgcagctttttctaataaaagaactaattatgcacagacttcattagaggggaaaagaatgtcatgttttatttctccatattcattcaagtaagtattctaagaattttaaatcaaatgggttgagaaacaacatataaatgataataaaatttggtagatgctgtggtgactaattgcctcccctcatcactcaacacacacacacacacacacacacacacacacacacacacacacacacagcaccaaggtttaaacacagattccaaattcaccatttcaactaatacctgttaaaaagtgccaaacaggggccaggcgtggtggctcacgcctataatcccagcactttgggagaccgaatcacttgaggccaggagttcgacacctgctcagccaacatggtgagacgctgtctcaactaaaaaatacaaaaattacccgggcatgatggcgcacacctactcaggaggctgaggctcaaaaatcacttgagcccgggaggtggaggttccagtgagctgagatcgcaccactgcactctagcctgtctcaaaaaaaaagaaaaaagaaaaaagaaaaaaggcaaataggtatttacagtccatacttctctcctgagcaacaaactcacataaacagctgcctattatgtgtttctacttagatatcatacatacctcaaaatacaacctatttttctcccccccattccctttcccagatgaaggataccaaaaccatactgtctggcccgagctagaaactggagtgccctagatgactcctctgccaacatccctatgtcagtctccagccctgtcaattctaccacccaaacatctctactaacacctcctccactctgttccactgtgccactacattaatgcattctttctttcctagattacaacagcctccaaaacagcctttctaccgccagcctctccacctagaagccccataatctacttcctgagcaagaataagcatctaaatattacctagaaaatataatatcctacaatttctgcaaaggagaatctagttaggaatagttcaattagaatcttttataaaatacatttacttttccattggcttcattggtcttattttcaggtgaactattaaagacagcttattaatgctataacactttttaagttaagaccagatgacaatgatgattttattatagaattgttgctaagcatattttgtgttatcagaatcattggcacatggactatacatttttttctcacacattctatacctcaacaaagcttcaggccaggcgcggtggctcatgcctgtaatcccagccctttgggaggccaaggcagggggatcatctgaggtcaggagttcgagaccagtctggctaacatggtgaaaccctgtctttactaaaaatacaaaaattagaagggcgtggtggtgatgcctgtaatcccagctactcaggaggctgaggcaggagaatcgcttgaaccccggaggtggaggttgcagtgagccgagactgcgccattgcactccagcctgggcgacaagagcgaaactacgtttaaaaaaaaaaaaaaaacagtcgggtgtggtggctcatgcccggaatcccagaactttgggagtccaaggtgggcggatcacgaggtcaggagatcaagaccatcctggccaacatggtgaaaccctgtctctactaaaaatacaaaaattagccaggcatgatggcaggcgcctgtagtcccagctacttgggaggctgaggcaggagaactgcctgaacccgggaggcggaggctgcagtgagccgagatcgcgtcactgcactccagcctgggcgacagagacagactccgtctcaaaaaaaaaaaaaaaaaaaaaaaaaagggcttcaaaagtctttctgaaatgtttaacatcagtactaaattattcagggcagagtgttggtctctttagaagcaccagagcatggggattaagaggaggcaatctgaagttaaacctaagtgaattacaattctggctctgtcatttcctagttgcgtcaccttaaacaagtttttatttagcctcattaagcctctgttccctgatttctagagtataataataacagtaatacctcatggatctgttgtgagaataaaaccatgtacatgaagcattcaagtatctggcacatgttaggtactcagcgatgttactcattactattactgtgagcagcaacagtattttggtaaatggagattgcaaataaataaatctagctatctgctagaaccacaagtgagctcaacactaccaaacagtacacctttaacatttgatgtgttaacaaacaatcccaaagacccacatgcctcgagccatcctctgaccaatacaagaatctaaacttcccattctgccagtctgatatgtggggagtgaacgtgaccaattccctatccagcaagtgagcctggtgaacttcctatgaagtgcatcccaatgaggctctcttcatttttactcttccctggatactcattttatgtggtgggtattctaggccaaagtggttatctgtcaatctgagaatccgcgatgtttagtacatctctatgaactgaaatacaattctaacttcttgtttcaatttaagttaactgctactatatgtgacttaaggtttatgtacttttcaagtcctcagaaattgtcttttgttatattttagtatttggattaaaagtcaacttgaaataaaacataaatgaatataactaaaccaattatgaactgctgcttcttatgcttaaatataacaacttgaggaaagcctggttttactattatcctaaggaaacccttaattttccaagagcctttcttggacatttgtggctgcagaccagatatttatagtttggcaaatacatacatttgccagctgccaacttctgctcacaactactttataaaagttgtaaaattctgtcctgaaaaacagcctgtccactacagctggggaaacatatttatttctctttctctctccacatctagttcctccacacagatgaggaatacggcccctaaacatgacatgccagatgacccctggcacaaatttgctatatcaaacgaagttcaaaatagtttagttccaaggactagactagctataactaccatatagctataactatcatataacaaaaatgccagaaaagattgataagagatggcacatagtagaccttccccccacacacagactaaagacgtctagccaccctgaagagcaaacagatttctcaggagtttcatagttcacattaaaattgaatgagtattttataattcaccccactacactgcctatcttaatataatgttctctccataaatctttcagtagaattatcttccaggtagatatgccacttttgtcatctacagtgtgctccatatgcttgcacactgcagcctgcccctgtgtgtgtgtgggggggggggggggggtggggggtgccctagtatgagaacccagaagtaccaaagagtctttgtgacaagaggaagactgaatgttaaggtaaataccaaaactttatgctttgagaggggtggaaaagtaagtatagaatgcagtgtcacgcagttgacactaccaacagaacaaatatgatgaaagctaagagtgatttgggaatcactagcatatgatgttttgttcacacactttggcaatgtgttcagaaagtaattttagcacagccataaccaaagagaattactggccgtaatctgaaaaacagcagcccacttttatcattcgtcttcagctaattacgaaccgcatgacattcaaaagattctggaacttattgtcctgtgcttctacaaaaggttaaaacaaggtagaatagtaattattacaattttttaaagctgcttgactagaaggccttaatgttgtgcttttctgataatatcaataaagtgtagttattaacaatcaacagttgcttgcaaagactactggaacctactgaagaagtaaccaaattgatgggccttgagattacacttggtattcttacatgattttcagctataaaaattcccttttcaatctgccttaggaagaaggtgaaacgagtgtgcctgccataaatgttggcatgaggctagaaattcagagatgatcttgttatcttgagaaccattcacattgcttctctggaacactgctagattcaaagtttaaggacaaactgttcttaaatggatgtgaaagtgacaggcacatgcaatatattttacttctaatttgagtaaggacatcttcaaacactgcgcaaagtctcagttttggggaaatttcaatgaaattacatcattacaacaatctattaaatcctatcattcccactggggcaacagtctctcttctcttcactcatttaatcatgctattcctgattgtcaaataagaaaatccttcctttcctccatcaccttcttaattgttactgctcaattgtatctcccagttcacatccaagtagtctactcagactgccttcttccaaaaacatccctctaggagggaggtctccaagcgccacagaactgcagggatactcctaccacggcatgatcctcactctattacgatgatttgttgattagactatacacttaccagtgtagagaactgcatcacctctatctacaatattaatatctgaagcatattcaagcatctgctgaatgtcaaattagtaaatggaacataatgcccagcaggaaccatggataaccactattttaatctttttaaactttctttagtagagatcactttcaatgaaaataatacgcaattctgcatttgaagtttctctttatgacatctttgctataagtacaaaatactttatagacagctttgctaagagcataatcaatgaaggttagaaactacatatgctctcaataaacacagaattaatacaatcaagaaaaaataggtatacagaaaacacagacagtatcagagctatttaattgtagcttgggagcaactcaatcttaacactactaaatcaaccatggcatgaagaatctaagtatttaggtaaattttaatcagcccaggcgcggtggctcaagcctgcaatcccagcactttgggaggccaaggcaggtggatcacaaggtcaggagttcgagaccagcctgaccaacatggtgaaaccccggctctactaaaaatacaaaaattagccaggcatggtggcacgcacctgtgatcccagctactcaggaggctgaggcaggagaatcgcttgaacacgggaggcggaggttgcagtgagctgagattacgccattgcactctagcctgggcaacagagcgagactctgtctcaaaaaaaaaaaaaattatcaaatgaaatacaaaagctgaagttggtaatgcaatttatcttgacaggagtagctggtcccagttactctaattgctatcaaaatgaggggagaatactctcagctctccaacagaaaacctaaagccagtctcctaatcatgaaatgtggtatgtcatgacaaatagttaggtgcctaaaacaagggcaggcactacccagaacattttaaaatatgatattcataccctttaagaatttttattcccatgtgttaggatctcttcatttgtagcagctgactatcagctggcataggacccaaatcatgatcctactgctccaagtaattcacatacatctccaagcaacagctgtgtaatctttatagtatagctaaaaatataaagttcaaaacattaaatgaatttcatctaacatttaggaatatgactgaaaaagaatacagttaattcatgctaaaggagtaacttagcagaaggcaacattcaaaatgagtaatccaattcataaaaaataaaaatgttatgggctatattttaattttagaagtgtcctcttttttcctcaagatatgcaatgtctgcaactgaacttaagcattttttctcattattatttccttactactaaagaggatacccttttggttaaaaatttagaaactatagttttctcagcatcttgacataattctatagcctctcacaatttttctaataacaaagaaagactcttctgaagctggcttatttttttattccttgactgacctcataagctgcttagctgcaaaagactcatgatatctttaatactctaccctggaaatcccattgctagtgagacagacagctatgtctaacacaaagtactcttcattgaaaaaccgaattttcagatattttccccccttagtgataaccaggaatttatattttacttagggtaagcctgccaggcaaacccacatgactgatccttctacgagtcagaactagcacttaatcagcaaagagtcaggactcaagttgagtttagccctctctggttttcaatgtcctgatctcttaaacaaaaaggttcctgaaattacaccagccttattacaaaactaggaggaccacatatagccatagtaaaactaaacagcttctgattaagaaggaggaagggaaaaaaactggcttccaaagtactctgttcaagtttaactatactcctcaaatagcatttaaattatgaaacaataataaaagactagaaatattcttctccaattattaagcctgaaaagagtgatttagcatatatacattgctctaaatccattgtaatgtttctatgaagttttatttattctagaaatacactttgaaaacttgattttacagatagccacaaaataaaaacatcataatcaggcaacacaggtacaacttgggcagtgaagggttaaaaactactgtttatctgcagttggacagtctactacttacacacagctgacatcttaagacttcaacctttctttaaatgttcaaatgaaaattaaaacatctgaccagtgggataaaaatggcaactaaattgaacaagtggtcacagctgttaggtgtactgtttctgtcattctgatgagatctaggatagaagacttctaaatccccttcccacctctccccttcttttgcccatactttttaaaaagacaataaaagtcttcaagtcaaatactgaacatcaatcctacatgtaggacgtatacccaaaatagcctattatttatgtttccattccgccgtgaaccaagtattctacccataggaaaatataagaatttaaacattaataccatattaaatcatgagtctccatgtttcataatggtagtgccttggaacaaggtcaatactgaaataaaatataacctaaagtgggagatgttagacaaaatagtcgttattcatcaaaaatgtctatgttaagactgaggaattgttctatattaaaagacacaaagaaggccaggcatggtggctcacacctataatctcaacaccttgagaggccgaggcaggaggatctcttgggcccaggagttcaagaccagcttgagtaacatagaaagactctgtttctacaaatttaaaaattagctgggcatggtggtacacacctgtagtcccagctacccaggagcccgagacaggaggatcacttgacccctcggaggtacaggctgcagttagccatgactgcgccactgccctccagcctgggcgacagtgcaagagcatctcaaaaaaaaaaaaaaaaaaaaagacgctaaagagatgtgacaatgaaacccaatgtgccatgtgaattgaatcctgggccagaaaaacaaaaaagagtatttttcttcttttgctacactgaaacggaacaaaatattaatagatgatgcataaggcctaccgaaggtccattctaacatcatattctactgagagctagatctgaaatcaacctgtttaactttttatttaaatccttactttctaatcaatgacattttaagagtttctctccacttaactttttttttttttggcaaatattaatattcttttccagttctatgcttctgtgttaccggaatcctcacaaaacctctgcagtcagtattcttcactccttttttaaggtaaggagacagttaacataaagaactgaagaaacctaccttcttcagagcacccagctggacctaaagccacttcccagtgtttaacacactaatgactcatgcatgtggtagagttcttccacttacaagaggattcctatccttgcatacacacatatcaaaaatttttaattattactttaatcatttggaaagagaatataaagtaaattatataatatcttgctgttttctaaaagataatctacccaagagtgaaaaatagaagaagaaagtgagaaagaaggaatgaagggaaagagagtaaagggggaaagcacaaatacagagagagtgaaaaaaaaaggaaaagacagaaagtatatcgataatttaaaaaactaaaaattctagattaacatcaacttgactgggtgaggggagacctcacccaagaacacagaatgaaataaagtacctatcttattaaagagaagatagtaacattactgagttttttttaatcaacaggaataaccatctctatgttttaagggcaaatggctaagaatacacacacacacacaaatgtataacctttaaaccagagaaagaaaattctatccatctattggaaaacaggacaaaaagggatggaaaaaaataaaagaatgggaaaaggtgtaaaagacaaaggaaagctggaatagcaatcttaacacccagtaaaatataaagacaaaattatagaagaatggcagctaacaaaagaatagaaatggaaaatcaccatttaaaactactataataatatttgattcaggcaaaaaaaaaaaatcaacgggtgctaaatcactgagttagggagtgttagttattcagtttcaaagcatcactctacagtccactgagtaattagagaaaaggatgtctttaaaatggagagatctggtggacactaccttaacaaaataatcaaacttaatttcgcaatattgggaaaactgccatcaggtgcctccagatgatggactgaaaagaacacatcactaggtaatacaataaacagtcctgcccaaaaatgtttagcctgaatccattcatgcaaaaacaatgaaacaaatccaaaatgaaacatatcaaagagaacagatctttcacaaaacaactggcctggcctcctaaaagtggcaacatcaagaaagaaaaacaaagctaaagagagactgaagagacatgaaaatgaaatgtaatggtagaatcctgaatggagaaagaggaaggctaaagggaggacagtaagaaatatcattgggaaatctaagaaaatctgggtatggaaagtatattagatgatattcaatttccagagtatgataactgtactgtgattatgtaggagaatgcctgtgttattcacactgcggagtaaagtgctgtgacttaaatggtttggatgtttgtcccctccaaatctcaagttaaaatgtgattgctggctgggtgcggtggctcacacctgtaatccttgcactttgggaggctgcggtggggagatcacctgaggtcaggagttcaagaccagcctgaccaacatggtgaaaccccgtctctactaaaaattcaaaaaaattagccaggcgcctgtaatcccagctactcggaagactgaggcaggagaatcacttgaaccccggaggcagaggttgccgtgagccaagattgcaccactgcactccagcctgggcgacagggccgagactccgtcttaaaaaaaaaaaaaaaaaaaaaaaaagtgaccccctttattggaggtggggcctgaaggaaggtgtctggatcatgggggaggaggatccctaggaatggcttggcgccctccctgtagtaataaagtaagttcttggtctgtcagctcacttgagagctaggaatgctggttatttaacggagcctgggtcctcctcttctctctccccatgtgacatgcctactcccacttcactttctgccatgagtaaaagctccctgaggcctcacaagaaaccaaccagatactggcaccacacttcctataaagcctgcagaaccatgagccaattaaacctcttctctttataaattacctagtctcagctatttctttagagcaacacaaaatggactaacactgtgacttactctcaaatggtgcactcaacacacacgtagaaaatgagtaagaccgctattcgggagacggaggccgggaggatcacttgagcccaggaggtcaaggttgcagtgagccatgttggtgccattgcactccagcctgggcaacagtcagactctgtctaaaaaataataataaataagaaaaaaaatagatgcagctaaagtaatgtttaatgggaaatttatagttttaaatccttatgttaggttggtgcagaagtaattgtggttttgccacatttaatggcaaaaaacgcaattacttttccaccaacctaatacaaaggcctaaaagcaacgacctaagtgagcttccttcttaagttagagaaggctgagaatagtagctcatgcctgtgatctgagcactttgagaagctgaggtgggaggattgcttgagcccaagggttcaagaccagcctgggcaacaaggtgagactctatttctacaaaaaaattaaaaaattagccaggcatgtggtgtgcgcccggagtcccagctactgggggaaatgaggtgggaggatcatttgggctcaaaactgcagtaagctgtgatcacaacactgcactgcagcctgggagatttaagaggaaaatatatagctttaaacatttaccaggaaataaaaaagactaaaaaaaagaaaaagaaagaatattaattggtaaagctatatgatgagcaaaataattttctttgtaacattcttacaacattcttaaaggtctgaaatttttccccaaaaaaagcaaattaaaagggatttaaaaatacatgaagaagaggctatatagtgatgaaaatgacagcaaaatatatctacccacttcaaacaggtcttaaaatatattcaacaattaacagaactgtcagagaaaaatcaacaattactcttaatcaactctgttcagactactgatagatcaagcagacaaaatataagcaaaaaaattcaagttctcaacagtacaaacagaaggttccaattacggccaggcacggtggctcacgcctgtaatcccagcagtttgggaggccgaggtgggcggatcacgatgtcaggagattgagaccatcctggctaacagtgaaaccccgtgtctactaaaaatacaaaaaattagccgggtgtggtggcggacgcatgtagtcccagctacttgggaggctgaggcaagagaatggcgtgaacctgggaggcggggcttgcagtgagccaagatggcgccactgcacgccagcctgggtgacagagtgagactccatctccccgccaaaaaaaaaaaaaagagaaggttccaattacaaaatacttatattaaaaaagaaagtcctaaaagcaatgacctacacttccttaggtcaaagaaatacatcccaatggacggggatacattttttttctcacataccctaaacatttatattactaaaccatgtggtaggcacaagggcatacagattatgttctgatataatacaatgaactcaggaatcaataatttttataaatattcaaatttggaaactaaaaaaaatataacttaataacccttacgttaaaaaggaaatcaataaaaatcaggaaacatttagaaaatatatgttagagccaaggaagaacttgaggaaaatatatggctttaaacatttaccagaaataagaaggtgaaaaaaaagaaaagcctaacaaagaaaagccaaataaataaaaaggaaagaaataataaaggacagaaatcaatgaaaatctagtccaaatgaacaattaagaagataacaaaaccaaaagctgtttcttggtaaatattaatagcctagataaaattctagtaagattcatcaagaaaaagacaaagaagatccaaaagaagagaaatgacaaaattatcagaagaaataaagaggatttgaatagattgaaagaaaacaggttgaaaaacagatcaaaagattaaagcaactgaaatggcaatgctcttctcccaacaaagtaaaacaaaacgaactccgtgatgagacctttttttaataggtggattctactaagcttttaagaaacattctattcttatcttatacaagttgtttcagaaagttaaaaagaacaaaagctacggtcatttttatcaggctagtattgaatctaaaaccagataacaatgctataaagttacagcctaaataaaatactgactaatcaaatccaacagtgtttttttgttgttaattattaaaggctaaaagaaaaaactcaggtggttatcttgatagaagcaggaaaacaactggacaaaagaagaacctacttaataatttttttaatctatgcaaacctggaatagaagggagtttccttaatttagcaaaggttatatatatatatcaaaaacgtataacaaatataaaatagagacttcaaaagcctttccctatgtcaacaaatatgaccatgctgtctagcacagtgccagactggccaacactgtaaaaaataagagtgtaacatttgaaaagaaagagagaaaactgtcactgctgctgatgacatcatcatctatctagaagaaccaaaacaatccacaaatagaataacatttctccaccaaaattaatctataaatgtaatgcaatctcaaattgccagtttgattctttaaagaattcaataaacagcctacaatgttcatgctaaaataaaggctaaccaacagctaaatcaacctcaaaaaaaaaaataaacttgcttgaccagatattaaaacatactatgaagtatagccaacagtaagagatatgagcacaaaaacaaatacccaaatagaactaaatgagaacttactctgggacacaaagaactaaatgataataaaggattaaaaggtacccacaaatcaatggcaaaaacaatagaaatttgttaatggttcttggctatccaaaatgtgaagactcaacctttaagcagtcattctccctaagtaaaaataaataattaagcaaatatttagaattatatgtataacttcttaaaagctcaaaagtttaactacaccgatggctctttattatatagcgcttgagatacatactttaaagctcctaaattattaaaagaataacccctgaaataaattgaaatatggtaatttgcagcttctataaaattacttttattaatttaataattacacattaacactcaaaaatagtcaatgaaagttagaaaaaagtgtacctgcaaatataaccgtgcttttctctttctccaaaactaagctctgttcatctttaaattcagtactagtatcaaacttccatttcaaaaaggaaaggaactgctatgtttattctaccacagcctcaaaatgtacagaggcattcattacaggcatgctctggctacccaagtgctatgagtcatgtttattttcaaagacaacactttgaaatcaatcagaaggactgtgaaaaagtacattaagaaaaacattggtatctaccaaatgtaaagttttcaaaattagaccatcagccaagatacaaacttgtaaaactgaaatcactacaaagaatttcacaaatttaagtagctaatggctatgggtttaaatggtcaaaataaaaattgctgatcacttagaatcaaccacaaggaacaaaaaaagtatggtgaaatcacacatgtggtataaaattaatgaaattattacccagtagccttttgcataccaggttttcaggggtcactcattctaaatcttatttattcaaaactttttgtgagtgctataatttcaactagaaacttctaataagcaaaaacttgcatgtatgccaaagaatctttaataacactacacactatgagtaataacactgtcattctactaattaaactcaaatttaaacaagctactttcagtggcagacataaaaaccaaaattccttatcactttgactttgaaaataacactcttaggaggtattctggacataatcaaagtccaggctctctcactatttttattcagtgaagttattactgtttctcttaactttggaaaatgtcaatgacttgctgagggagaacaggcaggcagagctaaaggaggaaaatgagggcttaatataaatgggggtaaataaataggtgggaaaatatgccccagacagctattaaacaaagggagactactattgtgtgccttatccactagaaaaaaacaatattttaaaattgtacaaatgtggccaggcgcagtggctcacgcctgtaatctcagcactttaggaggccgaggcgggcagatcacttgaggtcaggagttcgagaccagcctggccaacatggtaaaaccccgtctctaccaaaaaaaaaaaaaaaaaaaaaattagccaggcatggtggtgggtgcctgtagtcccagctacttgggaggctgaggcaggagaatcgcttaagcccatgaggcaggggttgcagtaagccgagattgcgccattgcactccagcctgggcaacacagcaagaccctgtctcaaacaaaaacaaacaaaaaaaggacaattgataaaagatttagagagggctgataaagatatgaaaaacattaaagctagctagtaaagaaatgcaagttaaataaaacaagatatccttttagactttgatacttaggagaaaacagtaatgttagagtgggaaaagggcatcctcataccttgctgataaaaaagcaaaggctcttgtccttatgcatcaagaacctttgaaacgtgaatatccactgactcagcagattacacttctgtaggtttcacttaaagcatgtaaaatgttaaactgaactacatgatgattggaaattctgacaagcgactgggtaaatacaattgtagattgaatcttaagaaactgctgatattcaaccacttgtgaatagaaagactaagcaattttaaaatgatacatatctacactcgaaattgacaccttctgatattaaataagggggaaggatacaaaacactactttggggagtgggggagagaaaagaccagtaagaacataatatttagaagtcaactcgatgtcaggcacttttaacatacatcgtccttaatttcttaccatcattctgtgatgtacagttactcccagttcatagatttggaagcaagtctcagagaagttacaaaaatttagggaactattaagaggcaaggctagagttcaaaccaggcctacctatctgactacaatgtccgagttatttccacttcatcacactaatacattcctttctgaagtgtatcagaaatgatactcctttaaatgcatgagataataaaaatatttgttatgtgctgagctgtgcccctccaacacccaccaaattcacatgtgaaaatccttacccccattacctcagaatgtgactgtatttgaagacagggccttaaagaggtaactgaggtaaactgagtatacaggtgggccctaatccaatatgaatggtgcccttataagaagattaggacagacacacacagagggaagatcactgtggacagagaaggagagccatctgcaagccaagaaagaggcttcagaaggaaccaaccctgccaacaccttgaccttctagccttcagaattgtgaggaaagtactgtttaagccactgggtctgtggtattttgtcatggcagccctagcaaactactacaacactcttacctaaaaatactgaacatcttaaaaacctaaacctcacattccccttttattattattttttaatgttccttttggatagattatgcttaaaataccaaaatggaatttttcacaaatacttttaatgttatattagaccattaaaaaaaatacacctgaatgtgacctattagaattaccatattttggccaggtgcagtggctcatgcctgtaatcccagcactttggaaggccgaggcaggtggatcatctgagttcaggagttcgagaccagcctggccaacacagcaaaaccccatttctactaaaaatataaaaattagccatgcgtggtggcaggcacctgtaatcccagctactcgggaggctgaggcagaattgcttgaacccaggaggcagaggttgcagtgagctgagaacgcaccactgcactccagcctgggcaacacagagcaagactccatctcaaaaaaaaaaaaaaaggaattaccatattttaacatattagttgataagcactcgtacaatctagttaagctataatgtagtccattcaaaataagtcaacttttggccagatgcagcggttcacgcctataattctaacactttgggaggccaaggcaggcagatcagttgaggccaggagaccagccttagtcaacatggcaaaacctcatctctactaaaaatgcagaaactagctggacgtggtggagtgcacctgtagtcccagctacttgagaggctgaggtaggagaatcccttgaacccaggaggcagggattgcagtgagccaacataacaccactacactccatcctggacgacagtgcaagactctgtctcaaaaaaaaaaaaaaaaaaaaaaaaaaattattttcaataaacttaaccaatcacaaaactagcccttctcacacaaatccaataaaataactacgtacagcccaaggtcctgaataatgcagctgagagtgccaggcacacagacctgtgaaggcctcaccacaatagctcaccttttcctcggcagagtggagcagagtgtttcttacaagtccaacactaaataataaataatttataaatgcagagactacaaacaaacagaagaggacactacagcagactctagatcaggagtgtgcaatcttttggcttccctgggccacactggaagaagtgacttgggccacacgtaaaatacactaacaacaacgacagctgatgagcttaaaaaaaacaaatcgcaaaacaaaaatctcatgttttaagaaagtttacgaatttgtgttgagccacattcaaagccatcctgggccacatgtggcccacaggccatgggttggacaagcttgctctagatataagcacaattttgaaagccgaaaagcagatggattagaggtaactgacttagtaggctgaagaaaacagaaactgtctagcagaattactgagggaatgtaccaagaataaagcctagaaaagttcaggaatccagagcagggtggggggcaaaaaaaaaaaaaaaaaacacctggttgaaattctagatacggagccattcatcgaaatcccagatatcataacccaaacaatgccatcagacactcagcccattactctgggaagtttacacaggagagactgtaaacaaaggcattctgagggaggtatgatggggattaaatgcaagcctaaatactgaatgataacttaccacccacccaccaccctccttttccccaattcaccacagaattctggcagtcaagcttagacaggaaaacaaaacagcctaaaaaagagagacctggagacactgacagctgagggtccccacggaaagccagattcaccagttcatccctcagagaggaagaccatgtcacaggcccataccatggaaagacttcccaacttgctttaaaaataaaaacttttttaaaagcctcaggcttaagtctgaacagataggcaaggaacatcaaacatttaagaaaacctttaatttgaaagataggaatcaaaacagagcaagggaaaaaaagaaacaacgcaaggaacagaatcataatatcctcaaagggtcgaaaaaaagatacgcatccgtgaaataagaatgattaaaagaaacattcataaaacaaaagaaaagcttttcaaattaaagacagcagaaactttaaatccaataaaggagttggaatataaaaaacagaaaaaaaaaaaaaaaaaagacaaaatcagacagcaaagagtagataaaagaattcagaagacccaaaaaccccctaacaaggagttctcccttttcagagtccattaccaaagaaacaactttctaagcattgaagggcatgtttctaaaataaaaagatccatcaagggcacagcacaacagacttttttttttttttaaacaaagactcacattaagaaatatcattataaaatttcagaacaccaggaataagagaagatcctaaaggtttccagaaagaaaaaaacagctttcttataagggtcttggaggccaggcaccgtggctcacgcctgtaatctgagcactttggaaggcagaggcgggcagattacctgaggtcaggagctcgagaccagcctcatcaacatggcgaaaccccgtctctactaacaatacaaaaattggccaggtgtgatggcaggcacctgtaatcccaaccactcaggaggctgaggcaggaaaatcgcttgaacccgggaggcggaggttgcagtgagcagagatcacaccattgcactccatcctgggcgacagagcgagactctgtctcaaaaaaaaaaaaaaaaaaaaaaaaaaggaggggggtcttggaatcaaaatgacatcagacttttcagagcaactctagaaacaagtcacttgagtaatgccttcaaaattttgaagaaaaataatttccaaccttgacttgtaaatacagccaagttatctatcaagagtaggctctaatagatattcttaaatattctaagtctcaaagaatttgcttcccatgctttatttctaagggagctacaatgaaaagcaacagaataaggctgaaagaattcccatgaaaatggtaaaaatcccactccaggaagcaagccaagaaggcaatcagttcaactggaacacaaagttagaggtatccaaaataaaaaaaaaagaaactgaaagattacctgatgtgtttattatattaaaaggagagttaaactttagtagtatagtctgagctgagtaagtgatgaatgcatggaaaacaaataaacacaaagattcattaaatccagctaaaacaaaaagctgtttcaaaaaaaaaaagtaaccatattaaaatagtacacagcatggctccaatgtgaatagttatataaactttgattaaccaaaattggttatataaccatatagagaagatggaaagtatgcatcgtggggaggagaatgtaaaacagctaaaccactatcttccatcatggcaagtcaaaagataaatctaaaattgaaacagtcaaaaaaggttagtttaaacacgttatctggaaattaaaaactaccaaagaaatatgtcagttgatagtggttcctcttgagagctggattctagcaggaaagggaaaaatggattttttttttttttttttttttttttttgagatggagtctctctgtcgcccaggctggaatgcagtggcacgatcttggctcactgcaacatccacctctcaggttcaagtggttctcatgcccagcctcctgagtatctgggagcacaggcatgcgccaccatccccagctaattttttatatttttagtagagacagcgttttgctatgttggccaggctggtctgaactcctggcctcaagtgatccgcctgcctcagcctcccaaagtgctgggattacaggcatgagccaccgcgcccggcctactttttttattagccttgtaaaactacatgactatataaattattaatatgtacatgtataccacatgataaaaattaaatttttaaatcatgctctaattttttaaaaccatgctttagaataatatttaattacagaggaaagtattcacagtatatttaggggaaatcacattatagaacattatgttcaataaaaaaaaaaaactagcattgcctaaaaacaaacaggaagtgtatgtactaacgtgattttctctcaagtagtgacattattttgattttcttatgtaactttcaaatgttttataatatgtacgcattattttgtaattttaaaagaaaataagaaaagatagagaagtttactagagctcaaagatcaaacaattaaaacaatattgctttctgttccagttagtctctaggacctactgtggggttataataaatttgtgattttataattactataaaaatattgggggatactcttaacatttggtaagaaaagaacgataggtccccagtaaaaaaaattcttttttttcccaagtatgcttgcatttcattcatcttaaacttcataccaagattatgtgactcaagagagctgacttccaattttaaaactctggatgaaggggtcacaatccaaacttaaaactaaccaaataaatgaacaaaagaaaaccacttacaacttctccatgcctaaacagaactaaaattaaaagaaaaaaaagaaacagccaacaaagtagaggaattatttacaccaatggcgacattttaacgctagtacgatcaaccactccaaaagctgtatttggcccacatacacgctcaagaaaaaacaaatagcagaatattcacgacattataagatccaaaaactgcaaccaatccaaatgtccatcaaccttagaatgaataaactagtatttcacacaatagaataaaatgaatgatacagatgaacggcacagatctaacgttaggccgaaaaaggcagatacagaatatgttctatgtgattctattcacatgagtacaaaagcaggcaaaactaattgacgctgttctgggtcaggtggggttactctttggtgaaagactgtgactagaagagggcataaagtgatggttacacatgtgtactgagttggtgctatgtgcccttttctgtacatcttatatttcaataaaaatttcaagttgaaaaaagataatagtccctgtaatcccagcactttgggagccaaaggtggaaggactgtatgagcctgggagttctagaccagcctgggcaaccttgtctctaccaaaaaaaaaaatttatttatttatttacgtatttatttatttattgagacagagtcttgctctgttgcccaggctggggtgcagtggcgcgatctctggtcactgcaacctctgcctcccagattcaagtgattctcctccctcagcctcctgagtagctgggactacaagcgtgcatcaccacgcccagctaatttttatatattttgtagagatgaggtttcactatgttggccaggctggtcttgaactactgacctcgggtgatccacctgcctcgagcctcccaaagtgctgggattacaggcatgagctaccttgcccagacaaaaaaaaaattttttaattagccaggtgtggtggcccacatctttggtcctggctactcaggaggctgaggtgggaggatcagctgagcccaggaggtcaaggctgcagtgagctgtgttcacaccactgcactccagcacaggtgacagagtgagaaaaagataatactcaacggccaacaagcacatgaagagatgctgaacatttttagtcattagggaaatgaaaataaaaaaccacaatgaaatcaaaaatcacactcactaggatggctatcataaaaaacaaaacacaaaaaatttaaaaataatgtattcgtgaggatatggagaaattaaaaccctcatccactgctggtgagaatgtgaaatcacacagccaacggggaaaccagtttggccagtcctcaatgagctaaatggaaaattacctatcatgtaacccggccaattccactcctagatatatgtccgaaaaaactgaaaacaggtattcaaatacttatacataaatcttcatagcagctctattcacaagagctaaatggtggaaatgacccaatgtccatcaagagatgaataaataatcaaaatgtggtatatccaaacgatggaatattagccataaaaagggaagacgtactgacactgctatgacacggatgaaccctgaaaactttatgcttagtcacagaagccagacacaaaaagccatgtactatataattccatttacatggaatgtccagaataggcaaatccatggagacagaaagcagattcatggctgccaggggttgatggggaacagggattgggaaatgattgcttggtgggtacaaggttttccacttagggtgatgaaaaagttctggaagtagatagtggcaatggttgcacaacactgtggatttatttaatgccacagaattgtacacttttaaatggttaccatggtaaattttatgttatctgcattttcccacagcaaaaaaaattttcaaaacaaaaataatacttaatgctggccaggatacagtaaacactctctacactttggtaattggaacataaactaaagcttttgccaaatattctggcaataaatactaaataattcatatctttgccccagtttatattttgccttctgaggaccaaccgtaagaagcaaaaaagttttatatccaaagtgctcactgtaatacttacaataatgcaaaaaaaagggggggaggagggatctaaatgccaaactattggggaatgggtaagtcaaccacgatacatttacaaaattaattgtgtcaacactaaaaatgtttactaaggtatgaaatgaagaatgtttatattatgaagcaaatattaaaacagcagaatacaaattctaaaaatacaagccaaagtatacatctacaaagactcagtatgtgtcctatggttttgctacggacactattttcttcctactttctgtcccttgaacaaagcaagctcattttcattgcaaggcctttggacctcttctgcttagagtactcttttccctgctctccaatgactgcctcctcatctttcagagcaactcaaacgtccctccctaagaagccttccgtgaccaccccaaccaagttaggccttgccttcaccacccatcttttctcactacacattttatctttttcacacttactgagaataacagacttattggtacatccttctcctccattcagctaccagaatgtaagccccctgggtacatgacttgtttaacaccatttccccagggcagagaacagtgcctggtggtaataataaatatttgtgaagataataaatatttgttgattaacttgttccttctactttttcagtttgtcaattttatgtgtaataagcacatattttatttttaacactatttttaaatatacaactagatcaacaaacaacacttattgaaccaaagaaaatgtgtaactttgctagatattttctgagaacaaagcaaaggtctggttcagccataacaacaaaaataactaattataaactcttcctaataagggataatgctctactacaccttatagcatattttattattaaagatggggaaaaaaacagtgttttttctactctcacacaacacactcctgacaccagattctctggcagacactaagtgagttatgatttaactcaattctgacactatgtggaaataacatcacatcccataggttaagggatcagtcccagaagaccaccccaacttctaatgccaatctcatgccccaggttgtgacctgtgcttctggcccaatagctctaaatcagggttcccataagctctccccagagtttaatttgctagagcagctcacagaactcaggaaaacactttacttatgtttacccatttattagaaagatttttttttttttttgagatggagtctcattctgtcgcccaggctggagtgcaatggcacaatctcggctcactgcaacctccacctactgggttcaagtgattctcctgcctcagcctcctaagtagctgggattacaggcgcccaccaccatgcacagctaatttttgtatttttagtagagacggggtttccccatgttggcaaggatggtctcgaactcctgacctcaggtgatccacccacctcggcctcccaaagtgctgggattacaggtgtgagccactgtgcccagccaatactaatattttaaaggatacaaatgaatagccagacgaagagacacatggggaaggtctggaagggtcctaagagcaagagtttctgatctcctgtacctgggatgtacccccaatcgctgcacttggatgtgttcttgctcatccatctggaagctctccagactctatcctttgggtttgtatagaggcttcattatgtagacatgactgattaaatcactggccactggttatcaactcatccttcaggctcttccccttcccctcccaggagataggttggttgcttctcctagcaaccagctcccccaccctgaagctatccaggagccccagccaccagtcatctcattagcatacaaaaagacatttattacagtactttggtcagtccaagggttttaagagctgtgtgccaggaaccaggaacagagaccaaatatgtatttcttattatattacaataccacatttacctattttcactcagaaacctgtctcaaatttccgattccataaggtaagtaacccttcctccaacaccaatcctacctctattccacaacctcaatacccttctccatacacaaatccttaagagtaatacttttctccctctccctctccccggtctccctctccctccacggtctccctctgatgccctctccccggtctccctctccctctccctctccctctctctccacggtctccctctgatgccgagcggaggctggactgtgctgccgccatctcggctcactgcaacctccctgcctgattctcctgcctcagcctgcggagtgcctgggattgcaggcgcgcgccgccacgcctgactggtttttgtattttttcggtggagacggggtttcgccgtgttggcccgactggtctccagctcctgaccgcgagtgatctgcctgcctcggcctcccgaggtgccgggattgcagacggagtctccctcactcagtgctcaatggtgcccaggctggagtgcagtggcgtgatctcggctcgctacaacctccacctcccagccgcctgccttggcctcccaaagtgccgagattgcagcctctgcctggccgccaccccatctgggaagtgaggagcgtctctgcctggccgcccattgtctgggatgtgaggagcccctcttcccggccgcccagtctgggaagtgaggagcgcctcttcccggctgccagcccgtctgggaagtgaggagcgtctctgcccggccgcccggcgtctgagatgtggggagcgcctctgccccgccaccccgtctgggatgtgaggagcgcctctgcccagccgcgaccccgtctgggaactgaggagtgtctctgcccgaccgccaccccgtctgggaggtgaggagcgtctctgcccggccgccccgtctgagaagtgaggagcccctctgcccggccgccaccccgtctgggaggtgtacccaacagctcattgagaacgggccatgatgacgatggcggttttgtcgaatagaaaaagggggaaatgtgcggaaaagaaagagaaatcagattgttactgtgtctgtgtagaaagaagcagacataggagactccattttgttctgtactaagaaaaattcttctgccttgggatgctgttaatctataaccttacccccaaccccgagctctctaaaacatgtgctgtgtccactcagggttaaatggattaagggcggagcaagatgtgctttgttaaacagatgcttgaaggcagcatgctggttaagagtcatcaccactccctaatctcaagtacccagggacacaaacactgcggaaggccgcagggtcctctgcctaggaaaaccagagaccctgttcacatgtttatctgctgaccttccctccactattgtcctatgaccctgccaaatcccccctccgagaaacacccaagaatgatcaataaatacttaaaaaaaaaaaaaaagagtaatactttgaaatagtcacatttaaggcatgagaattatttcagactcactggtgacaatatgtcaatattaaataatgttgagaaaaaaatttaatgaatgagtttattcatacaagtaaatttcaaattaaaatacatttaaaaaggaacctaactacaactactctatgttgatgtatggttgaaatgcggattcacaagtacatgttatatatagtatttataattatatattgcatctatatataaaaattgaagataaaatattcttctaggaaaagataagctaattgagatgctcaaaaatcaaaagtgataccaccaatcagaactacaaagtcaatctaaatatctctggaggtggtaattccagactccaataaaatacaagcattcaaaatttatggttactgagtttctactagtgattggaaaactaactccacccattaaattaagatttgaaaccaggcatggtggctcaggcctgtaatcccaacactttgcgaggctgaggcgggcagatcacctgaggtcaggagttcaagaccagcctggccaagtggagaaatcctgtctctactaaaaatacaaaaactagccagaggtggtggcaggcacctgtaatcccagctactcgggaggttgaggcaggagaatcgcttgaacctgggaggcagaggttgcagtgagccaagatcatgccactgcactccagccggggcaacacagcaaggctccatctcaattaaaaaaaaaaaaagatttgaagatgtccaacttaagtgctgacctcagatcaacaaatgcaaatgcattatcagacacgaaaaagaaaaggacatttccatctgtcttccttatagttagttgaaatatacatgtccactgacaactatgacattacttctaaaagtgaatttaaattctattcacaaaataacaacctaaccaaataagcaaatatgtaagtgtacttccaggccctatacattatcctttcataccacaaaagacgttctagtactgagtgacagcttttagactatgcttagatagaaattggggttactaggatcctggctcaggatttagacacattatctgatacataaaggtcagcataaacccaaattaaaagcacccattgcaggttcttatatctgtggtattaaaaaagtattttttaaaaaactgaaaggatcttagctgtacagtgctaagtggacagtgtggtgacaggatggcaattaatttagtctcttccttaaactcaacttaatttgtatcatcacaactggtcagaggtatgattcacgcatgcaactccaactcactagtaagcttaggaatagccagctaagtaaattttactactaatgcttccaaaggtcattagaatttacattccaacacacaatatgaataaatctcatgtgatactgccatctaaaccatcagaaagcaccttaagtctctccccttaccaaaatggttagataatatacagctaattttgaactgaaaggttctgttaccaccaacctatgattaaatcctgagcaaaatcttaagggaaggcataacatttttaattgttcatcgtagctatcaattattctttcaaggaagctctcttaaaagaggaaagttatcagtcagaagcattaccagccagaactaagtgaatgtaactggaatgagcaggaaaacatttatccttgaggcaaaggaacataatttcaggaaccaggaggcagatttccactacataccaacttgcacctaatcccaaacagattgttcaacagctgttgcccttgccaaactggtctccattctcatccaaacatcccccggaggaaaatgacaattccctgaaagcaatcagccttactagcaatcaacttttccaaaaactggggagaaagaaaaagtgaaccatgggccaatatccctaaaacctaataaaacaatatcctgccagcagctctttatatgaaaggttcacgcatctcacttaaaaaagaatggtcatccagatacaaaattggccacagggacttctttcaatcatctagtggccaatttggaacctttttctcctcacctctccaagatagtacagcacagaaaaaaaggggaagataatcacctctctgttcctactatcaacttctgcttcatattcactaatacgtagttcactgatcctagacaggtgctcagaactgtctccacccattccacaaatctatcaagtgcctacctaccagtctttcttgttttcctctgaaatatagatgaattctcagtgatcactctacaaaaactcaacttagaaagtttcatgttctacttaaaacacttaaatgagaacactatctctgtgctttaggttttctgtttttaaccacctttataccagcaactaccaggaatcacctttaaaaaaattccaaaggattctactctatactaaattacattgcgttacatgcaggtaaaggaaagacatgagccagagttcagaggagtttgatggcaccagtggagagagagaaggcctactttctggcccacaataggagggcaaaaggttaaagaagtccgaggacccctacaatggcttaccttctatccccaagatgccaagcctacatcaattcatctcccaaatcagcattactcaaatgtttaaggcctgtgataaataaatacactgcatatacaacccagtacacacacacacacacacaaatgcacagacactaaatgtttcatgaaacacttgccattaccatgtgcaatgtttcctgaatattttctattgtctttcatttgtgataaatcctgttaaaaacctacagttagaaaaactaacctacagttagcaaaacaccacccttgccaatcacggtgggtcacgcctgtaatcccagcactttgggaggccaaggcgggcagatcacttgaggtcaggagtttgagaccagcctggccaacatggtaaaaccctgtttctactaaaaaatactaaaattagctgggcatggtggcaagcacctgtagtcccagctactcgggaggctgaggcaggagaatcacttgaacctgagaggcagaggttgcagtgagctgagatcctgccactgcactcctgcctgggcaacagagtaagaccccatctcaaaaacagaaaagagaaacaccaccctaaaatactcccacctccctagtcttattttggggatcaggggaaggaggatgactatagagagaaaacccatcagaaacttgggattaaggagaatccctggggcagaagggccttcagtctcagacatcccaatttaaaaccctgaatggtctcagagaaatgcttttaaaacacagctatcaggtcaattctgcagtctcagtgtcttcccaaataaattatagacatcaaatgtctggtgataccaaaaactacttgtaccctaaaagtattgaaataaaaagtacataaatgataataaattttaaaaattcactaagctaaaaaaaaatgtctggtgataattaaatgtaccggattgaaccatgtgaaactgccaacatctggtgatctgtgacttccaaaaacagtaatttcttacagtttagcctaatagtgtaacacatacttcaaggatacgatgcattaaatggccttgtgtgtactacttgagaacgtactagccctcattataacacagttcccacagaaagatatgtgctaagctcctaccaaaaatctgatttgaaagctggaactatctgcaattaagatgtaatgtgatctagtatctctgaatgcttttcaatgtgaccaccagcggtttcaacacttcgtcactagaaaagtaccaggcctcgcgcggtggttcacacctgtaatcccagcactttgggaggccgcggcaggtagatcacaaggtcaggagattgagaccagcctggccaacatggtgaaaccccgtatctaccaaaaatacaaaaattagctgggcgtggtgccacatgcctgtagtcccagctacttgggaagctgaggcagaaaagaaaaatcgcttgtacccagggggcggaggttgcagtgagccaagatcggccactgcactccagcctgggtaataagagcaaaactgtctcaaaaatgtcccaggcctctaatacaaacccactacttttccatgcaacttgggatacttgattcattcttgttttcacacaattaccaaatctggagcctcaatctcagcctgctactttctatcagatctatcttattttctgaaggtatgttcacttcaatcagatcataagctccttaaatgtggagatagggccgggtgcagtggctcacacctgtaatcccagcactttgggaggccaaggtgggcggatcacccaaggtcaggagttcaagaccagcctagccaacatggtgaaaccccgtatctactaaaaatacaaaaattagctgggcatggtggcgggcgcctgtattcccagctactcaggaggctgaggcaagagaatcgtttgaacctgggaggcagagactgcagtcagccgccatctcaccactgcactccagcctgggtaacagagctagactccatcaaaaaaaaagaaaaaaaagtgtggagatagtcctttgtagtctttgaaagcctccttccttatggtgatatactatcatttgataaaatgtgtcccgaattaaaacaaatctccttgggaaaatcttcacccatgtccacttgcctaatcatctttttaagagtgacaatgctatcatcctattaccaaattccagaaccttggtgtgacctttcacaccaaccattctcattatacttatcacccttctgactcagtatggccatgggaattacttctttaaatctatctctcttttttttttttttgagacgcagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaatctatctcttaatcaaccactaagattattttacatatacaccataatggcccagtcactcaatctcccaaattcttcattggcttttgttaaccgcacacatcaaatacaaacatttcccacctgctacatggacctctaactgaataaatcccaagcagtcactcctaaatttaccatttacctcagcacacagcttcagtttcacctaatcagaaattagttactctctgtgacatacctatcctccttctcaaagctctactcagtccttggagacagaagtatttgccttggaagaggggagaccactgagaactccctgtgctctctttgattctctcatagcctccctcttcgtatctctcacttcaaaagaagctgaaaatgtttctacttctaacatgaaacaatctatgtactatcatcttagatgtgtaaagaacatgtttttaacatgccattgctcaactctttaaaaagtcatactattattaagaccatgtaacaacatggaaaagtgtccatggttatgttcattgaaaaagaacactgaaggttattatacatattgagtgttaggcttatggggtgatgtcccttcaaatttgtgttcatatgtttatatattaggagtgatggatatgtttgctatcttgattgtacaccttaaatatgtgacatttattgtatgtcctcaataaaggtgttggccaggcactgtgactcaagcttataatccagcactttgggaggctgaggcaggaggatcctttgagcgcaggagttagagaccagactgggcaatatggcaagaccccatctctatttttttaaagctgttaaaatgttatatattgtattaaatatttgataagctatgtgtcttagttgttcctgctgctacaacaaaataccttagactgagtaatttataaacatgagtgtactgctcacagctctggaggctggggaagtccaagatcaaattgccaacagatatggtgtttggtgagggcatgctgttcatggatggcaccttctatttgtcctcatatggcagaagggcaaaaggagcaagctcccctgacctaaccacctctcaaagcccctaccctcttaataccatcaccttgggggtaggtttcaacctaagaatcttgggagcatacacatattcagaccatagcactatggcagaatgacataaccacaagccttaagcatgtaagggcagcttataagagctaggggataggggatcacagagagtaatttgcaccaggaagtaactcgaaggatggatttcaaaaggaaaaaactagaagcagtgaggggcacagggataagacataaagagaaatcctccactccagcacccccaccatggcccagtttacagaaccttctcaacttgaaacagaaaaacttgcaagttaaggctttaaaagtaggggaactttttattacagaaaaggttctggattatgctaaaatgcaaaagaaaggcagatagaatttttcaagacactagagttcttactacggatttaagagatctctgaaaaaacaggcttagagaaaaataaaacaaaggtggttttaattttgtctataattagcaaagtaaattcattcccttgtttttctaaattatatttcccaatttttctgtttggcttaatattggtaaaaatgcttcctctaaggctgttagattacaggctatctcatttatgttgttgagctcaccagtactaacctggtgactgagaaaagaaaaaaagaaattaagtctttatcagcaaagactcataatttcacttgtatattcaaaaatatgataatacttccattaacaaatttttcttttttttagattcaggggtatgcaggtttgttacacaggtacactgcatgatgctgaggtttgggcttcctgccccccaagttgtgaacatagtacccgacaagtagtgtttttttgttgggttttttttttttttttgagacggagtcttgctctgtcgcccaggctggagtgcagtggtgcaatctcggctcactgcaagctccgcctcctgggttcacaccattctcctgcctcagcctcctgagtagctgggattacaggcgcctgccaccacgcccggctaatttttttcttgtatttttagtagagatgtggtttcactgtgttagccaggatggtctcgctctcctgaccttgtgatccacctacatcggcctcccaaagtgctgggattacaggcgtaagccaccgggcccagtcagtacccgataagtagtttttcactcttgacttcctcccctgcttttggaatccccagtgtttattgttcccatctttgtgtctgtgtgtaaccaatgtttagctcctacttataagtgagaacatgcggttatttggttttttgtttctatattaatttgcttaggctaacggcctccagctgcaaagaacatgattttgttcttttttatggctgcaacaaatctcttgaaaaacataaaaactttaaatactaaaagcttcataggttgggtacagtggctgatgtctataattccagcactttgggaggccaaggcaggagaattgcttaaggccaggagttcaagaccagcctgggcaacacagcaagaccctgtctttagaaaaaaaaaatttaagattagctggtagaggaagaaaaggacaaagaaatattttaaaaataaatatggccaggcatggtgcctcacacctgtaatcccagcattttgggaggctgaggcagacagatcacttgaggtcagaagtttgagaccagcctggccaacatggtgaaaccgcgtctatactaaaactataagaattagctgggtggggtggtaggcgcctgtaataccagctacttgggaggctgaggaaggagaatcgcttgaacctgggaggcagaagttgcagtgagctgagattgcaccactgcattccaacctgggcgacagagtaagaccctgccactaaatcaatcaacaaataaataaataaataaataaatattttaaaaataaataaaaattccccaggtgtggtggtgcaggtctgtaatcttagctacaacctgtcctagacaatgaaaggatgctgtgatctcaacactggactctatccaccggggatgaagaagcccagattaaggtcccctaaaaggaaaatgccccaggattctgcttttgttatctgtcacagggttgattcttcccaggtcacaatcttacatggtttctacatcactgcatcaccaaataagtgggaaagctaaggactatgtgctcacctaacctggtgggatgtgaaacagctgaccccttaatgtgacagatagagctcatggtggagaactgtggtcaacaatggggatgtcagatgttcggaattccagtgtccctattctcacacataacctgttcctgaaaagcatgtgaaagcagaagagctgagcgatagacttaatttcaaaatgggttttcattccaagagtcaaaagatatgaaaaatccttaggctatgaatgtttagttttaaaagctagggtataagcaatcatttaaaacaagataaagtaaatatgaaatgcagataaagttaattttcttaaattcttagctcaaattctagtcttcttggcacacctaaagcaatatttagcagacaaaaataatttttaaaaaactgctcagagactttgcaagaaatgagatgttgtcttaccaattttctttaagaaatatcttaagacatagttgaactcctgccttttcttctttttaaaaaaagaagtcgtgcaagctacattcctccacaaactctatggtcctgtcaatataacagattactaaaacagtcaacacgtttcctgtatttttgtttattttttgagatggaatttcgctcttgttgcccaggctgcagtgtaatgacatgatctcagctcaccccaacctccacctcctgggttcaagcgattctcagcctcccaactagctaggattacaggcatgtgccaacgtgcccggctaattgtttgtatttttagagagacagggtttcaccatgttggtcagactggtctcaaactcctgaccccaggtgatccacccacctcggcctcccaaagtgctgggattacaggcatgagccaccacacctggcctcctgtattttttaaatataacttaattttgctattgtcctctttagttgaattatcatagtagatatccattgccagcattccttcttccattttagaactctgttccttctacccattggtgcccaccacagtacctcatcccccattaaagaagaagggacaaagatgcaagttggactttaccagtctttttcaggattttcctccctgaagattacaggaaacatcctttgactctccatttatgaaagctggaataatgggaatctagaaaaaccatgaagaaagactgcagggaaaaaaaataaagctaagcaaatatgaaagagtcctatttaaccaaaatggtcagctctgttctcatctttgaggtcctcaagctgccctagctccagcaactctcactttgcctctaccaggagaactaacttgagtttctatcagtgccaacaaaaaaatcttgtctgataaacagtcagcttaagtacaaactgggtatcgttctactgaggttaaatgctacagtttgaatgtatgtgtctctccaaaatccctatgttgaaactaatcaccaaggtgatgatattgcaaggtggggcctttgggaggtgaataggtcacaaggcctccaacctcgtgaatggcatttatgcccttaaaaaagagctaggccctcctgcctttgtgccttctaccatgtgagaatgcagcaacaaggcgccatctatgaagcagagagcagcattcaaccaaacactgaatctcttggcaacttaatattgggcttcccaggctccaaaactgtgagaaataaatttgtgtttataaattacccagtctaagatgttgtgttatagcagcaagaacagactacaacaccaaagaattaccacttttggaaaaccaagtgacttccatctttatctcaactgtgttagcattaacatttcctttcttctattctctagttatttttataaaggcaaaaccacaatagcgttcaaataaatacactacaaaggcactgatactagtgaaaatgagctgagtggacaagttgtatcaccatgcaatacagttcaaatcattgtcagctgacatatgagacactaaactgagaaagaggaatggtatttcacgacacaagtacatatcatatgagaaaaacacacaaataaaatcctctagtgagaatttttgttctcagtcattgggaaggaaataggtaaactttcttctggcctatcaaaagaaaaattatgggctctacagtttacaaaatgagaaagacagttttaatacaatgtgtcttaaattgatattatttataatttagccccctgcgttatttttatgtctgaaactttgggaaaaatgttactgaaacacctaagtataaacttgtatgaaaatatcacaacaccctgatttggacacgtggtatttaaagtgcctattagttatacaaagagaattaagatgccagcttatttatctagggctcaggagcaagagccaggtaaaaaataaatctaggaataagcagcacacaggttgtaaagcccagggagtaacattgtggaggaggggaagactgatggggagaagaaaatgaaaagggaggaaaggaacaagatacagccaatgagataaggagagaaccaagggagcttaaaatcactgcaaagtggctcgaggccagaatggtcaactgtgctgagtgctgttatgaggccagaggagaccagataagacctccctgttatcaactttcagtaggaatggtgtcccctgaccctccttctattcagggagaaaattttccatacttaatactaaattatctaacaagttcttagggaaaagctactttacctccagagttgttaatgatttcctagctaaagaagtagcagtgactcaggctacatctaattagcacccctggacaaggtggctactgaatgtaactttcagacgcctccagacacaccaagcccagtggtggagtggagaagagagccaaacctaccccagctctcaagggaaatgtcatgtgaaacatacactgttttgtcccctaccaacttataaacatacactgttttgtcccccaccaacttatcaaaataattaagggggctgaaaagcagaaaagggcagttacttcatgtttccaaaagaattcaccttaactgggcaaaacagaatataagcagctgaaggggcagaaactggtaaaccaggctttccttctttctaatccaatctcaaccacgattataattctgggtgtaattcaggatagaagctcagcagagctgtaaatcaattcttcttagatttaaaggtcagcatcaaaacattccctcctattgctggctgaggtgaaatggacactccatatatttgctggctggcatgaaaactggtacaacacttttggaaagcattttggcaataagattcaagagcttttaaaatcgtttctattccttcagggatctaatactatttctggaaatccatcttaaggaattagtctgcaattaggaggggaaaaaaacctttgggttcatgaaagcattattcattacacaaaatccctgtaaaccacataaatagccattttaaaggaagtaagtaaattacagtgaaatatgcaactaataaaattctaagtttttaaaaaacatagaaaatgcaaaacatatcaaatgaacaaggcaaaaaatgtatcaagtataatcacacatatataaatgcacaaaaataaaagaagaacatttttttaaaagatggtgcaactaggccgggcacagtggctcacgcctggaatcccagcactttgggaggccaaggtgggcagatcacctgaggtcaggagttcgagaccagcctcaacatggaaaaaccccatctctactaaaaatacaaaaatagccgggcgtggtggtgcatgcctgtaatcccagctactcgggaggctgaagcagagaactgcttgaacctgggaggcggaggttgtggtgagtggagatcgcgtcattgcactccaacctgggcaacaagagcgaaactccgtctcaaaaaaaaaaaaaaaagatggtgcaactgtgaacagatatgaaaagcaaactgactagagagtaagtctggttgagcaagacagaaatatgggccaagcgcagtggcttacaactgtaatcccaggactttgggaggccgaggcgggcagataacgaggtcaagagttcgggaccagcctggccaacatggtaaaaccccatctctactaagaatacaaaaattagatgggcgtggtggacagtgcctgtaacaccagctacttgggaagctgggtcaggagaatcgcttgaatccgggaggcagaggttgcagtgagccgagatcacgccactgcacttcagcctgggtgacagagcaagactccatctcggaagaaagaaaagaaggcagggaaaggctgggcgctgtggctcacgcctataatcccagcactttgggaggccaaggcaggtggatcatttgaggtcaggaattcgtgaccagcctggccaacatggtgaaaccccacctctactaaaaatgcaaaaatcagccaggtggtagtggagtgcacctgtaatcccagctactcgggaggctgaggtaggagaattgcttgaatctgggaagcggaggttgcagtgagccgagatcatgccactgcactccagcctgggcaacagagtgagacactgtcccagaaaaaaaaaaaaaagtagaaggtggggaaaaaaaatcaaaggaaagtaagctccttaaggatgcttaagaatggtagtagagatattacatggcagaaaaaaagcagagtctgcaaaaactcatccctattcatcaattggaagttaatgactccttgcaatgtttttctccctttttactcctccctattgctctttattctaaactgccaatactacaattaactccagattattcgtgaaaaagaagatcataaatttagagaatactaagtggatgatccaatgccaactggctttagtctttggatggcatcatattaaaattctctaacagcaagtgtaccttcctatttacattaaatgaccagaaaatgatttgcattctctattggaaggaatggcatgaaaaatggtccagaaacaaactgaaaaaggaaagtaagtcctttctatataattaaccataatatgtataatttcatatacaaataacacaatataaaataacataaactgcatccttttgaaatatttagaaaaaaaatgtctagaagattgcagggatttatagccaaactaaatttgttaacagtccaaaatgctgttaaactgtattaactttacttggaaaagctacagaaagtaattttttttttaaatcaatgctcttaaccactaaacaaaaaagaaagtaattccaaaagagggtaacatagcataatagttgagagcacagaagagttggactgttggtgtttgaattccggctccactaattactacttttgtgttcctttttgtgcctcactcttctcatttggaacaaaagtacttctcgtacatatagggttcttacgaagattaaacgaattaaaggatttagaagacagtctggactaagttactaaatgggatgcaaaaggttgttatccaggagatgaacagttgatatttgcacaactatgtgaaacactcgaaatggttaaaattgtaaattttgtgttatatatattttatcacaatttttagaaggctattagccatcacccatttgctataaaggcattttaatttctcctggcagaaaataaattatcatacatgagacttcatacaagtttagggttcctatttaaaaaactttatcaataaaagggttttttgggttcatgtttttcataaataaatttaaaaataatatgatgtgcttacaataaacttctgatgttcaaattatacaacttgaattctcaagctaaaatttactctttggaagttggcaatattacccctgttacagcaacaaaacaaaaatacactgctctaacctgaaacaacttggaaacagatctataaaccctttgaacactagcattttattgtatcttctagtaagtacagaaagacttcaccgaccttaaatataaccaattacaaatagcaacaaaattttttaaatgcttgttttaaaataaaaccttgcaaactagccccaaaccacttctctcagattacaaaatgagcatgtggtgaaaagggacagagaataccaatttactataccctatactgactgacaatttttgttgcatagcaacaagattctgcagtctgaaaacagcacagaactccttttcttgatttgccaagccacaattaaccccaccaaggctgagaagtatgcaaaacaaatctgtacaaaggccagggactttggctcatgcctgtaatcccagcactttgggaggcgcatggatcacctgaggtcaggagtttgagaccagcctgaccaacatatagtgaaactgtctctactataaaaaaaaaaaaaaattggctggacgtggtggcacacgcctgtagtcccagctacttgggaagctgaggcaagagaatcacttgaacttggaaggcggaggttgcggtgagctgagatcgcaccactacactccagcctgagtgacagagcaagacaccatctctcaaaaaaaaaaaaaaaaaaggcataaactaatatccaatattaaaagtctaatgatataaattctaaaactataaaatcacaagcccaaattccagcctatttacaacttgaaagtattaatatgccttcactctcaaagtttctccatgtaccagcaaaaagtgccagtgctcatttttggactacatttcttttgaaagcatcatctagcaagagttagttgttttgttttgttttgtttttttaatcctaggtaatagcatacccacagattttgtttcctaattttaaagacatcatttgatcccttcagtttattttctaaaaattataatttataagaaaagactataatgtcttaacagtttaagtttttctcctactcacaatttgtttgtactatttttatggattgcctttgtaggtaactagtaacaattcacaaaacatttttgttttttcacaaaattctacttcacctagagaacaaaaaacaagattgcagttattcttgcggtagctttaaatactttcattgtttagaggtttcctcctttattttgagaatgttaaatggctgccaatctccgcctaagaaacagattaaatagagaaaacatctatgtagaacagtggttctcagctgggtgcaggggctcacacctgtaatcccagcactttgggaggccaaagcgggcagatcacctgaggtcaggaattcaagaccagcctggccaagtggagaaatcccatctctactgaaaatacaaaaattagttgggcatagtggcaggcgcctgtaatctcagctactcaggagactgaggcaggagaatctcttgaacctaggaggcggaggctgcagagagccaagatcacgccatggcactccaacctgggtgacacagcgagactccgtctcaaaaaaaaaaaaaaaaagtggttctcaacatttccaaagatgaaaagaccttttaacttcatgaataattgctctacttttaatactgtatatgttgactgaaaaaatgtgatttaaaagcacattatatttgcaagcttttaaatgaatctatacattatcagaaaagcatctacatatagttgaaatataatgcatgtaaaggctggcatctttggattacagacaaatcttgctatacctaggggttcaactattctttaaaggaatggcgcagacgccccccagggctcacaaactggaagtcattaatccagtggaaaagttcaaattattttgaataaaacacttagggtaaggtgcatataggcttggaaatgagacaaagctgggttcaggtctaggtgccactacttactaaccatgcaggcttgacattaatgaagacatgttccctgtatggtggcttacggactggaagacataatgtacaggaagtatgtggcatgttagttctgttccttaaactgtcactcaaagtcttttttttttttttgagatggagtcttgctctgtcgcccagtgcccaggctgaagtgcagtggcgcaatctcggctcactgtaagctccacctcccaggttcacaccattctcctgcctcagcctcctgaatagctggaactacaggcacctgccaccacacctggctaattttttttttttttgtatttttattagagacggggtttcaccatgttagcgaggatggtcttgatctcctgacctcgtgatccacctgcctctgcctcccgaagtgctgggattacaggtgtgagccaccgcacccagccaactgtcactcaaagtctttaacaccccagcccaactgccattatttcctactgcttccaacacaaactccaacatgagacttgagacagcattggatgtgatcttaaggatgaaaaatgaaatttgagaaacagcattgaaaggtaaaataagaggctatagaaagtattaagagcaaggactttggagttacgcaggacttagatctgaatttcagctgtcatttatctactgtatgactccagccaagtcacttaagtatcctaagccttggtttcctacactgtaaaacagcaatgacgacatgaatctcatggcttattcgaatccattaaatgaaatgatccatgtgaagttgcctggcctatctttaaatattcaacaaataatatctattaatattatttatcaaagttatcatatataattggttagaccacttaatttgcaccaggtgtgaacaaacattacccaaaggttagcctcagagatgctctggtctgtggcgaaggacttataccctgtggcatgcatgttttggatattcagctatgaggcctctggatcagtaaggacatttaatatcaggtctttggaactcaaaagctaatctttaaaaataagtttattttaagtatttgcaataaattaacaatgaagtacctcaacttctttaaaagtgttttattttttccatttcacttacgttaaaattcaaaagctgattttttttctttagtcagttccaatttataaatgagcttatgatttttaggatacaaactgattttctttcttgaaactgcttataaattgtggttggggtactaggctagtctattaaagtctaagcaaccaaacagatatgtgcattttgtaataaaagtaggaaacggcatgaatgccacctcatctcacttaaagcatttaagagtttaaaatatgttgaacatattttttaaaatgtgtaacttatatagtagttgctgacattttacagaatttaaagaggttctccaagagtgattttagccctcataaacatctggcagtatgtagagacattctggttgtctcttctgggagagaaaggttaaggtgtgtactactggtatttggtgggtacaaactagggatactgctgaacatcccacaattcacagtacaaccctgtaacagggaattatctggccccaaacatcaataatgttgaggttgagaaactctgaaagtaggcactgatgttttaagaaaaaaacactaaactctctttgaaaagacctgcgaatatcatttccctagtgtcatttgaaaagattatcccttctctcaggagaaagttcttgtcactgtcatcaaaaatctattgaatgtgagggtttactgggctctctattctattcactggtctgtaggtctggtctataggtatgtccttactatgccttactatgcctttacctgttttgattactgtaactgcaaagttaagttttgaaatcgggaagtgtctcctccaactctgttctttctcaagattattttggctatttggggtcccttgaaattccatatgaattatttttgcaaaaaacgccattgggattttgataaggattacgttgtgtctgcatatcaatttaagtagtactgtcaccttaacaatatcaagtcttatcaactatcacatcttaacaattatcaagtcaatatcaaatttatgaagacaaagtctttttatttattgaagtcttttctttcaacaatattttatagtttcagtgtacaagtcttttacttccttggttaaatttattcctaggtgtttatttctttagatgctactgtaagtgaaattgtttttatataaaatttatttttaaagaaacagtctatgttgcccaggctggtctcaaattcctggcctcaagtgatcctcccatcatagcctcccaaattgctgggaattataggcacaagccaccacacctagcctgaaactggtttaatttttttcagttgtttatcgtaggtgtatagaaataactgatttttgtgtgacgatcttgtaccctgcaactttgctgaagtcgttcattagctccagctgctttactgtggaatctttgcatatatttatttttattgtgtacatgcatgtctccctctgtatctgtcacctgagacaattagttcatctgactaatgagagagatgaatgagaccactgtggtccatactcaaagaggaaactcaggcaagaagttgatgttgaagtcctaaccctcagtatatcacaatgtgacctcttttacaagcagggtctttgcagatgtaattagttaagatgaggtcacaccagagtagagtggaccccttaatccaatatggctggtgtctttataagaggaagaaaacatcaactgaagacagacaggaaaagacagccatgtgactgcagaagcatgagactgaagtgatggacctagaagcccaggaatgccaaagactgccagcaaacccaagccagagaaagcaattctgcctcaaaactgtaatacagaaatcctcctgttttgagtttccagcttactgacttgctctgcaaatttcagactcaagatgcaacatcaattcttgcctgagtttccagcctgcctgttggccttacaattttcagacttaccagctcccataatcatgtaagccaattcctttaaataaacaaatactggttctgtttctctagagaaccctggctaataatgataggagcatttatgaaaacaggggaagagtagatgtggaggtcacaaaaaattaactgcctacctcagaagtgtacccaagatctgcataaatttatgtaaagtttttgtaaagcccttactgtattagtttctaattttagttaactttttacagactcagaaaaaactaacagtcaatatgttacagggaaacagaactgctgactgggtgacaagattcttattttgtataacatttccaggcaggaaaaataaaaccaaatatatttgatgtcttgtctttatattttcaagtgcatattgaaaattttggttaaaatgttataccatgacaccttcactttgtcacttaccaaaacatcctatgtacaatataaaattgtttaaagtactgtcccaatacctttattaaaaatcagatgatttagctaaagaataaaatgagggtgcagtggctcacagccgtaattccagcactttggaagactgaggtgggaggatcgttagaagccaggaatttgagaccaacctgggcaacacagcaagacactcatctctacaacaaataaagaataaaatgagaaggccaaaaacaatcaatagtcatgagtttagttttttaatttattcaaaaaagttattaatagtgtctcattgaacccagcatgatataaagtgttcagagaaatgtgtcatgagtttatactccgtttttttaagggaaaaatgtatgtatgacacaccaaaagagctagtcgacaaaaactatgaaaagagagagactcagcctggaacaatcactaaagacaaaccagaagaggaaactaaagcaagaatgggattgaggtgagcacagagaaggcagctttccagaagacagacagaataaaagtaatgaaaccgcaacttcactggtacctttggaaaacaataaacgaccattctgaagtgaattcacatggggagtattgaaaggcactgctgaactgtttctcgagggccctgaatgccaagttaagacatctcttctgtgtgctccagggtgcaggggaaggtttcttcagtagattttttttttgttttctgttgttgttgcttggttgtgagacagggtctcactctgtcgcccaggctggagtgaagtggtgcaatctctgctcactgcaacctctgtctcccgggttctaactattctcatgcctcagcctcccgagtagctgggattataggcatgcgccatcacgcccagctaatttttgtatttttagtagagacggggtttcaccagttagccaggctggtctagaactcctggcctcaaatgatccacccgcctcagcctcccaaagtgctgggattacaggcgtgagccaccgtgcatggcctttttttcaggagaaagtttagacaggatggctgaccacacgggaaccacacattatgaagggaaggtagggtgacagatctagggggagaacttagttctaagtaatgcaaataaccattctatgtctgggtgctggtttttaatttaaatattcatcttaaattataaacatcattttaaaatacaggtactctaagaatttaactggctatttgctttcagagtgcctaaaaaacagaaactttcatattaagttaaaaaaggcaacagtgggtgtgatggcaggtgcctatagtcccagctacttaggaagccgaggtgcaaggatggcttgagcccaggagttccaggttgcagtgagctatgatcgcgccactgcatttcagcctgtgtaacagtcaggccttgtctcaaaacaagaaaaagcaagcaagcaaaaagggcaaaacaacattcagaagcttgaactttattttttgttttaatctcatggtacaatacaaagaaaacaataaacagaatatgcccaatccataaaaactctaactacattatagcaaatttcaaaacaaggcaatgaattattaatcccattttgcaaaaaaagaaattaaggtttgggaaagtcaaggtctcacagccagtaaatagcagaatggctctgaagtcaatgctgattctattaaacttgactaaccccaaaatgcaaacaccttgaaaaaaaagcagcctcaacattccaggctcaagtgatcctcctacctcaatctcctgagtatagctaggactacaggtgtgcaccaccacacccagctaatattattttttgtattttttgtagagatagaccatgttgcctaagctggtcttgaactcttgggctcaactgatccacccacctcggcctcccaaactgctgggattataggcatgagccactatgctctgccagctcttgaaaattaatgtctcctcccccactaaactgtaagtctaaggcaatgggtcatacctatgcacatttttacttttttgtaagttattgttgaggatttttcttattgggtcattttacttactttggaatcactgagaaagtaaaattgtgcaggacttaggccataatgaggaggagcttagtggagcttggtcttaattccaagagcaatgggaaggcactgaagtagttcagactcaaggctgagctgatcaaatctaaatttcataaagatctaacggctcacagctaacagattgcataggaataatagaccaatgcaataaattagagaatctataacgacatatatgtaaaaatgtaatacagaacaaaataggtacaagggtcttaaaatcaaagttcattatcagacacagaagttgccagggaagcaaaagtattcttaacacaaaaatatccgctaatgaactaaacatttataatatcagtccccattaaacatccctcccaaagcagcattagcctctatgtcaggccatttcacctttgccctgtcagtctctcaatgattgacaggttatttcaattacaaagcaacacaatgcatatcatctacaaagtgaaagtgcaaacattccaaaagatgtaggcctttatgaagtcactgaaaatgatgaaaactctttacaaagcaactgaaaaaaatgagtatttggaaagatactgactgggaaggggcatgagggaacttaatggcctaagtgtgttctatatccagacctggttggtggctacacaggtatgtatacatagtaaaaatgtaccaagctatatgtatacatgatttatgcatttagctgtatgtaaatgataccttaagagagctgctatggtttgaatcttgaaactcatgttgaaatttaactgtaacagtactaagaagtgattcggccatgggcattccacccccatcaatcgattaataacattatgatgggagtgggttagttaccacaggaattcaaccccttttttctgttttgagcatacaccatcttgctctgagatgccttccaccatgttatgagacagcaagaaggccctcaccagatgcaaccccttgatcttggacttctcagcctccgaactgtgaaccacataaatctctttcctttataaattacccagtctgtggtatctgttatagcagcacaaaatggactatggcgggattaaacacacacacacacacacacacacacacacacacacacaagaaggatggtcctacttcctccaagaattactgggtctcaatgtgaatcctggaagccctatggtccacttgttaccaatataaagatgactgaacaccaaagatggcaaaatgtacccgtgtcctcaaagacatcagtgacccactgactgtagtatgtgtggagtctaccttacctctggacctctaattatatgggataaattttctcaatatttaagcactttaagtcttaaacagttacttggagctgaaagcattttaacagattgtaaattaataactggagaactaacaaagatgagattaccaggaggtcaaaagaaaatctgaaaatcaaagttaggaaaactaatgaagcccttgaatattttggcaaaaaggactgtctttatgatcatactgcaaaagtccatcataacatggatagtttcatgtgatcttacaattttctcagaaaaattatgtaaaattttttaagcaaccaacacttgattcattcttctttcattctaataatttaacacatagttgcaaccataacatgaatgttttcatagttttgtttcatttttcaagattaaacccaaataaagccttttctccccaccccaactatgtactattatctctgaaatgttctaggtcaattcatcctacaagatcttgttcttacgccaattattttcagaaagtaaagaccccctaaacaatgaaatcacaaggaaaaataaattactcactcacacattaacatttggaaaattcaaatataagcttcagttcaaaagttaaccattacaaacagttatgtatgagagcttactggttaaaaaccatgggctctggaacctgactgcctgagatggaatcccagttccactctctactaactgggtgaccctgggcaagtcacttaactctctgtggcttaatttcctcatctataaaatggagataacagttctatcagtgttaaatgagttaataaaggtttcatacagtaagtactcaataacagcgattacattttttttaaactctaagaaaactgaagaatataaatgccaacactgaaattaagttaattagcaaaggaaaaacatttttaaaaacacaagctttatggtttaaatacaagtacatacttttttttttttttttttttgagacagagtctcgttctgttgcccaggctggagtgcaatggcgcgatctcggctcactgcaagctccgcctcccgagtagctgggactacaggcgcccgccaccacgcctgactaattttttgtatttttagtagagacagggtttcaccgtgttagccaggatggtctcaatatcctgacctcgtgatccacccgcctcagcctcccaaagtgctgggattacaggcatgagccaccgcgcccggccaaatacaagtacacacattttaaataaaattaagacaaagaaaaatgagaacaaatgtacttaacgataaaaaagaaagctaaaagcatattatatatgcttttatatgatgtctatatagtaaaaaattatgcattttccttctaaacatgtttttttaaaggtaccatgtcgaacccattaaactagaaactaagccaagcactgtggttcagtaatcccagcactttgggaggtcaaggcaaacagatcactcaaggccaagagttgaagactaacttgagcaacacagcaagactccatctctaaaaaaaaaaaaaaaaaaaagtttttaattaaaaaaaaccaatgagttgccgcacacttcactaaagataaaattttaaatcttaatatacagatgaaaaaaagaatggaaaactcagtattaccgaagatacaaggctgaacatggtggctcatgtttgtaatcctagcactttaggaggctgaggcgggcagatcacgtgaggtccggagttcgagaccagcctggccaacatgatgaaaccccatctctactaaaaacacaaaaaaagctggacgccgtggctcacacctgtaatcccagcactttgggaggccgaggcaggcagatcacctgaggtcaggagttcaagaccagcccggccaacatggtgaaaccctgtctctactaaaaatacaaaaattacctgggcgtggtctcgtgcatctgtaattccagctacttgggaggctgaggcaggagaatcacttgaacccgggaagcagaggttgcagtgagccaagactgcaccactgcactccggcctgggggacacagcaagactccatctcaaaaataaaaataagaacaaatacaaaaaaattagccaggcatggtgacgcacacctgtaatcctagctactcaggagactgaaatgggaggactgtttgaacccaggaggcagaggttgcagtgagccgaaatcgcatgactgcacacactccagcctgggtgagaaagagtgagactccatctcaggaaaaaaaaaaaaaaaaagaagatacatatagtaaagtttacattatgaccaccaatgaatcgcacctcttgatctgtccttgtgtaatcacctcccccactgactttgggcttgaccatatgacttgttttggccaaagaaacataagcaaacaggatgcaagctgaggtctggtaagagctttcatactagggcatgttgtcatgaggaggctgctattgttaagtgagcgatgaggcagagggatgggatagacacaccagatgaacctaagtgaaggaaaacacacgaatgagtccaggtaagaagagctgcccagccaatccgtagcacatctgcagtctcagctactcaggaagctgaggtgggaggatcacttgagcccaggagttcgaggttgcagtaagctatgattgtaccactgcactccagcccgggtaacagctttactaggctttgagatgctttgttaaacagcagtaatatcggatacgatatatgtatatgcactatgaagagttaatatcctcattattataaatcattagaagaaaaactacacatctcattgggaaaacagaaaaagcacatgaacagacatccacacaaaaataaagctgtccaataaacaaacaaagagaccctacaggtaatcaaagaaatacaaattaaaccaatgaggtaacaccttttacctatcacattggcaaagattaaaagaccgataatggcctgagctggccagaatgtggggtaactagaaatctcatctactcttgcttatctggtaacgtgtatcaaaaactgatacaactccctttagtcattttgtttattattcactcaaatacttatgcatactcacagaggcctgtgctgggaacttggaatgcagagccaggtcacgcaagaccttaataattttggttttatgacaaatttgggttttagtctaagatgccgctgaaggctttacatgggaaataacaatatctgatttccactttaagagtattctgagtgatgcatgaagaacaggggacatgaatggaaatgaggaaacactaatagttcaggtaagagataacagtggcctggacttgaggcagtgagatggacagaagcaagtgaaggtgacctggtaggacaatgatagactggatacagaaaggtaaagaaacaaaaaataaaaaaaaaaacaaaacacagcactacttcttgattttacttctaggaatgtatcctaaaacagtatcagatatgtacacaaagacatataaccaaagatgttcacagcagtgttttttataataacaaaaataatggaacaaatctaaaagtccatctttaagatttaagtagacaaagtcatccatccaaagcaatggaatattatgcagtcacttaaagttatgtagctatatagttaggaacaagaattactggctggacacagcagctcatgcctgtaatccgagtgctttgggaggctgaagtgggaggatgacttgaggccaggagttcaagaccagcctgggcaacatagcgagaccttgtctctgcacaaaaatcttaacaattagagggtgtggtggcgcacatctgtagtctcagctactcaggaggctgagatgggaggatcgcttgagcccaggagttcgaggctgcagtaagctatgattgcaccactgcactccagcctgggtgacagtttaagaccctatttaaaaaataaaaataataaaatgtaaaaagtatagatattatatatatggaaagggacaagctacaaaatacacaatacaaatatagtataattccatttttaaatagtataatcttacttttatatataatcatatgcacacgcacaatgatctgcaatgctgcaaatgcactacaaaaagtttagaaatctacacattaaaatattaaaatactagatggcttggatttaacatttcataaataaatgttttatactttccataccttctaaaatctgttcaaaatctgtactactttacaatggaaggaaaaaagtaatttaaaaaaatactgaccagacatatggacaacagtaattgatttatttttctaaaaataattctaaaaaaattgtgcaaagaccacaattaagtagactgtaagtaaaagttttaaatgaaaacttaagatacataaatcttaaattgttaaaaactgaacggtcacaattttgcttgcaatatcagtctaacatgagaatttgggggaggaggagaaagactgcagaacaaagcagatattcaaataaccagtatataataattattaagactgcataaaaagatcccttcactgaactgtaaaaggagcaatttggactcccttgagatttgacctcaagagctattcattttattttacttaagttcttggttcttcataaagctcccccgctgccaagttgcaaatgtaacagataccaaaaaggacagaagactgaggacctctaaggcacagttaaaggtagtcattttgatttcacatcatcagatgtattcttaccaagaccagatgttctataaggcctttaccactggaaaagggctcagtttatttaaaaatatcatgattacctcattccccaaagacaaaacttttggtatttgagactactgtaaacaaaccccagaaaatcaccacccagatttaagttttctgaagattctgatggatttgcttcatcacattttactggtgactttagtcatccttacttacaacaggcctaccaaagagatggctggctgtctccttagcacgaagatacagctccaaaatttgttcaggcctttcaaagccaccactaccaaggtttccacctcagcattcccacgtgcttgtttccctacagagaaatgtccagtggttctatcttcaatctctcttctttaaatagcacgaagatgtcaattcaaaatattaatccaaagtaataaaaatgtcagaaacaactcacgtaaaaagcaaatgagatcttctggtgttattatatagatctgtctattctgggcatttcatataaatggaatcatggcatatatcgccttttgtgtctggcttatttcacttagcataatgcttccatctacgctgtggcatgtatcagaattccattccttttgatggccaaatattattctgttgtatggacataccacattttgatgatctattcatgaaatcagacacacctgggttatttctgctttttggctgttatgaataacgatactatagacatttgtgtacaagtttttctgtggacaaatgttttcatttctaggaaaggaattgctgggtcatacgataactctatgtttaacttttgaggaactgccaaactgttttctaaagcagctgcaccatcttacatggtttttcacattcttaacataaacttaagagatgtcagactttcataaaagtgggggatttactcttatcaagctcattttgtgtgccaagtgttatgccagaattttatttaattttctcaacagctctataattcacaaagtatattcgatcccaaaaaatgtttataacccactcaaaaataaattatttagtaaatgtcaaactagagtcaaacccagagttaacttcaaagcctgtcctctttaccctacaccattcaatctctacacttagatatacatacattgcctcatacccaaagtagtctttggaaaagttgcctgttaataaaacttactttaatcattgtaaaatagaaggttcccagtgtaaagagatttctagaaaatttaacggatatcttgtataaatcaatcaacccccctaatttatcttctttagtaaacaacttctggttacttaaaacaaaacttatctaaagttcacctaaatattaaacaaattattttcttccaaagttgtatgcactgacaaaaaaaaaaaatgtagttatcttctgctatagactgaactgtgttcccctaaaatttatatgttaataccctaaccctcaatgtgactctatttggaaaaagggcttttaggaggtaactaatgttaaattaagttataagcacagggccctaattcaataggattaatggccttatgaaatgaggaggagagagaaatcccccctcatctccccgaccccaggattcccatacccaccctaccatgtgaggacacagagagaaggatatcttctgcaagccaggaagagaaccctcaccaaaacccatccatactggcaacctgatctctgacttccagcctccagaaccttaaaataaatgtctaggccgggcgctgtggctcccacctgtaatcccacgaggtcaggagatcaagaccatcctggctaacacagtgaaaccccatctcaactaaaaaatacaaaaaaattagccaggcgtggtggcaggcgcctgtggtcccacctgctcaggaggctgaggcaggagaatggtgtgaacccgggaggcagagcttgcagtaacctgagatcgagccgctgcaatccagcctgggcgacacagtgagactgtctcaaaaaaattaataaataaaaataaaaaataattttctgttgtttaagccacccagtctatggtattttgttatggcagcccacactaatacttcaagagtatcatacactacccagtgattggtatttgaagcactgataagaatcaaaacaaagcagggctgggggcggtgactcacgcctataatcccagcactttgggaggctgaggtgggcgcatcacgaggtcaggagatcaagaccatcctggctaacatgttgaaaccccatctctactaaaaatacaaaaaattagctgggcgtggtggcacgcgcctgtagtctcagctactcgggaggctgaggctagagaattgcttgaacccaggaggcggaagctgcagtgagtggagatcatgccactgcactccagcctgggcaagagtgagactccatctcaaaaaacaaaaacaaaaaaagaatcaaaacaaagcaagcactaaatggggtaaaaataaattaaaccaatagagatgcatatgcttgttacttgaaaatatttacaagttctttggtcaaagagacttaaaaacagattgatggccctttcagtaattcagaatttaatcataaagtcaagtaaacatggtatcctccaaagggcttagaatttagacaatcctgacacttgtagccacttccaagctctgtgttagaataagaaataaattctggccaggtgagttcaaaacctgcctggtccacatagcaagaccacatctctacaaaataaaaattaaattaaaatttaaaaaagaacaaaagaaaaccaaattctacacctattcctggagtcaggatgtgagtttttgcttgcttaattaaattatgttattaacatttagtatccaccaaatactacactacaccctacaatatccagtagagcttctagaacactacaggtattccaaaaatggggttgctagtgaacagattctataaaagagcaacgcagtcaaagtcaaacacttacacaggccacccactatttgccaagtattttgctagtaccatgaatataaaaatgctagtattttgctagtaccatgaatataaaaatcctcttcaaggaacttacaatgaagagggacaaaaagaaccacataattataagacagaataaattcaatagcaaaaaaacatgtaaagtgcactggaacacacaggaatagtgggggacaagggggttgggggagcatgttaggggcaagtcaaggactatatcccaggtctgacaaggagtccccttcttgtttctagtcaggaaaatttcgtaaacccttatctgaagaagcatccactgaagtacagcctcagctcatattctctaacttttacttccacttaattccattcatcaatttcaaacaaggaggagaaaaaagaggaaaagacaactttaagttggcacaagtagggtttaaatacccttttactcccctacaaccatataaaaattgaaatcacattttttcaaatctttcttacactcatgatacagactagatattttacaagttatacaatcacctgttttaagccttctgtaagataaatcaccaaaacctattcagtatgtaatttcttctataccagccaaatggtgcctccatagttattttgcttaatccaactgggccaacaaggtatccaacaccttgaatactgaataaactttagtgaattttctctattaatccacactcttcttcaagatttattcacttagtaaattcctacaatactgacattcaaaaaatgaagatttggctcttgctcctaaaataaacctctgtgggaaagtcacacatccaacagctacgagtataaatgaagacccatgggaacaaagagactactatttgtatcctttcatggatatctcacttgacacttcacaaaacaatcctgtgaaatataagattatctccttttttttttttttttttaccagtttactcaattaacaggtcagcatataaaacctggatcttctgacccttgattgtaccacactctgaaatgtatataaaatttatgattaccacaaataaagatacttcaaagaccctaaggaaggaaacacagaagaagggaacagcttcctcacctataaaataataaaaatgtggtctttttgacatccttgagctaaataaggtcgcaaggtggagcccactgcccagaagttttacccaaatagtctaacatagaaataggcctggaaacaggaggagtaacataaatttaaggcttaccagtgtataaagtaccttctattatcatttgatcctcactactcagttaagaattatctctatttttacatattttttaaaaaggcatcagtgaaataatgtgattacttcaaggtcacccagctagtaaatggcttggacaaatcctcataaccctactatacctttttatatgagaaagtcagagtagctagtggaagcctggactattttaatacggatccaagaatgtaaatacaaaatcttctgagctctccttagccaccaggctacatgcaactattttagatcagacaagctcctctttcagttaaaaaaaaaaaaaaatcttaagtaacaaaccaactaattttaaaaatgcacttaaaaggcacacactgtatgtacatgcatacaaacgcattcacatacatacacgcacactttaatcacaaagcatcttacacttttgaaacattgcataaatgaaaaataagaatagaactaaacagacaggacactaaaagtaccagctttttggtctcaacctttccactgtcctgtataagtaatatgctttttcattttttaaatattcatctttaagcaaaatattaacaagtaaatctatatactgcattttactcaaatgcctatgaccgtttcaggaacataaactattattcagttctcttctgtataagattatacacagtgatcatgctattcctaaaattaaagtcatctgacagataccactaatagttataccgtaatatattcatcatatcctctgttcaggattctgaccgacttaattggaaattcctgttcaggcattcctatttctggatggcctttgaaacatcagaactacctcttaatataaccaaaaaggactcaacttaaaagactaacattaacgtcccacaggacttgaaagcatgaagactaagcatatattaatataacctgaaaagcacttcctaagcaccaaaatatcccaaagaatattccaaagacttttgcaagcagcacaagaacgttttatcccataccaatctcacttttacaggtatctaagcaaatctaagtactacctaaccacctgccaaataatccagtaccttccaaagtgaaaagctgaccctctttcctgctcttattcaaaattagcctacgaagaattactgtagactgcttaaataaacttttcagacctgtgtaccaagttctatatttacgttactggaaaacatcagcgtggttcctctctctctacacttcataaggaacagagcaagaaaagagcttgaaaaacagaagttactttttattagaaaaggaattttcaagtgaagacataatttacctgtgacagactgacatctatacatgacagtgattaaacttcactgaatacccaaaacggtaacttttttttagttcacaatctttgaattagacaactattcctgtttttatttaaaaataacccactttcggccaggcaccgtggctcacgcctgtaatcccagcactttgggaggccgaagctggtggatcacgaggtccggagttggagaccatcctggctaacatggtgaaaccccgtctctactaaaaatacaaaaaattagccgggcgtggtgatacccgcctgtaatcccagctacttgggaggctgaggcaggagaatcgcttgaacccaggaggcggaggttgcagtgagccgagaccgcgccactgcactccagcctgggcaagagagcaagactgcatttaaaaaaaaaaaaaaaaaaaaaaaaaaaaaactttccctgttttatatttctcaatgttaagataagtttacccaaagtttgaaacaactgataacttctggtctgcaagatccctacggcattagatctctaaaacagaaaccaacaacatataatattacaagatataacagtatgtatattatagttcctgagtttaaggacatcagtaacttgatttaaaaaaaaagaagtcatgctcaaacatacgactcaaagttttcaagccatattttacaaagattgtgttttttggttcgtatgctataattactatttaaactcatcgcttatatttgaaaataacttgtgtgaaatcatcaagggaaaaggggtcagtcgcctagagacaccacattaaactcactctttaaggccatcataaatacaggtaacttggaatcagaaaaaaaaattcaaattcacagtaagcctaagtaaaaattcaacaaagatatatcacaatatatatataaaagcaaaatggaaacacgtttaaccttgatagaaaaaaaaaatgaaaagcaaagtttaaaatggaaactaccgaaattgagaaagaattccaatgacatgacattttcttgccaaagcgaaggaatttgtagattatatcattcaaatctcattgtattacattataaaggtcttagcaacggttggccattaatctttaacacaaaggagattcaaatccaaatgaactgtaagactatctcttccaggagagagaaatggagtaatttactttatccacaattgtttaacccaaaaggaaggcctttaaggatgataacgcagaatggatcagccttcagtctaccaagtcccatttcacacgaagtcttgcaccaatccgaaaagagaaggttatggacacagaacaggtttaggaaaggctggaaaaaaaatctccaatgaatgacacaccacatcacggtttattctcctacacaatttgagaaacaataaagaaaaatatcataccatatgtttcatcgtatcaattaaaaaaatattttacgacagtacattcaattcttcggggccgcaaaaataatttagctcctgttttattgagtacagagcaaagggaaaaagcagctgctgcaatgcaacacaggctgctacagagaaaggggagaaaaggcttttccaaacagatcccttccccgcccccgcttacacacccctaccaacttacttatcccagtcttttactgcccccaccacgtgaacctaatcaattctttcccttcccccaccatcgtgaaatttcacctttcacagctccttcacctacccctaccagaggcactttattacccgcagagatttcagacctttcaaacttttcttccttttttaattaaacacgagagttcggaggcaaaagtgcatgaaatttttacatatatacgaaaaaatacctgtttcccagcaacacgcacgcttcgattctcgaacccctccccatctcccgggtttcgcttgcaaaggcttgggggagggagccaggcgcaaattaaatttaggaagggaaatcctgggtgaaagaagagcatttgaggaaaaatgagagaacgatgaagcgagacccccaaaccacacgggttggggaggtttccaagaaagaaagagaaattggaagggacaaaaggcggaggggggaggaacagaccggagaccaggggagacgcgccgggccgggagagggaaggcggggtccgaggagaacgggggtcgcggctcccgcggcacaatggcccgcccggcccccgccccgcgcgcccctcacctcatggtgccggcggcgcagaggcttccccaccagccgggagacgcagaaggcgccgagccgaggggggggtctctcctccaggggtggggagcagctcggagacgggagacaagtgtccggctcctccttcggcggccagggggctacaccatctcctcgcacaaagccgaggcgccggccgggagtgtgggagaagagggcgagagaaaggctggggagggggcggagaggccgaggcgcggagctggtccccaggcggccgccgcctcccacctcctcgtggtcctgctcctcctcccggagcttcctcggccgccctctgaggggtgcccgccggggccgcgcgcccggccgccgctccacaggcccgcgctcgccgcgccgccgccgaggccgtgtgcaaccggcagctgctgcagccgcgggaggagagtcgggatcgccgcgaggaacccgggaggaggcggggcgcgcggcggaggaacacgcaggcgccgccctcctcccctccttcccccgggggcgagggggcggtgcggggggaggggaggaaaggggaggcggggggccgggcgcactcccccgcgccggcggccgggcccccgccggactgcggagagcgaggctgggagagagcgagcgcgacggcggcggcggcggagagaggctctttgttgcctccctaccccgccccctgcacccctctgggattcgggcgggccaccacccccccctcccgcccaacacctccggccagttgtcggccggggttcctcgcccgtggttgtccttgaccgtcggccccctccccgtcgcctcccgctccccagaggcttggggagctccgaggcctcccccacggccacggtgcggagaccgaggcgccgagacctcctgggcgccagacccgtaggcaccggcgtggggagcttggacgcgtgactgggcacagggccgggccaggagactccgggtcggctcgcggccgggtgccctcgcgcggggcgagtgctcagcccgccctgttgcggtctcaggacggggatgagggaatcggggggcatcccggtcagcccaactgcccgccctcgccgcggctgcgcccagcgattcctgcggagttgaggaggggcatataaatggaaaatatggtcatcattgttcccttcgctccttttcttcccgaggaatcccagcgtgctgcgccgatggaacgagttgatgtgcacactaggtatagggatgacttcatccccaaacgaacgcagccgactctcggggaaacgcagtcgccgggagacgcgcgcggaacagtgtgttgccgcaagagtggaagaagagaaacgcagccagtggagccgctttccagcgtcattagcaaagagggaatcccgggcagggggcggggagagagaggaactaatgataattttaaatttttcgtcattcccaatggtcttgaagtcacctcccttaaaaagtagatataaaatactggcgaggcaatttcatttcaagtcaagtcggggaggagggcatccaggaagccagaattgatcgttgttgaaggttttgttttcggttttttttaaatctaaaaacaaatccaataataaaatttttaactgtacgaattacggcccccttttagtccggaagacagggatgtactttctgtataaaaggtgaggaggatagaaaagggttgttgctacagggatcctattgctgaaggatctcatccaaaatggaggacctaccatgactccaggaatccattcaaaagttttggtgttttgttttaagatgcaggtaccattcaaaagatagttaggaaggttgggataatgtacacttccaaatgaaaagacaggttatagtgatccgtggtcaatgcctgatttgtctataattgaactgtgtagcccatttttaaccataaaaaaagcttcctggtttcagccgggtgcggtggctcacgcctgtcatctcagcacttcgggaggctgaggcaggcgaatcatctgaggtcaggagttccagaccagcctggccaacatggcgaaaccctgtctctactaaaaataaaaaataaaaaaacagccgggcgtggtggtgcacgcctgtaatcccagctgagtcaagagaatcgcttgaacccgggaagaggaggttgtagtgagctcagatcacaccactgcactccagcctaggtgacagagcgagactccatctaaaaaataaataaataaataaataaataaataaataaataaaattcctggtttcagagctcaataccgagttattttctttttggaaccggcagccttagaccaacagccctatagaagcagtgacccggagctatggcagaggatcaaggtggcctcaggtagtagaaagcatgatgcctctgccttaaacatggtgtacttgaagaacgctaatttccacccacatatctaattacagcttaccattacagagggcattttattcaaggatctccaaccactggagagaaaacaaacttgccagtcaaatgttctagttgccatattgcaagtagagacagggaaacatagagctcaagtaactggatcaattagtgcaacaggcatgattaaaaatcatagctaccaactatgagggtcattgtcttacgtaagtttctccctgtagtttgaaacacatacctcaagtatttgaacatgtgctgtggagagttttttcttggaaaaattaagacatattgaaccatcttggaaaagtattaataaaacatattcgaccacagagaagtcacaccaatttgccttagtccattcatagcaatacagtaaatccgacagagcttatgtttcagggaaaactcttacaaagggccaaaaggggtggagagagtgctgtaatgactcaagctatctcctgccagacacaagaaacaaggataaaaattccttacagatgactccataacctacttctcatttgtgaaagttaatccatcctgcgctaaataagtgatatatcacatcatctttattctaacagcaaatgttccaatggtatgggcaccaaattaagcaatccaagtggaaaatgctgttcttattttctatgtttattaaaaatgtaccagccaagaattttggctgcctacaaccatttccatccttttggatggcagcctgccagctcacaagttggtcatagcattcattgccttttggatttagatattgcaatgggtggcctgacccccaaaggtcattctgtggaagggcaatttgttggctgtgacaaaatgttattgcttcttgttcatatttggtttaacattcaaagagtgcaaagcgatacttgaggtaggaagtcacagactaattctggtcacaaaggaaatgctgtggaatgtgttaccatatagaataaaagaattttagagatggaaggaatcttcggtccagcccactcatttttcagaaaagaaatgtgagacccagagaggttaagtaacttgcccacaacttaaactcaggatttccaaatcttggtccattgttccttcgactatatcaaactaccttcttatgggatgagagtgcactaaggcaataaaaattaaagctgattctcttctcataaactctgcttaaaaattaggtctgggcctggcatgatggctcaggtttgtaaacccagcactttgggaggctgaggcagcagatcacttgagcccaggagttcaagaccagcctgggcaacatggcaagaccccatttctacaaaatttttaaaaaattagccaggtagccaggtacggtggctcatacctgtaatcccagcactttgggaggctgaggcaggcggatcactaggtcaggagtttgagaccagcctggccaacatggtgaaaccccatctatattaaaaatacaaaaaattagccaggtgtggtggcaggtgcctgtaatcccagctactccagaggctgaggcaggagattcacttgaacccgggaggcagaggttgcagtgagccgagattgtgccactgtactccagcctgggaggcagaggttgcagtgagctgagattgtgccactgtactccagcctgggagacagagcgagactccgtctcaaagaaaaaaaatatgagccaggtattgtagcacgcccctgtggtctcagctgctcaggaggctgaggcaagaagattgtttgagcccagggattcgaggctgcagtgagctatgatccagccactgcactccagcctgagagacagaacctgtctctaaacaattaaaattaaaaactaaaaattagctgagattgtgttggcttggctgaatagtggaaatcatttgaactcttctctcataagggttgctggcccaaggcccaatggctggcccatcatgtaggcacctaggtatttaaaaggtgaatgaataaatgagtgaatgacttctctaattaaaaactattcatcaaaagaaatatactctgttgttaacatcaagtatatagacctcaactttctcttagataaacttttacccatgctttttttttttttcgaccgactcttgctctgttgcccaggctggagtgcagtggtgagagccctgctcactgcagcctcctcccaggttcgaggggttctcctgccttagcctccccagtagctgggattacaggcgcccgccaccacacccagctaattttcatatttttagtagagacaggttttaacatgttggccaggcaggtctctaacccctcacctcaggtgatctacccgctacggcctcccaaagtgctggaattacaggcatgggccaccgcgcccagccacccctgcttaatatcacagtaggaggcctgctccaagccctaggtgtacagtacagagccatcacattggcctatacatttgttagcagtgtgtactcagaaaaggaaataaaatttgctcctgttgaagatgagtttgctgcaggagtgttgtcagtctggctctgagggttcacttggaacatgccttgtttaaattcatctgatagcatcagtgtaggcttgtcctccatttatgggcatgaggaggatgcgtgactaatgctactcagcagttaggaaatcaatgctaaggattgtaggcacggtctcccccatcacccaaaaaaaaggctctccctcgaaaaattaagttactttacagatgggtgaggaagagaaggtagtttggagtgaacttgattgtacactttctgcttatacctaacagtattttgttttcttttgtggcagttagttcacagtgtaatttttgtttgtgtccccaagaatggaaaaaaaaataacgtagaacatgatattccagtaggattcaagatatttttatttctcatctttcagctttagctgcccatatataatgtcagctctaaaatattatcaggagacacagacattagaggaaactatttgcctctctgccttttgcatttttcttccatttgtcatttttctcccttccaaattaggatttattcagttaatttcatttcgtcttccccagagtctctttcttttcttagctctacagtgtttagatttggcagaagattcccatagcctgaatggttttggagtaacattagtctatagaggccatattctataaaatgcaatgcattttttcccacaaaattcagctatggccaccatttaaagaatatggcaggtggtccccatatctagataacaatcaaattatagtgctttagaaattggattgaaaataagtgtcgagcctggtgcagtggctcatgcttgtaatcttggccctttggaaggctgaggcaggaggatcacttgagcccaggagttcgagaccaggctgggcaatatagtgagactctatctctctaaaaaataaaattctagctaggcatggtggcatgcacctgtagacccaactacataggaagctgagggtggaggatggcttgagccaggaggttgaggctgcagtgagccataatcacaccactgcactccagcctgggtgacagagcaaaaccctgtcccaaaaaataaaaagaaaatagaaaagaaccatcaccatccgggcgcggtggctcacacttgtaatcccagcactttaggaggccaaggcagtcagaccacctaaggtcgggagttcgagacctgcctgatcaacatggagaaaccctgtctctactaaaaatacaaaaatattagctgggagtggtggcgcatgcctgtaatcccagctacttgggaggctgaggcaggagaatcgcttgaacctgggaggcagaggttacggtgagctgaggccgtgccattgcactccagcctgggcaacaagagcaaaagttcgtcaagaaagaaagaaggagagagagagagagagggagggagagagagagagagagagaaagagaaagaaagaaagaaagaaagaaagaaagaaagaaaggaaagaaagaagaaagaaagaaagagaaacgatcatcataatctaattctgaactcttagcccctattttataaaatctagctggtagctaggtaaaaaaaaaattggtaccctctttctcgcattgaagtgatttattgtaataaaactagaataccactcaattttcacagacaatacgatcaggtgacaactgaccttagagtatttcctcaaaggagatcagaaaaaatgttattaaataaaagattattttctggctaattacagtacagaagaaagatattaccactaggatgtatcctaaacaagctgtctaaaattaattcacaggccgggtgcggtggctcacacctgtaatcccagcactttgagaggctgaggtgggcagatcacgaggtcaggagattgagaccatcctggccaatgtggtgaaaccccatctctattaagaatacaaaaattagctgagcatggtggcgtacgcctgtagtcccagctactcgggaagctgaggcaggagaatcgcttaaacctgggagggggaggttgcagtgagccgagatcgtgccattgcactccagcctgggcaacagagtgagactctgcctcaaaaaaaaaaaaaaaaaaaaaaaaaaaagaaaaattcacactgcttaacaccacacttttatcccacctttaggtaagtttcaaagctcattaaaaatctcagttatctttctctttgaaacggttgctaagcctggtgacctggccaaattctactttgagaaattaccttcaaatgttcattttcttgggtttaatgtccaaattcagcctctagtcaagtctttctaaaattgaaaggcaggaaataatcagataaataatgtcattatgtgtcattagttataatactttcatttggcctccaaacattctaatacccttaactcacttatcatgagtaccgacttttaatgaagtaaaatgttgatattgtactcattttgtatatgaagctgttgggttctttgatcaaagtagccagtgattgaatactctatttggtagcaaatgaattgaactgcaaatcaataattaaagccattgagggaaaaatttaaatttagcctcttatttcaggcccctctctgtgggaatacctaccttagatggagtctgacacaaacaagctttatatttaagaaaaataatgttatttgagtggcaggaatgtaagagatgaatgtagctaagtgattggttgaccaatagtcatatttactcacctgctaggcacttacttatattaactccattaatcttcacaatattcctatgaagtgggtatcattatagtcatgcctgctatacaactcatgaaagtgaggcacagaaaggttaagagacttgcccgaagtcacacagctagtaaatgagaaggccagaaaggccagtttcatagcccacactcttaacctctgcaccacaggatctcttctatttcactttacttcctctgattaaaaaaagaaaagaaaaaaaagcctcaaggcccacttaggaaatggaaggtaaaaataaaacaaacaaaatactctcaattccttaacttcctcattctgccactagaaactacagagatatcctatctggtaaatcatgacacttctatctcccaagcaataaataaggccttcccttaggcacagatttgattcctagtgcttaggcttgtggctttgtgcactgtaggggctcaataaatgagttaaatgagcctccaaattacaactccaaattaatgttaggacttcatttccagaacagtaatgctactagagaagtagccagtagccattcattcactcaccactccttcaacttagatatttcaggcatacaactagtggaggttttataaagcttatagggatagagttacttaaaccaactcagtaaacaaaaaactcatagaaatgctaacagtttttgttgaacacagggtgataaacaaaataaagccaagcctgtgcgtgtgtgtgtgtgtgtgtgttgtctcttgtgtttttgtattttttttaaaaaaactgcctatatttaatgtatacaatttgctgagtttggatatatgcatatacttgtaagccaatgtttttgtttttgttttttgggggttttttttgagacggagtgtcactctgttgcccaggctggagtgcagtggcgcgatctcggctcactgcaagctctgcctcccgcattcacgccattctcctgcctcagcctcccgagcagctgggactacaggcgcccgccaccacgcctggctaattttttgtatttttagtaaagacgggttttcaccgtgttagccaggatgatctcaatctcctgacctcgtgatccactcacctcggcctcccaaaatgctgggattacaggcatgagccaccgcacccggcgccagtgtgtttttaaaggtgttctgagaatgtctagcattctttttattaacgttctaattagattcagagagtagctaagggatactgtaccccaaaagtaacctgatgctatatttagctttggttgtctgcaaagcaatttgccataaaagtcttactctaggatgagatgtaccaaaatctttgacaataactcatctatttcttcatttatattcttgtgaaaaacttttttttaggacttgctcatttaaaatttatcaccaatgagggtgcttatatttcagggaaaggccctgaatagaaaaccactatcctagcttcccattcaggttttcttgtctaactcaggtggcattttatatctgtcaacatctcataattagtctttaaatagctcctgttttgtgtgtttttttgtaatgttcactgaggaactcattgtacttgattttattcagtgtctctcacttgcaaataatatttcccttcaaaagttcacagtctggtcttttccttcttatttttcactttattttctctcctcctactagtgagatggtgattcttgatttgctttatttgagttatttatatcttccggcctctgtttaatatcaagtctggcgtggcattcttttcctactgaatgatgcccaaattaagttaagaagcaattcctaagaaagctggcctgtgattcttcatggtcttctggtatcccaagcactggacagtctgtttaattttgaaagttgatgtaactagctaagttaatagtttatgtcaggtttgattcaagagttgctttccagagtaactctgttccaaaactagatgaggagatagaatagggaaggaagaattaaagcagtctaggtagaggtggctcacacctgtaatcccagcactttgggaggctaaggcgggcaattgcttgagtccaggagttcaagaccagcctgggcaacattgaaaaaccttgcctctaccaaaaatacaaaaattagccgggcttggtggtgcatgccttgtagatccagctacttaggaggctgaggtgggaggatggcttgagcccaggaggcagaggtttcagtgagctgagatcatgccactgcacaccaacctgggctacagggccagatcgtgtctcaataaataaataaataaagttaatgaggcaatttgctctcttggttaagttctattcatttggcatcaaccaatagaatataaggcccttcatggtagcaggtacctgttatcccagctactcaggaggctgaggcagaagaatcgcttgaatccgggaggcagaggttgcagtgagctgagatgggccgctgcactccagcctgggcaacagagctagactctgtctcaaaaaaaaaaaaaaaaaaaaaaaaaaaaaaaagactataaggcccttaactggctctcaatgatggggctccaagagagaacagtcagtggagtataataacaaggggtcctgatgccaacttaactactcccaccattagcatcacccgcatcaaagaaaaagagcttttctgcttttaccttctatccggtctttttgttaggattctggttgctggtgatagaaatccaattcaaagtagcttaatgttactgtatattttcagtatgctcttccggctagctagatccaggggctcaaacaatggcatcctctccatctcttagttctgcctatctttgcctttctttgtgttttgacctattttctcctcctatatatagtcccaacttcactttctaccagtactgtgatcccaaagctggacaatctgtccaagtagcaaggtctctctgattggaccaggagtcacatggtcatcctgaaccactggctgcaaccagggtgaagaggttctcttattggccagaaccaaatcatgggcccacccttggtcaggaagacagctctcttacttcaaggggtaggacataaaatagtatattgggcaaccaaatccacaactactcaaagagcctccagctagggagcgtgggtttaactaaacaagaacaacattcttgagtggggtaggaggaatgggtgagggaatgatttttctttggtggtggcagtcaatttataaagaacagatacctggccgggccaggtggttcacgcctgtgtaatcccaactctttgggaggccacggcgggcagatctcctgaggtcaggagttcgagaccagcctgaccaacatggtgaaacgccgtctctactaaaaatactaaaattagccgggtgtggtggcacatgcctatagtcccagctactcggaaggctgaggcaggagaatcgcctgaacccaggagatgaaagttgcagtgagcggagatcgcaccactgcactccagcctgggagacagagcaagactctgtctcaaaaaacaaacagactgggcatggtggctcacgcctgtaatcccagcattttgggaggctgaggagggcggatcacacggtcaggagatggagaccatcccatactgtctaacatagtgaaaccccatctctactaaaaatacaaaaaaattagctggctgtggtggcgggcacctgtagtctcaactacttgggaagctgaggcaggaaaatcacttgaacccgggaggtggagattgcagtgggctgagatcatgccactgcactccagcctgggcaacagagcgagactctgtctcaaaaacaaacaaacaaacccagaaagcagaaacctctgagggtaatatttccacaggttcaaacacagccataggtgcttccacagatgccctgggctcctttgaagttaagcttgtgccaacagcctgctcacctcaacagaatgatagaccagagtaatagagggtgcagcaccacaaagtccctggatctccctcattttcttccttcctttatccttccctccttcttaactgtggcagattttttacaaaaattgtcacaatcattacgctgtcaatatccatgcttttggttggcctctccctcactaaccctgagctcggccctgtgacttgctttggacagtggtacaatagcaaatgtgacacaagcagagacttgtaaagggctttttgcatcagggcccaccctttcttgctgctctctggaaacctatgatggccatgtgaagaagcctggacgggtttattgaagaatgagagacttcatggagtagaatcaagttgctcaagctgaggccctggaccagtggcctgccaactgaaagactgtgcatgagaccgttctagaccatccagccccaggtgagctcatctagaccaaaataactgcccagtcaacccactgttttaaggccactaaagttgtggagtagtttgttttacaataaaagctaactgatagacccattctcttcttcaacaacttcccataagtccttgaatagagcaatggctcctgcactgagagaagtatctgtggttgaagctcttgctccaactgaaagatgttcactttcagctgggtgtggtggctcacacctgtaatcccagcactttgggaggccgaggcaggcagatcacctgagatcgggagttcgagactagcctgaccaacatgaagaaacaccgtctctacaaaaatacaaaattagctgggtgtggtggtgcatgcctgtaatcccagctacttgggaggctgaggcaggagaatcgcttgaacccgggaggtggagtttgcagtgagccgagatcacaccattgcactccagcctgggcaacaggagtgaaactctgtctcaaaatgaaaagaaaaaaagaaaaatattcacttttgcccaagatcgcatatccaggcatattcttaagacatcgcagagtccatgagccttgatgtaccacaactactcaccactggttcgttggctgatattctttggagttcttcctccagaagggggcaggaaatccaagatgggaaggatgagaataataaaaagttggaacctctgagggcaccagattacaagcagttaaggcaggagtcattatttattatttatttatttatttattttatttatttattttgagacagaatctctctctgtcacccaggcatcatgcagtggcgtaatctcagctcaccgcaacctctgcctcccaggttcaagcgattctcctgcctcagcctcctgagttgctggaactacaggcatgcaccaccacgcccagctaatttttgtatttttagtagagacagggtttcaccacgttggacaggctggtcttgaattcctgacctcatgatccgcccccctcggcctactaaaatgctgggattacaggcctgagccaccgcgcccgaccctatttatttatttttgagacagggtctcactctgtcgcccaggttgaaggcaggagttcttgaggccatgagcaagagctgtaacttgatatcagatgatctagattcttatttccctctctgcttattttccagaaatctttggtaaagtcttgttggaatgttccaaattgctctcagctggtccacaaggtagtaaaggaaaagtctttgtccatgctcaagttcaagtttctaaggagaacagcacccctctcatgctgtcaggttgatggcagaggaagatactctctctagtccacctaataaattgcttaggaataaacacttaggaatcagctcctactcaggtatgcttggcagagttctcggtgagagtccattgtctatatgtcatggctaaggaggcgggcatgagttgggataaaactcatgtttctttccaatttgaaaaagacactgaggtcatccctcagaagagttcaatgaggccatttctctcgaacgggggaagaaggaaggaagccgatattcctggaggtctcagaacaatattttagatcttggcctccagacttactaggcagcagtccagtggagtaactgcagtgaagttagattatttgagatccaagaagcctgtaataagggaacggagagctcaagacacttagatctcaatagaagctgacatctgggtcaggaagaggaaagaatcaagactaataggagagggagggaaattctttacaaatatctggtatgcagccatctggaaggggttctgggaaccaactatattgcatatcaatataaacccagcctcacaggaggagccctcagtttttttcactagggacccaagccactcttcgctgctttggaaagattgactatattataatctatgccagaggactatatatacatacatacacacacacacacacacacacacacacacacatatatgtttttgtttgtttgtttgttttttgagacagagtccagcctggaatgcagtggcatgatcttggctcactgcaacctccgtctcctggatttaagcaattcttcctgcctcagcctcccgagtagctgggattacaggcgcccgccaccacactcagctaatttttgtgtttttagtagagatggggtttcgccttgttggccaggctggtcttgaactcctgacctcaggttatccacccgcctcgacctcccaaagtgctgggattacaggcatgagccaccgcacccagcccaagaaacctatattaattactcatttttaaaaagatttcaatgacagccagcttgaactacgagaattctttctcatgtaatgaactctcaggaaagacagggatgaacagcatctcaaacaggtcagaactctttctgtcttccattttttacttctctgtgagtattagcttctttttctcaggttggcttcttcacaaagctgtaaccacagcagccagcagctcctggctcacctcttccttggccaccagagaaggatggactcttcccccaataaactgtaggcggggggaaactggggaaaggctctgattgacttacttgggtcatatgcccatatccacccaaacactggtcaggaggtgaagtactttcattgattcttcttgggtcacgcgcccagcttcagagccctcctaaaatcatacccctggaggcagggaagagagactctccttcagagaagggagggattactctctgaagatagaaataaaacaatgtggccaggcgtggtggctcatgcctgcaatccagcactttgggaggccgaggcgggcggatcatgaggtcaggagatcgagaccatcctggctaacactgtgaaaccccgtctctactaaaaatacaaaaaattgtgagccgaaattgcaccactgcactccagcctgggtgacagagtaagactccgtctcaaaaaaaaaaaaaaaaaaaaaaagaaataaaacaatgctaagttctgattttcttaccaggttctgctgcttcccagtggaccacacactaaggagtaagatggaaaataatagagaaaaacctaaaataatggcataataacaagttctgagcaatgtcattctctttctttcactatcaccctattttactttttccctagattacttttctgagcaatgtcattctcttttttcactttatcaccccattttacttttcccctagatgtgtaataaaaattgtgaaaagaagaatgaaaataaaaaggaataaataattttttgaaaccagcagtattaaagataacccagtcattgtattaggcctaaatacataaataaagcagcagagatgcagttgaatgtagaaaaaatgacatcatcaacatttagggaaaaaataaataaatgtagaaaaatatttttaaaaaacttttctaaggagtggaagggggtacaagaagcccttaaaataaattctttccagttttaggggagcttattaatatcacattaacatttagttgagttgttttttgctgacattggaactggagctctgtatcgtattagctactgaattttactgcataagtccctccccttgattagctgaagggagtgagaatcctttctaagtttgtttccattctgtttggactgcattaagacatcagtccataattacacagaaccaagggaaaagcctataaaatcagatcaactaccgtgttgttagtttattccgttaaccatctaaattcaattatttttaatgaaacgtattgtgatataacttatatataataaaacgctcctgttaaatgtacactatcagttttgacaaatgcatatgatcatgtgaccaccatcacaatcatggtagagaacaaccccattaccccccaaaatttcctgtaatccttcctagttaatctttctctcaccgtcagcctggtctgctttctgttactatagattagatttgtctgttctagagtttcatacaaatgtaatcacgtcgtatgtactcttgtgtcagtttctttcattcagcataatggatttgtgatcccccatgtcaccatgggtatcagcagatcattcctctttactgctaagtagtattccgttgtatggatatcctacaatttgtttaaatttgttgatccatttgtgtattgttggacatttggcttgtttccagtttggggactattatgtatacagttggtatgtacatacatatacaagtctttggacatatattttcatataccttggataaataattaggattggaatggttagatcacatggtaagtgtatatttaaagaaaactgccaagctgttttctaaaattgttgtgtcatttcacattcccaccagcaatatatgagttgcatttgcttcacatcctggccaacgcttggtatgatcagtttttaaaattttgaccattctagtggatacgtagtggtatctcactgtggtttatttttatttatgtatttattttttgttttgttttgagacagtctcactctgtcaccaggctggagtgcagtggcgcgatctcagctcactgcaacctccacctccagggttcaagtgattctcctgcctcagcctcccaagtagctggtactacaggcatgcgccactatgcccagctatttttgtatttttagtagagatggggtttcaccatgctggccagaatggtctccatctcttgatctcctgatccacctgcctcaggctcccaaagtgctgggatcacaggcatgagccaccgtgcctggcctatttatttatttatatttattttatttacttggtttttgtttgtttgttttgggttttttttttcttaaacagagtcttcctctgtctcccaggctggagttcagtggcgctatctcagctcactacaacctccacctcccaggttcaagcaattctcatgtctcagccaaccaagtagctggaataacaggtgcacaccatggctggctaatttttctttctttctttcttttttttttttttttttttttttgagctggagtcttgctccgttgcccaggctggaatgcaagggcgccatctcggctcactgaaagctctgcctcccgggttcacgccattctcccgccttagcctcccgagtagctgggactacaggcacgtgccgccacactcggctaattttttgtatttttaatagagacggggtttcaccgtgttagccagggtggtctcgatctcctgacctcgtgatctgcccccctcggcctcccaaagtgctggaattacaggcgtgagccactgtgcctggccaatttttctatttttagtagagacggggtttcaccatgttggtcaggctggtttcaaactcctaacctcatgtgatccacctgcctcggcctcccaaactgctgggattacaggcatgagccaccgcgccagccctcattgtggttttaatttgcatttttctgatgactaatggtgttgagcatcttttgatgtgcttactggccatccatataccttttctgttcctcgttattgccactcttccacatataggcttgtgatggttaatattgtgtgtcaacttgattggatcgaaggatgcaaagtattgtgcctgggtgtgtctgtgaggatgttgccaaaggacataaacaattgagtcagtggactgggagaggcagacttaccctcagtctgggtgggcaccagctaatcagctgccagcataaaagcaagcatggaaagagcagacttcctgagtcttctggactccatctttcttccatgctggatgcttcctgccctttaacatcagactccaagttcttcagcttttagactcttggacttacaccagtgatttgccaggggctattgggcctttggccaaagactgaaagctgtgctatcagcttccctacttttgaggttttgggatttggactggcttcctggctcctcagcttgcagacggcctattgtgggacttcaccttgtgatcctgtgagtcaattctcctaataaactccccattcatacgttcatctatcctattagttctgtccctttagagaaccctgactaatacaaggctctcattatctcctgtctaaaatgtaaaattctaattcatctccagcataaaccaaggtctgattgtgtcctagccctacttataagccttccctggagccctattttctcagaataaagtccacacttcttagaatgacattcaaggcttttaccaaattagccacaaaagactaaaagaccaaaagaccaatttcctttaagtggggtaatctgggcagggtaatttttcttcctcaccttttctgcttgaccccacatcctccacacatgcacattggactgttgactcttccctaattttctcacacatgctcatggggttgtggctttgctcatgctgtttatcctacctggttgccctttgatcttttctacatgacggcatgttcattctttaaggctcagctcataggtctgctcttctgtgaagccgtctcaacctcatgaagtagaatcaacaactatttgtgctctttggtagctcttagtctgtaatgctcacaagctcctcaccacagactacttactgtattagctggttgaggggctcctgtctctctttgctggagcttaactccttaagaacaacggtggtatcttactctttttacatcctgagggcctcacattaactcctgcttagtaacatggttgactgaatgtgtggaagaataactgaggaaataaatgaaaagaaatctgccttggccgggcatggtggctcacgcctgtaatcacaacactttgggaggctgaggtgggtgggtcacctgaggtcagtagttcgagaccagcctggccaacatggtaaaaccccgtctctactaaaaatacaaaattagctgggtgtggtggcgcaagcttgtgatcctagctacctggtatgttgaggcaggagaatcgcttgaacccaggaggcggaggttgcagcgagctgagatttcgccactgcactccagcttgggcgactccgtctcaaaaaaaaaaaaaagaaagaaagaaatctgcctttaagcaaatggtttaccctctctagacctccatttccttatctgtaatttgagagagctagaatcattgatttataatacctttacagttcttttcttttcttttttttttctttttcttttttttgagacaggatcttgccctgtcacccagactgtagtcatagctctgcagactccagctcctggctcaagcaatcctcccacctcagcctcccgagtagctgggactgcaagtgtgcaccaccacatccagctaatttttaaatttttttttgttttttatagagacagggtctctgctttgttgcccaccctggacttgaactcttagcctcaagtgatcctcctgcctcagccactcaaagtgctgggattataggcgtgagccaccatacccagcctctttccagttctaatatatttgatttattttattttgtttctaatgtattttaaattctatgtttatattttcaaatccagtaaaacagtatatttgaatgtatccaaaaactggatgatggatcaaatgtgctaattagataatgctggattatcagtgacactttgaggggccacatcttattccctgggaaatataagatgaaaatagtgggaccttcctcagttaactttgctagcagatgtgatcgtgaagaattatgatttgtcactatttttagtctgaatctacaatgcagcagcaacagcacattctcacacattcctataagtttatgcctttatatatgtctatatattgtggtttttttcttcgtttattgtctgggggaagacaaaaggaagaagaatgataatacttagaagctgtaatctaccatttagttttataaggaattgttacttaaattgtaatttatagtatttataatggaaaaaagttgtttactcaagtatatcaagtttaaaatatataatgaaggccgggcacagtggctcacgcctgtaatcctagcattttgggaggccaaggcgagttcaagaccagcctggccaacagagtgaaaccccatctctattaaaaatccaaaaattagccaggcgtggtggtgggcacctgtagtcccagctactcgggaggatgaggcgggagaatcacttgaacccaggaggcggaggttgtagtggtctgagatctcacaactgcactccagcctgggcgacagagtgagactctgtctcaaataaataaataaataaataaataataaaatatatgatgaagacttattttcatataaaatataacaaatattccattttatttttaaattatgcaaacattctataattttttttgtcctataaatccaggagtttcttttctacatgattatcctggataaagttagacattgaggcagtctgtgatagcttcttaacttctttccagtattatagcttctgttagctggcaacaaccagagccaaatctacaatttggatttcagatttagtaagtggtaaatcatttgtaagacccaagacacacaaagctgcagcagtgacaatatcctccccaagcatttcagaaggatcacaagcacactgccaacatttattaattgctctataaaaagacacacatgaaggcatgagccccaaaaggtctgacaatgtcaaaacatcactgggattactgttaactgtcatttaattctgaagcaaaagctgctcatggaattatagaacaattaataaacctccaggtctctttcatatatttaaagagtttttgtccaaattatggattttcttcctcctctgacagtttgaatgctgcattgaattaacctattctgcatgtctctttcccatatgaatattgttgcccaatagtcctgccatttagaatccaggatctagagatcctctgtgggtgtctttcacatctgcgaaatggaggtaacactcttgcaaaagagtctacctagcaacgctcctgtaaaaactaaaaacaggtttattaatttactttttttttttttgagccaggtggtcttattatgttgtctaagctggtctcaaactcttggcctcaagcgatcctcccatctcagcctcctgagtacctggattataggcaggagccacagaacctctcttaatttttttttaactctgtagtatccccaagaaagtcaagtacgtgaaaacctcccaaacagatgatgagtgattatatttttaaggattcttactatatagctattaatcacaccacagatacaaatggtaatcacagatacaaatggtatgtatctgaagattatgtgaagatatgatgacataggaaatgctcttaatgtattatgaaatgagaaaaccaggctaccaaactgtaagaatggaatgacgacaatttttagaaaccacagtgtgtgcacacatagatggatgtgtgtgtgaatgtatgtgtgtatatatacatatatagaatgcaggggatgcaccaacacgttcattaaaatgatctctgaccagtgggattactggtgactcttcttttatttacttttctatagtttcctaattttctacaatgaacacctattattttgtaataagttaattttcaaaagatatttttaaagaatccattataggcttcttttaaatagctagatactctgtacatttaaaatatgatttttggccaggcacagtggctcactcctgtaatcccagcactttgggaggccgaggcgggcggatcacctgaggtcaggagttcaagaccagcctggccaacatggtgaaaccccgtctctacaaaaaatacaaaaactagctgggcatgatggtgggtgcctgtaattccagctacttgggaggctctgaggcaggagaatctgttgaatcaggaaggcgggggttgcagtgagccaagatcacgccactacactccagcctgggcgacagaacaagactctttctctctctctctgtctctcaatatatatatatgtgtgcgtgtgtgtgtgtgtgtgtgtgtgtgatttttattatcacaactactatgcaaagtgagacatacctacctaacttattgattcatgttggaaacacccccaccaatctagagatctgaaagccagtaattttcactatctaaaagacaactgagaaccaataaattagcaaaaaaggaatctgtgagaaaaataacaaatatgggtgaggatttagagaaattggagaccttatgcactgttggtgggaatataaaacagtgcagccactatagaaaacagtatggcagctcctaaaaaaaaattataaatagaattaccaagtgattctgcaattccacttctgagtgtatacccaaaaggactgaaatcagggtcttacagagatatctgcacactcattttcatagcagcattattcacaaaagccaaaacccaagtattccttgatggatgaatggacaaagaaaatgtggtctattaatacaatggaatattcttcagtcttaaaatagaaggaaattctgacacgtgctacaatatgcatgaatttttagaacagtatgttaaatgaaataagccagtcacaaaaagtcaaaaactgtatgattctacttacatgaggtacatacagttgtcaaattcatagagacataaagtagaatggtgattggcagggactccggggagaagagaatagaaaggtgtttaatgggcatggggtttcagttttgcaagatgaaagttccagaggtggatggcggtgactattgcacaacaatgtgaactgtcttaatgccactgaactgtatacttaaaaatggtcaagattggccaggtgcagtggctcacgactgtaattccagcactttgggaggccgaggtgggtggaccacttgaggtcaggagttcgagaccagcctggacaacatggtgaaaccccgtctctactaaaaatacaaaatttggctgggcatggtggctcacgcctctaatctcagcactttgggaagccaaggcaggtggatcacttgaggtcaggagttcaagaccagcttggtcaacatgatgaaaccccatctctactaaaaaaatacaaaaattagctggctgtggtggcgtgcgcctgtagtcccagctacttgggaggctgaggcaggagaattgcttgaacctgggaggtggaggttacagtgagccaagactgcagagatcacgccactgtactgcagcctgggagacagagtctctgtctcaaaaaaaaaaaaaaaaatcaagatagtaaattttatgtcatgtgtattttgccacaatttaaaagaatgataattttaaaaaagcatttgaatggttttaaaaatcgatgtacaagagctcagccttgacatattcatatgaggacttcttgggctatttatttatttatttatttgagacagagtcacactctgtcacccaggctggagtgcagtggcgcgatctccgctcactgctacctctgcctcccaggttcaagcgattctcctgcctcagcctcccgagtagctgggattacaggcacctgccaccatgcccggctgatttttgtatttttagtagagacggggtttcaccatgttggccaggctggtcttgaactcctgacctcaggtgatccactcaccttagcctcccaaagtgctgggattacaggtgtgagctaccgtgcctggccttccagggctatttattagtgttacttattaatcaattctgagaagtttgacactgactccctggccctatacaaattaaagacagcaaaataggcctcaagaggtagcgatgggtgcgatagcagagcgagccggcgcctacaaacaggtggggaggggggtggtggggagagtggggggtgcagatggtggtagcagaggagccccgcacaccttagacgttctgagctggaacagtgaaagagcctcagcaacgaggaccaagagcctgccacatcagggtaaatgaaaggaatacatgtttcaaaaacaaaaatgttttaaaaatttgcagcttgggttcttaaagaaagaagttgcagttacctggaagattcatcaaaattcaccaataccgagaagttttttctccacccccagtgctagacaaaggaggtgtgatttgtccaacgctcgcagccatttgagccaccccacacggaggcgagcctcgctagcgcctcggttacagcctttcccgcaaggcttcattcagtcgcgccggctccggggatgctgccttctctcgggccggtgcttcggccctccagactgggcccggactgacccccgcagcagcccagcctctccggagggctggagggggcaggcgcagccacagccgcgctccgagggttggggccctggggccttcccgggagccgccaccggcccttagggagagaattgatggactcgttgaaatcacaagttgcacacgttacttttcactccacctgctcatcgaaagggaatcccttgtttctcctttctttccctctgggtgacaaaccatttaatatgcgtagcgcttagtattttaagtgctcgacgaccacttaaggctggtcccagggcgatcatcagaaacagagagatacaaccccatttggagttgggtgactttcttagagcaagcagttttgaaggatttgcgggggcgtggagcggggaggtgggaaataaccagctttgccgcacaaaaggtaaatgccagcctgatggcttgaggggagagagggcgccaaagtgagcttccgtaaggcttataaaggcttgggaagttctggtcaaactaacgagcagttgattccacctaggatcccttaggtcaacctgtggacagcacccccttaggggaagtttctggagtccttagccccttggatcagagcagttttgcctttgttagttttaaattctgaatacacttgtctttgaaaaaccataagcaaaacttaaaaaaaaagtttctgcttctagaatgtaggtaaaggttgaggacacttcagttggaagtttgggttacattctacgctcactagtccccaggcaagtcaactacttgagccctagtttccaaggatgagaggtggaaatgatgttatttgtctcacatgagataacatgaaaacagcttgcaagttagtaatacttcacccagtccatagcggtattcagcctacctctgtcacttctcccaggattagaaacacccagccttgctggtctcgaactcctgacctctagtgatccgcctgcctcagcctcccaaagtgctgggattacaggcaagagccaccgcgcccagccccaatgctgccatatgttaggtacataatcttagatatgtcatctagctcttcttaaatgtagtttcctcacttgtaaaatgtttgttaatacctgccttatcctccccagagggttattgtgaaaaccaaatgaagcaacacttaagctttcgtgtttaaattgatgtaaaaatattcatgttgaatgtgttaatgtactgaaattgtcaacatttttacttacagactgtcttacagcgtaatttgcccaaggcctgatgttatgaactgcctcctttttttttttttaattcatgaagaacttgtaacataatcccatttcagtcaaattgaaaactcaggtttaaaacattgctgttcagaggtaatgggggattggaacttgcattccctaattgctcatctggacaagattaaaatggtcacactatactctggtttctcttcaaatggtataaatctttcgctttaaaattgtcacactggctttattagttctgttaaaggtttttctggtaggcttcagtggaattttattagttagaaatattaacgtaatttttttttttttttttgagaaggagtttcgctcatgttgcccaggctggagtgcagtggcatgatctcggctcactgcaacctgtgcctcccgggttcaaatgattctcctgcctcagcctcctgagtagctgggattacaggcatgcgccaccacgcctggctaattttgtatttttagtagagacgaggtttctccatattggtcaggctggtctcgaactcctacctcaggtgatccgcccacctcagcctcccaaagtgctgggattacaggtgtgagccaccatgtccagccagaaatatcgatgtaattctaaagacacctaaatctctcaatcgctctctctctctctctttttttttttcttaagacagtgtaccactctgttgctgaggctggagtgtggtggtgcaatcgccacccattgcagccacaagcaatcctcccacttcagcctttcgagtagctgggactacaagtactcacgctcagctatttttccttttcttttctttttttgagatggagtctcgctctgtcacccaggctggagtgcagtggcgccatctcggctcactgcaagctccgcctcccgggttcacgccattctcctgcctcagcctccgcagtagccgggactataggcgcccgccaccacacctggctaattttttgtatttttagtagagacggggtttcaccgtgttagccaggatggtttcgatctcctgacctcgtgatccgcccgccttggcatcccaaagtgctgggattacaggcgtgagctacagcgcccggccttttttttttttttttttttaagagacagggtctcactattttgcccaggctaatcttgaactcctgggctcaagcgacccactaacctcagtctcccaaagtgctaggattacaaacgtgagctactgtgtctggccctgaatctctttaaaccaggggttctaaacacgggggtaaaaggatacctatgataaactgctgctggtagaacttttctggcagatcttgctgctgcctacctggcctctcagggtaacggagcctgaatcgagcatggtcctctctgcctcactctgcatagcatagacatgtggttgcccacactgcctcctctttctctcctcacctgcctcacctccaacacaccccctactccgactccccagttgtgtccactctgtctagcgatctagaaatgggagacgtcagaaaatgaacaggtatggaaagtaacatcttaggtgaaaacaacctgtgtctattaatggattaatggataaacacatgtgatctatacatgcagtggaatattcttcagtcttaaaaaggaattaaattctgacgcacgttacaacacagatgaactgtgaagacgctatgctaagtgaaatcagccagacacaaaagaacaaatattgcatgattccacttgccatgtatatgaggtacctagaatagtcaaattcttagagacagaaagtagagtgatttttgctagaagttgggggagaggggaatgggaagttattgtctaaggagtatagttgcagttttcacaagatgaaaaagttctagagatgaatggtagtgatggttgcatgacgatgtgaatatactcaatgccactgaattgtacacttaaaaatggttaatatggtaaattttatgttaggtatattttaccatagtttttttaacgtaacatctcctagcagaaagtttaaggacacccagtgatgtgctttttttctcccaccaaaaggtcaaactcaggaccaattcaagttccctgaccaaagtgttagaaattaaagataagtgcttattacttctctagaatatcttgctgtgttccacttattataggactggcttagccagtaaattatatctttatttctcactcaccaaacagcaggaattataagtggataagtaggatttagtcatatactgaaaatataattgtgctggtaacctaaactctagcaaatactcttagcaatgcaggaaaccgctaactacttttccctataaaatgtctcagttttcaaaaatctcaggtgtcttagtaccctttcaaaaaattaagacagtattgtggtactttactacctgctcatttataaattcatttgtattaaaggcaaataatgttgataggactcccaaaattcagtactttgaaaggcctgaatacactgggctgtataacaaggaatgcagacgaatacttgatttaattataatgtttggtccaatactcctagcctggtttaaaggagagattgctttgttcagtggaatgacttctttaacaatgagccattcattcacttgtgatagcaccagaaggagagaattactggttcttcaaaatcgctttttaaagcaagaaattaaccttttggggtgaggagggctagaaacaggtaaaggttaggaaatcagatctagaataattggacctagaccacctgggacttggaagccagttcccaaactcaaattatctgaattctaaactagggaccctattcctatgtttcattgctgttgttgttttctcactctgtcacccagactggcatgatcatggctcactgcagccttgacctcctgggctcaagcaatcctcccacctcagcctccaaaagtgctgggattacaggtgtataccattgcactcagccctattcctgtttttagtataaataaacctctatcacacggaacacaactgatgctcatgaacactttagctcgtctccccagcagaagaagcaaaagctaagggggccaagtgaccttctgcccctctgtctcgaagccatggttgaggtggtgaaagaaggagaacacgttctcatcctcttcagaggacagtttttccttcagaatcgtctacatagcacccttcatctgaattgaagactcctcaaaataaaacagctctatttgggggcatgaggaatttgtaatgaggaagaaaaatgaggttttggatgaggacgagagacagttcttgcacagagagccagttagaatgaggagaggacgggccgggtgcagtggctcacacgggtaatcccagccctttggggggccgaggcaggcggatctcttgaggtcagcagttcgagaccagcctggccaacatggtgaaaccccgtctctactaaaaatacaaaaattagctgggtgcggtggcccgcacctctaatcccagctactcgggaggctgaaacaggagaattgcttgagcccaagaggcggagattgcagtgagctgagattgtgacactgtgctcgagcctgggtgacagagtgagactccatctcaagctgagcctgctcacaagagaaggaatgggcaggcaccagccaataactcaagcactgtacccacattttatacatgagaaaggaaaccatctccctccattcccagccatacagtttggacatgaggaccaaaaccacatgctgtctgcattaacccaactttatgattctattgtgtttatcagaattgcttttctatttcagggatttcccaggcaaataactttattgtttattacagaaacttccaactcttttaataaaaagcatcaactgtttatgtcctaagattctttgaaaccctgtctcaaaatcctcggccaactgttgccaccaacactaaaccaccctttcaaaaaattaagaattgggtaattcttacccaatgctaccaaagccacatcgaaagacctgcactaaaccaaatttcaaattctcaacaaattccaaccttaccttttcccctccaagaccctatcaaagctctatggatgaggtgttctccctaaccacagtaagcaatgaacttggctatgtcttatcaacaggctgtgcggtagtatttggggatccagcattcaacatcctaatatgtacagtacattagaaggttaattgataatcattgccggcacttcaatagatgaaaaatagaatatttaacatagtagtgtagggctttacaatttacagaaggctttcccatgggtgacttcactgggctcacttacagtgcactatgagaggtgaggggtaaatattagtatcatgaccaagtcacacatgagaacacagcccaaagacgggacatgacttatctgaggctgaaggggaccaattaaaagccagagtagaatctttattctaggtctcccaattttaaatattgactgttaacctacggaagtcccaacggcaatatttagtatttacattaagagatgaagcattttcttaaatcttaaagaaccaaagtgtatttgtttgctagggcttctgaacaaaccacaaattgggtgactttgtggcaccgaggggttaatttgatcaggtctgcctgccctgcttgcttttgctcactagctttttcttttttcctttttccatgaagcagaaggccgtggtagttgaaggtcttgccactgaactctgaaacttaaccttcactggctactttatatataacattcatacattaccatggtaatggctgcttcggttgtttttcaggaacttgggcccgctcctgttcagttcaaactagttgagaccactgactgactcttccgcccaccccggcctcccagagtgctgggattacaggcgtgagccaccgcatccggctagtcctctcctcattctaacttgctctctgtgccaaaactgtctcttgtcctcatctaaaacctcatttttcctcctcattacagattgctcatgcccccaaatagagctgttttattttgaggagtcttcaattcggattgaaggatgcaggcactgggccctcatgagtgcctgagaggtggccttttgatgttggagggcccaaaactccaccctcctgatcatgctagcagcaccattttctgtgcatatgtcctataaaatgccacaaaccccaactatgtttgcacaacatgaacccattacttcatttttccccaccgccaatcacctctccctgcaccttagacaaccccactcccctaacccatcaatatccctaagctttatctttggggaggcagatttgagaactgttctcccacctccttgcttggcagcctcacaaatcttttctcttttgcaaaacccgtgtcacagtgattgatttactgtgcacaggcagaacggacctggacctggccggtgacattagaacaaccaaaatttgttgtctcacagttctggagacgagaagtccaagatgagggtgttggcagggttgggtctttccgagggctgagaaggagaatctgttccaggcctctcttctcacttctggtggtttgctggtttgctggcagtctttggtgctccttggcttctgtcgcatcacctggtctctgcctccattgtcacatggtattctgcttgtgcgtgtgtctgtgttcccccagctttttttttttttgagactaggtctccctctctcacccaggctggagtgcagtagcacaacgatagctctctggagccttgacctcccagactcaagcgatcctcctgcatcagcctcttgaatagctgggactacaggcgtgcatcactacacatggctaatttcttattttttgtataagcggggtcacgttttgttgcccagggtggtctcaaactcttaggctcaagtgatccttctgcctccacctcccaaagtgctgggatgataggcatgagccactgcactcagccacatttcccctttttataaagacaccagttttactggattcagggcccagcctactgtagtatgacctcatcatactttaactaattacatctgcagtgaccctagtttcagagccccgatgctaagcattacacaatgaccctattttcaaataaggaaatctaaggtactgggcttaggacttcaacatgtgagctggggtgggtaggggaaacatgcaattcaacccacagcacaaagataatgaaagtttggtccatctctgcaagcccaacagttcataattgatccttgtattccagtaaatccttgggactagggatggcttttaagacaggaaaatttgctttagtgcagtaatgcttattaccctaggcagataaatttcctgggctgctatgtggctaattttattttattctcactaataagtaatcatgaatacttcatgaattattgagcaaaatgcatgcctgaaagccactgcttgtattcagtttaaagaataggtccatttcaactgaattttgagtgatagcagtaaataaattgtgtctactggtgactcacacctgtaatcccagtgctttgggaggctgaggcaggaggatcacttgaggccaggagttctataccagcctgggtaatatagcaagatcccatctctacaaaaaatttaaaaattagctgggtatggcagcacacacctgtagtcccagctactcaggaggccaaggtgggaggatcactggagctcaagaggtcaaggctgcagtgagctgagattgcaccattgcactccagccttggtaacagaacaagaccctgtctcaaaaaaaaattgtgtctgcaaaagaacctggtccagtctggtgcatgctacatgctacactcctactggtaaagatgggtttgtgtaaaaatgtagcttgaagaaaatgatgtgttttagtctacaaaagtagacagggaacatggtctgttactaacttgggtgaatttattctggaaccttttctgctttaacattcaaaggttgatcccaggagaaaacattctactcctcaacatgggtcttgcctgattcatttaccaactatgacagtaagtactgatccatgtagtcaatgctttaaaaaaaaccagtgacgacagcctagacaggctgttctttttcttcctctcctttttagttcatttttgttgattttgatggaaatctctattttgagggaaagaaatatatttgcttactgtaatcagatgttttttgagccagtgcattagatgttttcatggttatatcaattttagttttatgtaatatcaaatagatttaagtattacatacatgtatatatacatatgaaatctatctgtaaattataaactaataatagaataaacatatgggaaaaccactttcaacaacttaagaatcagaacattaccagtaactgtcttctttcctccaggggtaatcattctcctaaatttgtgacttctttgcctttaaaaacttttatcttttttaatcgatatatcatagttgtacattttttggagtaaatgtggtataaaaaaagttgactgggcacagtggctcatgcccgtaatcccagcactttggaaggctaaggcgggcggatcacctgaggtcaggagttcgaagccagcctggccaacatggtgaaaccccatcactactaaaaatacaaacaattagccgggcgtggtggcaggtgcctgtaattccagcgactcaggaggctgaggcaggagaatcgcttgtacctgggaggcagaggttgcagtgagccaagaccacaccattgcactccagcctgggcaacaagagtgaaactccatctcaaaaaaaaaaaaaaaaaaaagttttgccacatatggcatatgttgttttgtttagttttgctggttgggggttttataaaaataacatactattttagtcttctgtgaccagctcttttctctcaatattgtgtttctgggattcactcacattgctgcatgtagcaatatagttcattccttttcattgttgtgtaatagacaattgtgttaatgctccacaatttacttatccatattcctggcaatgggcatttgagttgtctgcagttttttgctcttgtgaattatgaacattctacatttctccaggtatgtatgtcaaagagttacactacagggcattggtttccaaactttaaaaaactgtaatatgttttatacacacatattttacaggtaccataaatactttacatcacaactgtacacacatggtgcacacatatgtgaaaccaacaatttatgaaacaaaacttactcttttttcttttttttcactccagcactcaagttggagtgcagtggtacaatcacaaggctcacagcagcctccacctcccaggcttacgtgatcctcccatctcagcctcccaagaagctggaactacaagcatgcaccaccatgcccagctaatttttgtattttttgtagagacaaggtttcaccatgttgcccaggctggtaaaacttactcttactatactaagtttttccactctactgaattttattttgtttgtttaaaaaaaaaaaagttggttgaggccagaagcagcagttcacatctataatcctagtgcttcaggaggccaaggcaggagtatcacttgaggccagaagttcaagaccagcctgggctgggcgcggtggctcacgcctgtaatcccagcactttgggaggccaaggcggggggatcacgaggtcaggagattgagaccatcgagaccatcctggctaacacagtgaaaccccgtctctactaaaaaatacaaaaaattagccgggtgtggtggtgggcacctgtagtcccagctactcgggaggctgaggcaggagaatggcgtgaatgcaggaggcggagcttgcagtgggccaagatcgtgccactgcactccagcctgggcgacccagcgagactccgtctcaaaaaaaaaaaaagaccagcctgggcaacacagtgaaaccccatctccacaaaaataaaaaaaagttagctaggcttggcttaatggtgtgtgcctgtagttccagctactcaggaggctgaggtaggaggattgcttgagcccaggagttggaagctgcagtgagctatgattgcaccactgcactccagtctgggtgatagagcaagaccctgtctctgaagagaaaaaaaaggttgtaccaccaaattgtagatgtttgaaaacacccagatctagaatactatacccaggagtgaaactgctaggtcctggttatatgcatgtttgcctttacaacaaaatgacacattgtttataccaaactgtttataaaaatttacatgctcattaggaatgtgaaataattcctgtagtttcacatcctctcccacacttggtatcatcagcattcttaatttttgctaatctggtagatgtaaaagaatatctcgctgcatctgcatttgcaattacctgaggaataattagctggcagaacttttttttcttttcccctgtttgaaacagggtctcactctgtcacccagctggagtgcagtggctcactcagccttgacttccttctcagctcactgcagtcttgacttcctgagcccaaaagatcctcctacctcagcttccccagtagctgggactacaagtacatgccaccacacctggctatttttaaaattttttttatacagacaaggtcttgctatgtttttcggctggagtcaaactcctggcctcaagcaaccctctggtcttgacctctcaaagcgctgagattacaggtgtgagccactatgcccagtcagcttgaatatgttttggatctattcacacactttgtgaaatacctattcatgttttttgctcactttttctattggatttttttttttttttttttttagacggagtctcattctgttgcccaggctggggtgcaatggcacaatcttggcttactgcaacctctgcctcctgggttcaagcgattctcctgcctcagcctcccgagtacctgggattacagacacccaccaccacaaccgactagtttttgtctttttagtagagacggggtttcaccatgttggccaggctggtctcgatcttctgacctcaagtgatccacccacctcagcctttcaaagtgctgggattacaggcatgagccaccgtgcctggctctgttggaatttttacaaggcacctgttggagaatttgcatcacattctatggcattttgtgtatgtaattcaggcataaattggaagattattcctttggggagggattaagagtcaagaaacttgatttggtctgaccgggtataggaggaaaactgtggccccattttttgttttagccttgtatttcctcttgtcaggaatcaacctgtgtcgggaatactcccctctcttagctaggcctggtacttttttttttcttttttgaggctacaacagctgctgaagacagtagcaaggagagtgtcaaccattcttcattgatgctgcttcaatatgaacagcggccctgctccccatttcctgcctcatttctctttgacctcaactgagtatcttactcctttgcccgtctggcactgggattatgggctcctgaatgctctggagctccttttaatgtcattcataatttaatcttgagctgcaattctgggtcttttggttcacacacctcattcttcctgcatatttcactataagtagagagaaaaatgctggtcactgggtgctggtggtagccatgctctgaccagggagcccctgttcatgccttttgtccaggtccctgcagtgctgtcctgtggctgtctctgggccagggtgggccttttcccaccagtgcttttggtagcagtgcattccatgcaaccgcttcacaaagtagatgatatttttccagggtaaccatgttataattggggtttgtgttattaactaaatcaatcataatataaagccaatccaatatcataaaaataaaaatcaagtgacacacaagcctctgtaataattatgacccagattaggagtacagctcatatctgacactggtatgatctggagcatgatttcatcatcatcgtgttcataggtggccctagttttgctttgatgaatcatccttggtggtagcattgggctctacttcccatatctaaaattgggttccttggaacccaactcttctggaggaaaacttttgagttgacatccagcccctcagtgtcattccctaagataccaagacaatgaaagcaaggaggatgtgtgggtggccagagccttgggccctctctgtttcaaccatgacaaaatgtttgatcacattttacaatccttctggaatttcttccctagagcactgctcttagctgggtggcccccttctccatcttttggcactctctgcgttccctccctctacttagcagacccagctttctgattgatcctactccctggcctcttgctttttttatatatttttttcttttgagacggggtctcactctgtcatccaggctagagtgtagtggtgcaatcacagctcactgtagcctcaacctgccaggctcaagcaatcctccccactcagcttcctgagtagctgggactacaggtgcgcaccaccatgcctcgctaatgcttaaaattttttttgtagagatggggtctcactatgttgcccaggatggcctcgcactcctgtgctcaagcaatcctcctgccttggcctcccaaagttccacgacttcttttctctctttgtcctatctcagtacagcataaaaatggggagtaaccagggatccctcagacgtcagcccataagacaccaagacaaacagggacagattactgaaaagcacaatctaaagaagtccaggcctggcgtggtggctcatgcctgtaatccccgcaggatcactgggatcgcagtggctcatgcctgtaatcccaggtggatcacttgaggtcgggagtttgagaccggcctgggcaacatggtgaaaccccatctctactaaaacacaaaaattagctgggagcggtggcaggcgcctgtaatcccagctactcgggaggctgaggcaggagaattgcttgaacccgggaagcggaggtttcagtgagccaagatggcgccactgcactctaacctgggctacagagagagattttatctcaaaaaataaataaaataaaaaagaagcccagggacaaatgagcccacctccactgtagacactgggagccacattctcaaaatgagtaactgcagggaagagacagaattctcacaagagggcatatcctccgcccttcatacatttctcctgtaacacccttctggttgaaaagaaataagaaagctgtgcttgacttttgctctagtgctttttaagatcaagcaggaatcttacattctttcattgcctttcacatttcttttccttcttccgtgtcctctttctttttaaattcagatcatttaacagacaagggtcatagctaaaaataaatcttcattgacctgagctacctatgatgtcatttactgtattcataggtctccagagtcaacactccaggcatgtagacacacacaggagaataaaacctcagttcccaggcagcttccagaagctgtggcattgctgtggcctgaggcctggactttcccaggggataggtatccagatcgtttgtgcccttccatatcacctttcattcagaggccttacctggattggtagccaagcattgatactcatgcctccccaaagaggtaagttttagtaggaaactgaaagaaaccaaggcccaacaaaatgaggcaactagacggagtgactggggaagtttccagccaagtcagatataaaatttgtactgtgaaaaactgttatctgtattttggtatttaccaaaaaacagtgagccatgatcactccatgcagtgggttaaacttgtgggagaagtaaattctgtggtgtcagctcagaacagaacatattgggaatgcataatagaaaagcagtactctcactcagcttcataactccagcaaatttgtggattggggttaaccacgtctggaattccagaactcaagttacccaagtgtggcaggccaggggaatttctgcgggctggatgggaaatcttcaaagtcagcatttattttcatctgcactcaatattttggcccaatatgtaagtaacttgatgtccattcttgtgttgataaggagcctaaaagcctggaacagagaaaggaaaagttggtctccacttggatctcaatgtggtcatcagtcatggaaaatgctgactatgaccattcccaatcagctcctcatgcctggcactaagagacactagacaccttgggctgcaatgactgcattgtgcgtttgtcactttaccataagctacatgagtccccagctggctgtgttaaagtgctccatcttcccaatagccatgtgtcccttgacggcaggaacactttcatgtttcttctgcagctctcatggtgcaccatgttgcttattcttttttttccctttttaaatttatttatttttagagatggggtcctgctatgttgcccaggctggtctagaactcctggccttaagacatcctcccaccttggcttcccaaagttttgggattacaggcatgggacaccacgcccagcccatgttggtattctctctgtcagcacccaaacagggaagcagaaccatgtgtaaattttgaaggatatattaggcaatggtgggagaagctaaggaagggtgcatgacaaggagttaaagcatcagtcacaaaccagccttcctgaagcactggtgtggatggaacaaagtttgccaaggaatataggcagctaggcacatctggttgctgaagtgggaccgtgaaagtagagctggtagaaaagtctatgtttctgatggtgagccggccccactaatggtcttaggaagagttgctggctgtggaatgggaaactgaacaagctggaacccaccagcacccctgcacctgccagtcagagcatcaaaccacaatgaccttcagagagtagtggctgttgctttacttccaccttcctaatcttggacaaatttctcttttgtccagctctcacccagaggcataccaagaaaggaacttgagaaaaccattccagttaaagcaagttgacccggcacagtccaaaatccgtgctatgcagcacagtccaaaatccgtgctatgcagcacagtccaaaatccgtgctacccagcacagtccaaaatccgtgcaggtatgtactagttgctcagaacacaagcagtcagtttctagcattgtgagaaaagccctgatctaaagtcaggatatctaggacttctggtcatagttctacctctaaaaatgtgtcctgggctaaattgttaacctctctgcccctcaggtccttagggaaagaaaatgacgactcatcacctcttagatggtgcatacagaagtgaaggagttaaaatgttagcagtgaaactgtcaaacagtacacagggggaaaaaaaagaaacttccatccaaagactctaaaagatgctagattctgtaatgttattttctctgattttcttactgtgcatgtaaagcatgtttatttacagctaagtctccctgctaaagcatgggtttgaaaatgagaaattctaggctgggcatggtggcttacacctgtaatcccagcactttgggaggctgaggcagatggatcatctgagatcaggagttcaagaccagcctggcccacatggtgaaaccccgtctctactaaaaaaatacaaaattagccggcgtggtggtgggcgcctgtaatcccagctactcaggaggctgaggcaggagaatcacttgaacccaggaggtggaggttgcagtgagccgagatcgcaccactgcattccagcctggtcaacaagactgacactccatctccaaaaaaaaagaaaatgagaaaatctagctattttttcctgtaactataatcttggtgtgctatgaaatttggagcaagtcattaaaccattttctgtcaacatttacttatatacagaatgggattaataatattctaacaatagtaattgaccattagctaagtcctttaaagaaatgaagtctccagcatttgttgcatcaaggccctgcagagctgtatgagcttcagccccgctgtgttctactagactccagggcttgcctgtgttatctccaacagataagatcatgccagaacacatgaagtcagcactcaccccatttaaccttaagtcaacactacagggtttgcttccttttaccaagtaccagcaaacatagaaaaacaatcagtttcctggttccagtctgatctgctgcaaagaacaaagaagggaccaccttactttatccactggataaagggaacagggagccaaaaaatgatgtaggagatggtgccaggccggggttgaggaagcaggacagaacccaggaatttgctttctccttggacctactgctttctacagagggtcaaagagttcggccagaaacctcctccaagaccaaggttatgtgtgtgcctccttaattagaaaaacaggccagacacagcagctcacacctataagtccagtactttgggaggtcaaggtaggaggatcacttgaggccagaaattcaagacctgcttgggcaacatagtgagaccttataattacaaaaaaaaaaaaaaagccagtctgttagttcattttcatgctgctgataaagacatacttgagactgagcaatttacaaaagaaagaggtttaattggacttacagttccacgtggctggggaagcctcacaatcatggcggaaggcaaggagaagcaagtcacatcttacatggatggcagcaagcaaagagagaacttgtgaaggaaaactcccccttataacaaccatcagatttcatgagacttactgtcatgagaacaccatgggaaagacctgcccctatgactcaattacctcccaatgggtcactcccacaacacataggaattcaagatgagatttgggtggagacacagccaaaccatatcaccaggtgtggtggcatgtgcctgtagtcccagctactcaggaggctaaggtcggaggattgcttgagcccaagagtttgaggctgcagggagccatgatcgtgtcactgcactccagcctgggtaacagagtgagatctcgtcttaaaaaagaaagaaaaaaaaaagacaaccccaacagctctgaaggacacaaacttcacacacacacacgcacacgcacacacacacacaaacacttcatgaatttcaacccttagatctggagggttaacttcatggcaaacataggggttacgaaaataacgcaccataatatttcccccctagtttttcattaacaacatgagccctcctaggtctgggtactttggtgtctatccttaataattaatatctgggcattaatagtttcagctctttctacctagcatctgtaagcgttaaccagaacctactaacaaatgtgaacatacaacatttgaacataaagtaacatctctggccttcgaaggtgacaaagctcagagtagcatttctcatcctaagcttccagctgttggcctgagcatattcacaaaggtgaagccttgtactgcaccatccacattctctcccatgtctctgcaggtcaggagcatgcttaagcaagttggctgatggtctgaagagttacatagagtcaaggataaacatattttggtctttttaaaacccagcataaaaatagcagtaaaaatatttcacaataaaaataatcatttctgaagccctttattagtttgccccctttcttaactggaagacttttaagtgacttacagcatttaggtccaatgtcgtgtttgttatgtttatatagtaaccaaaaactctggataaatatttatatagttacaaaacttttaacaggccccaaacttggaataatccaaaagaaacacaacgctccattttgggcagttgtaaatcccctgttgtcaacataactcagacattggaaaggagggaataagcctgaatggctcccatatgtttgccatgagcaggcttcaagggatgggggtggaggagagaatggaggaaggggctgccatggctggcctgcatcgagtgtcctgacagtctggtaatctgcagagcattgttttgcgcttgtcagctgttgcccagggatgcctgtgtgataaatgaataatgggctccacagggctctccttacactaaaaaattcagcgcatatggttctggccagttttctatcccatcctatcttttggtcactctagaagtacatttgttcccttggccataaaaaagaatattacagcttttaggagagaattgaggccaacaactcagagcatcagtctttagggacatgacataaagaaatcatatttgaaacctggatgcaagatcatctagaaaagtacccaggatcaatggggtgggagagtggaaataaaggaaaataatttgacaaaagttgctcccttgaatacataaagacccaaacttacttattttattttatttaatttattttttgagacagagtctcactgctgcccaggttggagtgcagtggcatgataatgatagcctcaaattcctgggctcaagagatcttcctgcctcagcttctagaatagctggaactacaagagcatgccaccaggcttagctaattataaaaaaaaaaatttgttttagaggcagggtcccaataggtgcttgggctgctcttgaactcctgagctcaagtgatcctcccatcttggcctcccaaagcaccgggattacaaccctgaaccactgcacctgtctggctcaaacttgctcatttttaactggtaatcatttcagaaattttatgagacagagagagaaagaaaaggatgctcctaggcctgtacatacaacaagttggccatggagtcatagtaatttggggccagtcctctataaaatagtaataataactgtatctacctcctgaggttgttgtgagacctatctacagcaatacagaagttgcttcgaacaatgtcaggcacagagtaagtggtaatcaatgctagctagtattattcttcctcaactcttcagacactgattcactaccctcaccgcagggaaagagttaaaactagacatatttagctgtaatgactagaaaaattgagcagaaaatctttccaaaaagttttgacttggagaaaggaggtttatggttctgttccctgaaagctatggcctagcgggggacagtctctgcccagcaggagagaaaccctaccgtcactgaggctaagttagcagaagactgttctcttaagaatggaggctgggagggccttttggtctttggatagttcaaagcatttctcaaagctttactagtggggcaagaaatactcagtaaaacctgaaatagcccctgccagggctgatggccaacagctgtgggaatggcagctgctgtgacccacgtcactgcacccgacccaggcatggggatccctgacaagtggtcatgagagtctcacatttttaatctgtctggaagccaatgggaggtgtaaggaagccagattctgatccctaacagtggcatccaatcaatttgtgtaaatttctcatcgtgatcccttcctccttaccatggagttggagagaaagggagaattcccacactttggcaatatgaaaggactattctgtaatcctattttcaggacagttttccttccttttaaaaatccaggttggctgggcttggtggctcatgcctgtgtaatctcagcactttgggaggccgaggtgggcggatcacgaggtcaggagatcaagaccatcctggctaacactgtgaaaccccgtctctactaaaaaatacaaaaaattagccgggcgtggtggcgggtgcctgtagtcccagctgctcgggaggctgaggcaggagaatggcatgaactcgggaggcggaacttgcagtgagccgagatcgtgccattgcactccagactgggtgacagagtgagactccgtctcaaaaaaaaaaaatctgcctgtaatcccatcactctgggaggccgaggtgggtggatcatgaggtcaggagttcaagaccagcctggccaagatggtgaaaccccatcctactaaaaatacaaaaaaattagccaggtgtggtggtgggcgcctgtaatcccagctgaggcacagaattgcttgaacccaggaggcagagctggcagtgagccaagatcacaccactgcactccagcctgggtgaaaaagcgagactccatctcaaaaaaaaacaaaaaaaattttcagataaatttctcatcagaatagaattctatacctggggccctttgaatactgttttgaatgttgaacttcatttgaggtgaaataatgatgctaactcacatttattaagcatttacaatatgtcttgcacccctgcaggcactttatatctatttaatttaatcatataatgcttatctctaataccaaggttacatactagtgagtgccaaaggtggaatccaactcacctttttcttttcttttctcttttttttcctttttttttttttttttcgatggtgtctcactctgccacccaggctggagtgcagtggcatgagtttggttcactgcaatgtttgcctcttgggttcaagcgactctcttgcctcagcctcccaagtagctgggattataggtgtgtgccaccaggcccagctaatttttgtatttttagtagagacgaggtatcaccatgttggccaggctggtcttgaactactgacctcaagggatccgcctgcctcagcctctcaaaattctgggattacaggtgtgagccactgtgtctggcctaacacctttttctttatagaaagctgcctggtttttgaaggaagtcttgaaacaatttttttcttcttaaaagtactttataaagtcttttgattataaaaataatgtatgcttataatagaaattttggaaaatgcaaaatgtgtaaagaagtagtaattctactactccacatgtaactgctgttaatattttaaattctcctaaggtatttttctgcacatttattgataatatttcttttttctccaaattgtgatcttaaaacttttagactttccaaagattttgtaaacttctttgaaataccaggaagcccatctaacccagtgcagcaagtatggacttttgaagttcaaacatagtttggaaaattgaccacacggtttccaagaggaaactaaaattggcaaaatgcccttttccaccctgataggggctttaaatgcctaaccatttgttttgctggcagcaggaccattttttagtggcaaccaatgactattagtgccaataaaagttcttaaacccctcacagcattaatcatgctccagatgttacaaaagttgagtgaccgaaaatgtacatacattgaagtcttcagctgctgcctcaaggtcatggggatttcagcttcattctcttaattcagagttaagccagaccccatcagtgagatttcagcctcattataaaccacagaggcttcattttgcatatatttcagcattttatattttcctttggccactctcatagtgtatgtgttcctttaaaacatctcctctttgatgaatagtccttcctggggcccttttgtaggcatgagagattatactctgttttgattctatctttgcccctgagataccaaccagtagcattcttcccactttgtctgatcaaatggaattatttttagaagaagctgctgtgtttgaaagacagcttataatcttaaaaaagccctttacattgcagacatatgggcttcttgacagtgtgtgtctagaattgcaatgttttctctgcccagaggactacctttgaattcaccctttctgcttgtgtgtgtctgtaaagataaatgaattgctttggcactgaatatagtaactgtagcgtgcatcatttctgacaactacttcctgaacttcttccctgagttttgtaccaactgttctcattggttctccgcagagctcgtggcacagaggaaaatggacataaggtagcggtaacaggctggcgactgtggcttttacacattgcttcacacaaccctgtccaggagttttacacactcactaaacaaacagaagacaccatccaattcactggagccccgttggataaatacggaaagaatgtgggagctatgtcatgaaccacaatggttttgtgttctgtgtaatttgaagacgagattcctttgctgtgtgtcacctcccatattaccactgtcgcccaacatttcataaccatcaactctttgccagtgcccacatgcaaagatgggtttgtattaaaaaataaatgagaacagcacattctgatgtggtgtagtatatcagcattttccatgaaacctcgtctccggccttccccttttaggaaacaaaggacccgtgacagagcctacttatcccgttacagctcctggtgagaagggcgaagccatgtcagaaataatagaaaaggctttttcctttgaaatatctaaacgttcaaagatgggaacagccgcaggggggagaatactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggactcagtttctttctgtcccaccaaccttaccatgttggattgtcatctttgtgcttgttgcctcatgatggcaagatggctgcagcacctctgggactcacgactgatttttaaggtaggaagaaggggacaggactgtactagccagatggcttcctttcatctggaaagcaaaaggtttccctgaatcctcagcagatttctgctgtcttcccattggccagaactgtgtcacatggtcacttttaataggtttaaaaatgagtttttcttgggaatattgctggcttgaactaaattgtggttctgttagtgcaaaaaagaggagtgggtggagtttggtcacatacctcacacagccgctcttcttaagatgctacttagaggatggtagggactgagaggaggaggcagaaggagcatagcgacctctttggagatgtaagtgactgtctacatcatgtgtttgtagagccatgggaatcaaaaataactcttgcgatagattagcagccccaaactttttgttcacatgcgaaaatctctgtaatgaattgttagttccgtgttacaattattatgaaaatctgctgtgtttaaattattgggaaagtaaaagtatgatttttaaaaggtaaatctgaccattttgcccacccctggcttaaaatccttcaggagatttccatagctcttgagataaaatgcaccatccttggcatgggctctagagacctacaggacactattttagcagcctcctgtgtgtctgtctgctccagggctctctctctgtccctccttttccctagaaccctctttccccatttggggccttgcagcccctgcttattcttcagctctaagatgaagggttccttagagaagcattcctttacccatcagcctggctttgggcaccccaataggagcgctgagtattctgatcgtctctttagcattaatttttaatttttatttattttattttatttttgagacagaatttcacttttgttgcccaggctggagtgcagtggcacgatctcagctcactgcaacctccgcctcccgggttcaagcaattctctgcctcagcctcccgagtagctgggattacaggtgcccgccaccatgccaggctaatttttttgtatttttagtagagatggagtttcaccatgttggccaggctggtcttgaactcctgacgtcaggtgatccacctgctttggcctcgcaaagtgctgggattacaggcatgagccaccatgcccagtggtatttatttttataattaattataaaaaataattaattctcagtaaattgtttcaattctgctttccctgctagaatgttaactttatgaaggccccgttgttcttttttcctacttgatttgtagcacctagttgggtgcctgctatgtagtaagcacttaaaaaaatgtgtattgaatgaatgaaatgaaattttaaaagtatgaagctgctttgttgataccacatattggtgcccatcaaaatactgtcctcgaactggtgttggcctgcaaactcttcactattcatctacaacaagataagtcagaaattgagaggatttagaaactcttataacaattatcaaattgtatgcaatgattaggagattttttcttttttgagacagggtcctgctctgtcacccaggctggggtgcagtggcacgatcaaagctcactgcaatcttgaactcctgggctcaagtgatcctcttgcctcatccttctgaatagcagctgggactataggtgtgagccaccacatccagctaattctttttttttttttttaagagatgggggtctcatgttgcccaggctggtcttgaactcctgggctcaaaggattctcccacctcagcctcccaaaatgctggatttacaagtgtaagccattgtgcctagccagattttttttttttttttaagatggagttttgcccttgtcgcccaggctggagtgcaatagcacaatctcagctcactgcagccaccgcctcccgggttcaagcaattctcctgcttcagcctcccgagtagctgggattacagacacccgccaccatgcccagctaattttttgtatttttaatagagacggggtttcaccatgttggccaggctggtcttggactcctgacctcaggtgatttacccacctcagcctctcaaagtgctgggattacaggcatgaaccaccacgcccagcccccagaaatttttaaaaataaaatcaaattggccaagcgtggtggctcgcccctgtaatcccagcactttgggaggccaaggcgggtggatcacgaggtcaggagatcgagaccatcctggctaacaaggtgaaaccccgtctctactaaaaatacaaaaaattagccaggcgtggtggcaggcgcctgtagtcccagctactcgggaggctgaggcaggagaatggtatgaacccgggaggcggagcctgcagtgagctgagatcacgccactgcactccagcctgggtgacagagcgagactccgtctcaaaaaagaaaaaaaatcaaattagtccttcgcacagtttgagaaacactgctatgggttagatactgcaaactatcattacactaataaaatgcaaacacttctgaagcttcaggagctcagaagccactgtcagccgcatgggaagccggcaggtcaacaacaacctcctgcaagagggaaaccatatagcccccacatccccttcccacttcctgagtggaatcttaactccttaacttcccagcaagttatttaacccagctgcctcagtttcctcatgtgtaaatggggattataaaagaaccttcttcacagtgttattttgaaagattacgtgggggcaactatatgcaaagcgtttagtgcagaatctgtctccagtatacactagctaagcatctgctattattattacttgcaaaccattttgcaaaaaataaaagaagatttttttaaaaaaaaacagttttgattaaaataacacctcaaatacaacagcacactgaacagagatggtatcaagcctacactgagagcaaagtgcctgctgggaggatatgcagttgtgtgtgcctgaggcctggctctgacctcatatcaaggaaaatatttgcatggcagagctgttatattcatgcgtgattcttttttcttttcttttcttttttttttttttttttttttttttgagacggagtcttgctctgtcgcccaggctggagtgcagtggcgcgatctctgctcactgaaagctccgcctcctgggttcatgccattctcctgcctcagcctcccaagtagctgggactacaggcgcccgccaccatacctggctaatttttttgtggtttttcagtagagacggggttttaccatgttagccaggatggtctcgatctcctgacctcatgatccacctgccttggtctcccaaagtgaggccttggcctcttttttttttttttttttttttgtgagatggagtttcgctgttgttgcccaggctgcagtgcaatggtgtgaccttggctgactgcaacctctgcctcccgggttcaagtgagtctcctgtcttagcctctggagtagctgggattacaggcacacaccaccatgcccggcttattttttgtattttcagtagagacagggtttcgccttgttggccagactggtttcaaactcctgacctcaggtgatccactctcctcggcctcccaaagtgccgggattacaggcataagccacgagcccagcctcatgcataattcttacaggggaaaacttgcaaactgaacagagagagagagggatgactctttttttgttttttcattactattatatttttttctaactcaggaaatggctgaaattctatcattaagactgcaggctgggtgcagtggttcacgccatcccagcacttttgggaggccgaggcgggcggatcacctgaggtcaggagttggaaaccagcctggccaacatggtagtctctactaaaaatacaaaattagctgggcatggtggcgcatgcctgtaatcccagctactcgggaggctgaggcaggagaatcgcttgaacccgggaggcagaggttgcagtgagccaggatcactccactacactccagcctgggcaacaagagcaaaactccgtctcaaaaaaaaaaaaaaaaaaaaacagaaaacaaaaaacaaaaaaaaaaaaacccagcttcttcttagttgaagtctttaatgtaaaatgcaagtacaacttaaataggttacgtttttagtccttctcagtcatttacactttaatgtgaagaaaacctctgaaggcatcttagatggtagaggccttgctcctgtcttactgtaacctggcacttgctccccaactccacccccactccgcaaaatcccgcccatcatagagtttagcttagctcgtaccttaagcttcaagatttctttgactgttccagcctggctgttctctctcttccctggtaggaagcacagtctgtgccacataacttggcacttatattctgccatccagtgttcagtagagttccgtgtgtgtatcttagtcacacctctgagttcagagggccactttttgataacttttccttccccaccaccgggctgcacacagaacaggtgctcaatgaacccgtgttgaacgatggggaaggtgaggcagaaacctagggcatatgtgtcagtagagagtaggggcaagcctcgaacgtgagctggactaagtcatttgtgaccttaaagaaagtgtgtttggctgggcgcggtagctcacgcctgtaatcccagcactttgggaggccgaggcgggcggatcacgaggtcaggagattgagaccatcgtggctaacatggtgaaaccccgtctctactaaagatacaaaaaattagccgggcgtggtggcgggcgcctgtagtcccagttacttgggaggctgaggcaggagaatggcgtgaacccaggaggcagaggttgcagtgagccaagatcacgccactgcactccagcctgggcgacagagcgagactccgtctcaacaacaaaaaaaaaaaaaaaaaaaaaaaaaaaggagagaaagtgtgttcaatatagacgggaaggagagggggccaggaggaaagagcgagagggtgaaaacaatgatggaggcagaaagtatagtggaaaatcccttttaaaataatttgttggccaggtgcagtggctcacacctgtaatcccagcacttggggaggccagggtgggcggatcgctcaaacccaggaattcgagaccagcctgggcaacatagtgaaagcctgtctctgcaaaaaatacaaaaattatccaggcatggtggcacatgcctgtggtcccagctacttgggagactgaggcaggaggatcacttgggcccagtaggtagggattgcagtgagctttgatcacactgctgcactccggcctgggtgacaggagtgagaccctgtatcaaaaaaaaaaaaaagaaaaagaaaagaaaaagtcacaatgttttcaagatagaagagacttcattcagcttgtatatctgtagaaaggaaggagaccacagacaggacgctgttaaatgggaagagaaggggacaatgggtgcatgatggttcctaagaggcatagcaccaagggttctcatagaagggctaaccttggctggaaggagggacccctcctcttctgacgcagaaaggaaggcaaggtgggtaagtgatgatacattgatgctgaggggtggagaagaaatgaatgagggagggagctggtagacttgacctcagaaaagacagaatccacgttcttctcttccaaaggaaagtcaccccacctcttctctcctccacccctggctcagagtttgaggcttggcagtggaaagaatgtgtgggtcagtgatgagctttcagaaaagaggtgcttaaaaagcttacacagtaacctccaaggaccaggtttctactggctacatggatatgtagaagaaccagtggcccattcattcacccagcaatcatgtgtcctccatttatgtacccaacattcacgtgtcctccatttattcacccaacaatcacctgtcctccatttattcacccaacaatcacgtgtcctccatttgttcacccagcaatcacgtgtcctccattcattcacccagcaatcacatgtccagcacctacctcgagccaggtgctacttagagccttgttcagcagtgaacaaaagaggctgagtcccttcatgaaggagttcgcagactagatgagaagacaggcaaacaggcagttgggacacagtgtggggaatgctacagtagggtaaataaggggagctgtcggggggatggccccagtggtaacaaaaacttaaggctgcaaagattaatctatttagagtgagtggcagaatcaaaggcccaaagacaagaaggagcctggctttttggaaagtaaaagtggagctgtgtggctggagcgaagggtaggtggcaaagaagagaaaagacctgaggttggagaggtaagcaagggctgatcacagggagcagagcctgcccctccagtcccacccaacctgcctagagtctgtgttttatcctgcggcagggagggagttggaaacaagaaggccagttacaagagagtagtgactgtgtaagtgaaaagaaacaaatggagttgagagatttataggcgggataatggacaggccttgttaattgattggctaaagaagaagtaaagggagactctcaagtttctagcatgggcaactgggtcaagggagatgctgttcactgaaataggaaacaggaggaaggactagtttatgggggaagatgaagagcttattttgagcatgtggattttgaagggcctgtggggaatgtaaatggggaatggcagcagacagctggatttatgtgtctggagcctggaagagaggtctggactggtggcactggatgattgatctccagctttggatgatgatggaagcctcagaatcatcgggatgaaccagaggagaggaaagagtaagaaaagaacaaaacgagggctagaccagcagagaatacagccacttagggatgagcagaagccgaagaactcacaaagggagaggagcccacacaggacactgggaggaggggctgggaaagtaggagttaaaggagttaaagagctggatgtcctgaagtcaagggatgaaaagcacattaaagggggaacaataagcaacttgggaagctactgagaggtcaaggaagaaaagactcaaggcagtcactggatcaagccacagggaggttttagtaaccttgctaagactgactccgaggagtgctgggtggatgcagaaaggaagggaggaagacagcgtcacagagacagtgaatgcgagctactctccaaagactgcagctgagaaagaaggacagatggaggggcaggtgaggtcaaggaaagttcttaattacgctgccatctttaaaaattgaagtaaattgtatttgtttatatggtgatgggtaggaggctatagaagaaaggctgaaggaacagggagagtgaataactgataagagtggagtttctgaaaaggcaagataccatggaaggcattggccttggacagaaatgataagaatagtaacagcaatattaataattaaagaaagtttcttgtgccaggcaccatgtaccttttccattatctctgtttgtttgtttgtttgtttgtttgagacaaggtcttgctcagttgcccaggctggagtgcagtggtgcaatcatggctcactgcagcctcgatctcgactccgcctcaaaaaaaaaaaaaaagtgggggacaatctttaactgaggccctcacaattgctccatgtcacagagctaataaatgatgcagctggggctcgttccatccttaacagaggaataaaggggaagatggactcaggtgcagtaatgttgcaggtttggtgactgtgggcattgtcctctgattacctctatctcctgtgaagtaggaggtaggggggtggtggcggaggggtcaatgggagggagaggttacccaatcacctgtagtgaatgctgtgacagatgagcagctgttgagggccacatctccagtagctccggcagccagcgggcagaagaaggaggagtcggtgacacaggactgggactggttctcacttgtctctccctgtttttaaccttccaaaactgagggaggacctgccttagaggtgtactagctggagtgccaatttagttccagaaaggaagtggaatctctggttacctgccaatgttaatacatgtcagaacaatagtcctgcttgggtcctagaaaattgtggtgcaacacccatgtcattatcgtccttataatttttcataggctttgtagcaactttgtaatttgtgctgaatttcattgacataccaaatctcaacagcacaatactttttagttctgaaatgtttcattcattccatctttcatttattcattccacaaatatttattgagagtcaggcagtggtggccaatacatccaatgttcctgtcctcacaaaccaggaaaacacacctattttaactagactagatgtgcgccccatgaggtcatgggctttgattattttattcaccacttcattctgagtgcctgaaacagtgcctggcatgtaagggatgctcaataaatgtttgtttgcagaggtgcatttatcatgaaactaaacagagtttaagcttcatagcccctcaattgcactgtcctctttcatggctctgggaggggactactgtgtgctctcatggtaatctgtttttataaaaatttcaaaggtaagatactttaactagttctctgtctctaccctaacttcccctctaccactttccgctgatgtcagtgacattggagaggccatgggcattctggatatccagctaagaggaagttgcattgggactacatttagtatgggatgttggggacatatttatgggatgtgggagacgtatgtggtatgctgtcacttaggtagatatgaagttattgctagctagcaatatatagcaatatagctatatcagtacataggtgacgtccaggaatactcctttactcactgtaaagacccacctggcatgtcataaaggtacagggtcagatgtgatgtcacaaaatgagcctgtcctgggctcctggcactagaagtttgggggtggtagagaaacaagggcttttttaaaagaaggcctccaaaattgtccaagcttcaggcccctcaaaatgtgaatctgcccttaactggatatggataaatctaaatcagctcatactttattttctctcacatttacagactacagagcctaagtcaaagcttgttcttggacccaggaaatatgtcaaatccttccagtgaatggtatgtcttcctaaatgacgcacttgtgagaacagctggacctaactgtctaaaggacagctagcttccagcccgattttcagagctgatatatcaaaatctaattccttttacagaatagccaaataaatattttcactgtcaaattcttcacaccaaatgctgtacaagcaaaatcattataccttagataatgactgtattatattcgtagatttctagtggtgttcatttattcactcactcacttgataaatacacgaagtccttactacaagtcaggtattgggggtaatacattaactaagacacagtccccttcttcaaagagtctagtgggggagtgagacatttaaacaggcgatgacaatacatgattcacactaagattggggttgatgatgagcacagcattttcgaagcacttgggtggagctcccaccttggcaaggcaagtcagggaatgcttcttggaaaagctgagtcaacctctcggcagggatgctggagcactgggtgggagggtgaactggatcaaaggttcccaaatctggctgatcatcagaatcacctgggggagcttcgagagtcccaggcttgcccccaacctactgactcaatttcagtggggtgaatttcaggaatctgtctcctaaaaaataaaagcatgcctggtgggtttttgatccaccaaatttggtgaagtggatgacttgtgattttggggagagggcccagggcaggaaggggtagataaaaaagcccacgggaggctgcagaatgccctatggaaaaggcagagtaaggaggggctaaggcacaggtaggcagaggagactttccaggcaaggggaaaaagaaccttctacatgggctgtttgaaggagctcaggcccttttagaacagtcactcagcatggctggcagctcacagggccgctggctaactcaggttcggaaaatcatttagcaacctgatagagaccacagaggtggctgtgtttcatgttggggaaaggggcaggaatgcctgcactgtggagcaggaaggaaaaggctcagactgcacctgtgaccctgcagggactttggtcccctgaaagctttgcactagtccaacttccaatgctctggtttaagaaacctccttgtgtcatttgcctcttttttttttttttttttttttttttgagatggtcttgctctgttgcccaggctgtagagcagtggtgtgatcacagctcattgcagccttgacctcccaggctcaagctatcctcccacctcagcttcccgagtagctgggaccacaagcatgcaccaccacacatttttgtattttttgtagatatgggtttttaccatgtttaccaggctggtctcaaattcctgggctcaagcaatcttcctgccttagcttcccaaagtgctgagattataggtgcgagccaccacacccagcctttttttctttttttttctataaatatatatatatattatatatatatatatatataatactttaacttctgggatacatgtgcagaacatgcaggtttgttacataagtatacatgtgccatggtggtttgctgcacctctcaaaccgtcatctaggttttaagccccacatgcattaggtatttgtcctgatgctatccctccccttgccccctacccttttattttcctttcctttctcttttttattttttagagatggtgtctcactatgttgcccaggctggtctccaacttctgggctcaagcaatcctcctgcctcagcttcccaagtagttgggattgcaggcataggccagcacatctggccccttttctttttctaataacagctttacttagatgtactttacatgccataaaattcacccttttaaagcgtacaattaagtggtttttagtatattcacagaattgtgcaaccatcaccactatttaattttagaacatttcatcactccaaaaagaaaccggcacctattaagtcacttctcatttccctaccccatccccatcccctagcaaccaacaatctactttctatctctataaatttgactcttctggatacttcctgtaaatagaataatacaatatatagtctgcctggtgtctggcttctttttttttttttttttcttgagacagagtctcgctctgtagcccaggctgtagtgcagtggtgcgatctcagctcactgtaacctctgcctcctggattcacaccattctcctgcctcagcctcccgagtagctgggactacaggtgcccgccaccatgcccggctaatttttttgtatttttagtagagatggggtttcaccgtgttagccaggatggtcttgatttcctgacctcgtgatccgcccacctcagcctcccaaagtgctgggattacaggcctgagccactgcacccggccatctggcttcttattagcatgttttcgaagttcaaccatgttgtatgtgtcagtacttcattccttttggtggctcagtaattctccgttgtatggatttggtttattcatccatcagttgatggacattttggttgtttctaccttttggctgttaggaataacactgctatgaacatttgtgtacaaatttctgcatcaacataggtttttaattcccttggatatatatgtaggagtgaaatttctgggtcatatggtaattttatttaactttttgaggaactacaaagttgtgttccaaagcagttgccctgttgtatgttcccaccagcaatgtatgagggttctgattcctctatatcctccccaacactttttttttcttttgagacggagccctgctctatcccccaggctggaatgcagtggtgcaatctcggctcactgcaacctccgcattcctggttcaagccattctcctggctcagccttccgagtaactgggactataggcgtgcgctaccacacccagctagtttttgtagtagagacagggtttcaccatgttggccaggctgatctcgaactcctgacctcaggtgattggctcacctcatcctcccaaagtactgggattacaggtgtgagccactgcgcctggccccaacacttgtttttattccttttttttttttttttttttttttctgagatggagtctcgctctgtcgcccaggctggagtgcagtggcgcaatcttggctcactgcaacctctgcctcccgggttcaagcaattctcctgcctctgcctcccaagtagctgggactacagacgcgtgccaccatgcctggctaattttttgtatttttagtagagacggggtttcaccatgttagtcaggattgtctcaatctcctgacctcatgatctgcccgcgtcggcctcccaaagtgctgggattacaggtgtgaaccactgcaccggcctacaatccattttgaattaatttttttttttttgagagatagaaaaggtctctctctggcaccctggctggaatgaggtggcatgaatatggctcactgcagtctcagcctcctgggctcaagtgatcctcctgccccagcctccccagtagcagggcccacagattgtaccaccatgccaggctaattaaaatatatatatatttttgtagacatagggttttgctatgttgctcaggctggtctcgaactcctaggctcttcctgcctcggcctcccaaagtgctgggattacaggtgtaagccaccacacccagccttaaattaatttttatatgatatgatatgatatgatatgatatgatatagggggttcaatttcattgttttgcatgaggaaatccagttaccccacaccatttgttgaaaagattatttttcctcattgaattgtcttgccactcttgttgaaaatcaattaaccatatctgacagtgtatttctggactctcaattatatgccattaatttctatccttattacagtatcctgctgtcttgactattgtagctttgtagtaaattttgaaattgggaggtgtgagtcctccaactttgttcttcttttccaagattgttttggctattctgggtcccttatatattcatataaattttaggatcagtttgtcaatttctgcaaaaaagtataaaaggggcagctaaaattttgatagggatattgttgaaatcatttattattgaagtagttccatgaggccactaacaggtcagagtgggaaacaaccatttattatctgtttgacaggaaaactgagacacaaacagtgaattttaaaacttcctcagcctgacagtgctgctttcaacagcagaacagctatctcccaaatcccatgatgccaatttccttctgtccttattagaagcaaatatttcctgagtgtttgctctgtgccaggcacagttccaggccctcaacaatgtagaggtcaagcttgagaaagaaccatataaaacttgctgtcaggccgagtgtggtggctcatgcctgtaatcccagcactttgggaggccgaggtgggtggatcacttgaggtcaggagtttgagaccagcctagccaacatagtgaaaccctggctctactaaaaatacaacaattagccaggcttgatggcggatgcctgtaatctcagctactcaggaggctgaggcaggagaatcatttgaacccgagaggcagaggttgcagtgagccaggatcgtgccactgcactccagcttggacgacaaagcaagactctgtctcaaaaaaacaaaaaacaaaaaaacttgctgtcaaatcaattgctctttctaagagaggtgatgtccatcaggaattttcattctctctactatccaatgtataccaaccaaattttcttttaacttaataatttactatttttcctttcctgattatctatcacagaaaatttaaaagatacaaaaattccaaagaacaaaataaaaattacctataatcccataaatcagagacagtcgttattaacatattggtctaagactttaaactctataataataatagttaacatggtggtgagtgtgtgtctggcctgtttaaatattttacattcatcaattcagtttaatcctcacgaaaaaccaacgagttaggtatttatttatttatttgttcacttattcagaacatgtttttcagcccctattatgtgttgggtccttagctatgtgcttagcatgcattagtaaatcaaatgaataaaaatctctgtcttctttgattttacattctagaaggggaaattgctgctaaacagtatgataaataggttaattatatactacgttagaagatgttaagtgccatagacagggatggggtggagaggaggtggtatgggttgcctcactgagtagtaaataggatagtcaggtctgtttgtctgcttaccgtgatcgtagtggatgctctggttctgcctaggtgcctttcaggattggagactactcccccagttgctgatggtgtggtcagccctcagttttcagtcctctttgggaattgccttggatgaagaaagtcacctcacccaagatcactccaactcctgggacccacatccaatgattggccaatatggggactcaaaggcctggtcccccttccccaacttgagactactctgaaggatcacccagcttcagagcttcccatggttgagacttttagacttcactgtggtccaaccaatctcttcctatacacggtcctgactccttcacttccctcccagcacttcttctgtgttaatatcaaacttctgtgctaataacaaacttcttccgtgctaatatctctcagtgtctccttccctgggaactcaaccctagattgtttataccagcagtgatccaagaaagagatgccaacatgagattttggaattggatcacctaccatccagctggcagtgcagaccccatcagtggcagtagaagaagtacatatagtccgtagcacaagatagcagtgaaattgttaaaacttttgccaatggtgaactagaatggtattcccatggaaggaaatgcaccagagggtgtgacctatcaggtggttgagaaatatggggagaattaccacaaggacaattcaattaggtggctttcactaaggataattaacactttgaaaaaaataatgaaatgttgaaaaggattcatcagcaattgaaaactgagtggagctcatagggatactctcatcccttgcacctggaggaaagggaaagctgaggaccaggtacatggtgtaatcctaatagtagcagagtgcaggccgggtgcggtggctcatgcctataatcccagcactctgggaggccaaggcgggtagatcacgaggtcaggagttcaagaccagcctggccaagatggtgaaacaccatctctactaaaaatacaaacagctgggcacggtggctcacacctgtaatcccagcactctgggaggccgaggcaggcaggtcacctgaggtcaggagtttgagaccagcctgaccaatatggtgaaaccctgtctctactaaaaatacaaaaaaattagctgggcatcatggcacaggcctgtagtcccaactactcgggaggctgagacacccgggaggtggaggttgcagtgagctgagattgtaccactgcaatccagcttgggtgaccgactgagacttcgtctcaaataaataaataaataatacaaaaaaacaaaaaacaaaaattagctgggcgcagtggcaggtgcctgtaatcccagctactcaggaggctgaggcaggagaatcacttgaacctgtgcggcagagtttgcagtgagccgagattgcaccattgcactccagcctgggcgacagaatgggactctgatacatgagatgtgaatatctgagtggatgtacccaaagatcttgaattcccagattgctctgagcctgcagaagtggcccacctttctctaagggctggcactcccggtttgctaaaagatgatgcagaggactctcttctgcaggacaacatgcacctcatgtagaatctgccaccatctgccctcctgaccactaacccagtaactagggtaaagtcacagcatgacttggccagagacacgctgggtctcataagagaaggaagcgcttctactgtgaaggagctgcagaacctaccaacatgtaccgggagctgttgacagaccgctggggatggatcctaggggagaccctgagactggaagaatatgcccgagactatgttcagaaggcatgggatcaacaggggcaaaacatttcgaaaaaggaaaggtgatcaatttgggaatgccctggcatgatcgcgggatgacagtgggaacatactgctggaatggctcttagaagcctgaagaaaattatggcccacaccaactaaggtaggaatgccagaattgccataacagaagatggaagaggggaaaaggctcagaaaaatggccatgctagaactgctatactgcatgcagcaggaaagcctgcaaggtgactatatcccacaggagacccagaagatatcccaaagcaataaggaatgcactgctgggagagacataagagggcaccagtatcaccaggagtctctaggccagggctaatgatcagacagaactagactcacgcatggcagtggggatgatgggaccctgaaacaatagaagctgttagccctcagtagccaggtggatgcaattatcataatgagcagcaagtttggagtggcagctgggggaccctgatcctcagagagttgtggcgatagttactagaacatagcaaaactaattgggcaaaagggttctgctcgctgggcacagtggctcacgcctgtaatcctagcactttgggaggccgaggcaggcagatcacgaggtcaggagatcaagaccatcctggctaatatggtgaaactccgtctctactaaaaataccaaaagttagccgggcgtggtggcaggcaccctgtagtcccagctacttgggaggctgaggagaatggcatgaacccgggaggtggagcttgcagtgagctgagatcgcgccactgtactccagcctgggcgacagagtgagactccgtctcaaaaacaaaacaaaacaaaagggttctgctcaatctgtacaacaaagagaaatcaagaacagttgatcagcaagccaagggcagctgcccccaataaaaagtcacaatcatttgctcagtttccagacaggaactagttttcagacccagaacccatagatgaaaagagaagccaggtccccagtaagtacgctgtcagatcatgtacactgatatatatggtaagtacccagtaagtaccctgtcagatcatgtacactgatgtacatggtggacatttcccaggttcttccccaaagggaactctggccacttatttgggtagtcatactctgagaaaagggaatactcttttttttttttttgagacggaatcccgctctgttgcccaggctgaagtacagtggcatgatctcggcttgctgcagcctcggcctcctggattcaagcgtttctcgggcctcagcctcttgagtagctgagattacaggagcccaccaccacaccagctaaattttgtaattttagtatagacagggtttcaccatgttggccaggctggtcttgaactcctggcctcgagtgatccgccctcctctgcctcccaaagtggtgtgagccaccgtgccgggccaggaatactcttttaaacactgttaggtatgaggtcctagttgagaccctgagactggaaacatcatcatgagacacgtttaaagtacacatgggggccaggtagtaaatggaggctggcctaggtgtggcccaccgtgtgcccaccaagtccacagattcaccaagtggtcatttttctagtccttgaatatatcattagaatggacttaccttggtttcttggcctgtggaataagagctattataatgggaaggtcaagtggaagcctctgaaactgcatttccggcaccctccttcccccatgagccaagacagtaaatcaaattatgcatcccagctgggggtgacagccattcataaaaaaagtaatgggggctgggcacagtggctcacgcctgtaatcccagcactttgggaggctgaggcagacggatcatgaggtcaggagttcaagaccagcctggtcaacacggtgaaacctcgtctctactaaaaatcaaaaaattagccaagcatggtggtgggcgcctgtaatcccagctacttgggaggctgaggcagcagaatcacttgaacttgggaggaggaagttgcagtgagccaaggtcgagccactatacttcagcctggatgacggagtgagactctgtctcaaaaaaaaaaaaaagtaactgggaaagacccaagggatacaaggtaggtagtttccaccacatctccatttaattacccatccaaactgtgaaagtcaggcagatcctagaggatgacaataggttactgtagtcaaccaagcagtagtcctatctgtagctgctgtgccagatgtgatatctttgctagtgcaaattaacatattctcaggtacataataagtggccactgaaccggtgagtgcgttcttttccatcctatcaaaaagaggatcagaacagttgattcacttggaacagacaacatgtacatttacaggccgggcgcggtggctcacgcctgtaatcctagcactttggaaggctgagacggacagatcaggagattgagtccatcctggctaacacagtgaaaccccatctctactaaaaatacaaaaaaattagccgggcatggtggcaggcgcctgtagtcccagctactctggaggctgaggcagaagaatgatgtgaacctgggaggcggagcttgcagtgagccgagatcacgccactgcactccagcctgggtgacagagcgagactctgtctcaaaaaaaaaaaaaaaaaaaaagtacatttacagtcttgccccagggctgtgttaatgctcctgctcgtggcataatatagtcctgagagacacgggctggctggatactgatgacatcatgctaatcgaaccagctaagcgagaattcactagtgcatcagagacctctgtaacatgcattccagagcgtaggagaaaaaccctatgttagacatcagaggtctaacatctcagtgacatttttagaggtccaggggcctgggacatgctgagactactcctcaagggaaagaatacattattggatcttgtacttcccatcacaaagtaggaagcctaatacctagtaggcctctttgagttccagaggcaacatattccaaaaatgggactatcgctttaactcgtactccagatgacatgaaagcctgtcaattttaagtggggccaagagcaggaaagggccccgtagcatgtccaggctacaatgcaatcagtcctgctgcttcggccagatgatccagcagactctatgttattagaggtatcagtgttggaaatttatgacaagtcccagagggagaatcatagtgcagatttgcaaggttctggaacaaggctatgctatctgtaacagagaattaaatgcctttctagaaagctcctggaatgctattaggccctgttagagacagagcacctgaccattggacaccaagtaactaggcagccataagtgctcaacatgagctgggttctatcagagccatggagtcataaggtgagggaggcccaatcccagcagaagtccatcataaggcagaaatggtatatccaggatcaaacaggtgcaggctgaacagcacatgtgatctgcatgagctagtagcccagacacacaagccactcatcactgttataccagcatctctctcagctcacacctatggttccatgtggatccctgattgtgattagttaacagagaagaaaaaaactgagtgtggttgatggatgagttggttcgatacatgggtacgaactgaaaatgggtgatggctgcactacagtgccattcagggatgaccttgaaagacaatggtgagcagaaatattctcaatgggcagtgaatctgtcatcaggtttatatgcaaaaacaaatggcttgggtttagaacaaactaggactcatgggtagtgataatggcttggtcaatggcgttcaaagagaaagatatgaagatcgggacaaagaagtatgtggtagaggcacttggatgacatgtaggagtggacgcgcagtgcgaagatcattgattagcatgttagtgcctatgcaacagcactcacaacacatgcgtggagcagccatggtggaagggatggaggctagacatgggcccaatagcagaggctcaccaaggtcgcactagctcctgctactacatgtccaatctgccagcaatagttaccagcactgagtcctttctttggtatcatcccttgaggggactgaccagccaccttgcaaggagtagcaattaacttagacagaaatagacattctggggatggtttcggctttcctccatacagtgtctcaaccagcaccactatcccaaggcttatagagtgttgaatccaccagcacgggatcctacatagcattgcattagaccaacagacccactttacaacaaaggaggtgcaagagtaggtccatgcccatcatatcacatattgaaaccaactcaatagtcccacagttttttggataaaccaccagaattgatgcttctggtcttaaagcttgaaccttatatttgttttatctgcattccttcttcaggaagcaatcttcaggcctctcaaaaaactatcaggccgggcacagtggctcacgcctgtaatcccagcactttgggaggccgatgcgggcagatcatgaggtcaggagtttgagaccagcctgaccaaaatggtgaaaccccgtctctactaaaaatacaaaaattagctggacatggtggtgtgcgcctgtaatcccagctactcaggaggctgaggcaggagaatttcttgaacccgggaggtggaggttgcagtgagccaagatcacaccattgcacactccagcctgggcaacagagcaagactcttgtctcaaaggaaaaaaaaaaaaaaactatcaaagaactgaaattcagccaagcgcagtagctcacgtctgtaatcctagcactttgggaggctgaggcaggaggactggggtcaggagttcgaaaccagcctggcctacatggtgaaaccctgtctctactaaaaatacaaaaaaatggccaggtacagtggctcatgtctgtaatcccagcactttgggaggccgaggcaggctgatcacaaggtcaggggttcaaatacaaaacaaattggccaagcgtggtggtgggcccctgtaatcccagctactcaggagactgagaaggagaattgcttgaacccaggaggcagaggttgcagggagccgagatggcgccactgcactccagcctgggcaacaaagcaagactccatctcaaaaaataataataataataaaataaaataaataaaaatacaaaaaaattagccaggcgtggtggtgtgtgcctgtaatcccagctacttgggaggctgaggtaggagaacgacttcaacccaggaggcagcggttactgtgagccaagatggtgccattgcactccagcctgggcgacagagcaatactctgtctcaaaaacagaaaaagaactgaaactcaccagatcaccacatccagacaacggacaatgagatgctggatccctcattcatcatgattgcttccttgcccctccctagttcctattttgttgtacattgttacacttcttccctactatataaacctctagttttagtacagcagggagatggatttgagactaagctcccatctcctcggctgtagcacccagtctgtagctacagaaggctatagcacgccttcttcttcttccttcttcttcttttttccttattccttggtaatactcatctcaatcattggctttctgtgcagcgagaagcaggatctagaccaaacccctggtgtttcgataacaatatcatactacccagtctcagagaatggtagaggtggagtagcctgttgaagcatcagctgggaggcattacaaagatggcaacaaactttcaatctggaaaccaagaggcagaagcaagaatgactccatttattcatcattctcaatcacccactcgggaaatttgtgcttcctgtctctgcaactatgggctctgcagggttagaggtcctggcattgaaatggagaaatgctggccaggcgtagtggctcatgcctgtaatcccagtacttcaggaggccaaggcagaaggttgcttgagctcaggagtttgagaccagtctgggcaacatattgagattcccatctctacaaaaaattaaaagttagctggacatggtggcacatgcctgtagtcctggctacttgagaggctgagatgggaggatcacttaagatggggaggttgagactgcagtctgtcacaattgtgctactgtacaccagcctgagtgacaaaaggtctcaaaaaaaaaaagcttccaccgggggacccagaaaaaatctcattgaacaataaactatggctgccactttggtacttcaggctatttgtgctaagcaggaccagcagacaagaagaagagtcaccatcttggcagaggcgattgactgtgatcagcaagggaagggagctctattgctacacactgggggcaaggaagaacatgtttggcacccaggtgatctacttgggtgactcggtcctcacccaactttgacagctaatggacaagtacagcagctgtggcctgagaaaggcctggtgaccagggagcaaatagatcgctcagggatgagggtctaggtccccagaccagataggccacctagaccagcagagtctatttgtgggtgaggggaaatctagaattgtattatcagtgtgaaagggaaaaatgaatattaatcgtagcctcaagacaagctgcaatgtcaggggctgttgttcatctctttaaccttcctgttataagtttctcccaggaaagaagcccactggaattccagaggaactgctccttgaacttatttgaagtagatctgaacagcacaaggggtgaattataatggacactgagatgcgccatccataacccccattaggactgattacttatctccgcaactgcttgggagtgctgcaagcagacagctctcagctgtgagcactccttagaaatcgtctctgttgcagagagcagtctactcgctttcctagggctgccttcatccagtgacctggccccctcaccctaactcaggacatctctgaagagcctgccagcctcggagctcctcttaggattggctgacgcctttgttgagactactgcacagtccagtcccgcttcctcctcttcccttccacaggagttgacctcaagagcactccccaataaacttcccactcagtctctatctcagagactgcctccagagaactcaacctgtgacggtgatatctgagcaaagacttaaaggaagtaagaaggaagattattccaggtaaaagggcagctagtcccaaatctctaaggcaggaatgtctgtgtggtcaaaaaacagcacaagaagccagagtggccgtaatggaaggagggaatggagaccatggaggaagatgagatcagagcaacaataggaagccagatcatggagtgccccaaagaccgttgttggatttggctttttactatgagtgggccccattgcagagttttgataagaaaagtgacatggccaggcgcggtggctcacgcctgtaatcccagcactctgggaagccaaggcaggcagatcacctgaggtcaagagttcgagaccagcctggccaacatggtgaaacctcgtctctactaaaaatacaaaaaaaaaattagctgggtatggtggcacatgcctgtagtcccagctactcagcgaggctgaggcaagagaattgcttgaacccaggaggtggaggttgcagtgagcaaagatcatgccactgcactccagcctgggtaacagagggagactccatctgaaaaaagaaaaagaaaaaaagaaggaaaactgacacactctaacttgaaatggaaagcatcattctgactgctgtcttgagaaaagagtaggaagggtaaggatggtcacagggagactagcagggactctatttcagtcatccattgagatgggacagtggcccagaccatggtggcaatggagaagacagcaaaaactgatctgattctggatatagcccaaagctagaaccaacagatttcctgagccattgggtgtagtctgtgacagaaacaaagaagtcaaggatgattctagggttttttgttctgaaccacctgaggaatggaattgagatggggaatgctatggatggagcgaatgggggaatagaaaataaggagtttaatttcattttggatgtgaattttgagattcctattagacatccaaataaagatgtcaagtagtcagcgggatgtaccagtctggatttcaggggagaggtctggactggagatataattggaatcatctgcaaagggacatggttgaaagtcttgagactgggccgggcgcggtggctcacgcctgtaatcccagcactttgggaggccaaggcgggcggatcacgaggtcaggagattgagaccatcctggctaacacggtgaaaccccatctgtactaaaaatacaaaaaattagccgggcatggtggcgggcgcctgtagtcccagcaactcgggaggctgaggcaggagaatggcgtgaacccgggaggcggagcttgcagtgagcccagatggcgccattgcactccagcctgggcgacagagcaagactccgtctcaaaaaaaaaaaaaaaaagaaagaaagtcttgagactggatgagtccaccaaggtaaggggtatagatgacgaagagaaaaccaaggaccatgtcccaggtgctgtatccttaagaaggcagggaggagggagatagaggagtgaccagtgtggggtaggaaggaaattaagagaaaatagggtcctagaagccaagagaaccaattgtgtcagagaagaaggggggcccaactgggtcaaattatgcccaaagaccaagtatgatgacagctaaggactgttccttgaacttagtcaatgttagcaactttgacaacatcagttttactggagtagcaaggacaagagcctggctggagtggatttcaaagagagtgcacatcagtgcgtatcacctattcttttgagaagtttcattgcaaagaaaagcagagaaatggtaggtagtggcagagaaagtggttaggagaaggtattattattgtgatccattttacagatgaggaaaatcaggcttaaaaaagtcgagggccaggcacagtggctcacgcctgtaaccccagcactttcggaggccaaggcagaattgcttgagcccaggaattcgagaccagcctgagaaacatgacgaaaccttgtctctacaaaaaatatccaggcatggtggtgcacgcctgtcgtcccagctactagggaaactgaggtgggaggattgcttgactcaggaggtcaaggctgcagtgagctgtgaccgcaccgctgcactccagcctgcatgtgtgagcaggctgtgtgagcacagcacatctgtgatgtgacagaacaaaaccttgtcttgaaaaaaaagtcagggaatttgtttaggttcattcagatagcaagttgtgatttgagctcagaatctagaagctgagctcttacttttttttttttttttaaccaattccctattgatggaactaagtttttctcaaatttttctattatattgatttatttctattgttaaaaatgtcagttataaagcagatgaatattcttttttttttttttaatgttggccaggctagtctcaaactcctgacctcaggtaatctgcccacctcggtctcccgaggtggtgggattacaggcgtgagccactgcacctggcccagatgaatattcttacaggtaagcatataatcacatttctgattatttccttaagatgaatttctggacgtagaaatcctgggtcaaaaggtatgcacatgcgtatagctttggatgcctcttgccaaagctctatggaaaggttgtagtcgttcccacttttgtcagcaacacaggagaaggtccatttcctgcatcattaccagccctgggtcttatctttctctcccaaccgcgtcccactgcatagtgagaatgataccattttattttccatatgtacgattaccagttagatttgaccatgatgtacaggtctatcttccagccacccctttggcttctgctggtgtttatcactctcagacctgatcgccttcacctgacccctctcatcaggaatatttatctcttgctgcaacagacccagtttagaaggtaaactgcacagagctaggttgaattttaaaataacaataattttagggtaagaaattagatcttgggtgatttttctatctgagagactgtggaagagctaagattttagaaaagctaggggaaatataggaaggtgtgataattggaccttctgtgtgactctccatgtagctatgacctaagagtgtcttgttccgaagaatcccccagagtgtgcattgaaaggggagggaggtcccttcatgaaatatacttccagggccataattttcaatttagccactgttggagggctttcctgctcttcctttgctcctcaacctagccctgtctgggagcacagctgataagctggccccagcacatttgaaagaagcatagatatttcttttcttttgtttcttttctttttttttttttttgatggagtctcgctgtcttgcccaggctggagtgcagtggtgtgatcccagctccctgcaacctctgcctcctgggttcaagcaattctcgtgcctcgagtagctgggactacaggcatgtgccaccacacctggctaatttttgtatttttagtagagatggggtttcaccatgttagccaggctggtctcgaactcctgacctcaagcaatccactcgccttggcctcccaaagtgctgagattagaggcgtgagccactgcacccagcctgatatttcttttcttttcttttcttttcttttttgagacagagtttcactcttgttgcccaggctggagtgcaatggcgtgatcttggctcaccgcaacctccacctccccggttcaagcaattctcctgcctcagccttccgagtagctgggattacaggcatgagccactgcgcctggccagatatttctttacatcagtaatacatagttgttgtaaaaagattaggaaataggccagtacagtggggcatatctgtagttccagttatgcaggaggattgcttgagcccaggagttcaaggccagcctgggcaacatagagataccccctctccactcacccatctccatctcaaaaaaaaaaaaaagattaggaggctgggtgcggtggctcacacctgtaatcccagttccttgggaggctgaggcgggtggatcacctgaggttgggagtttgagaccagcccgaccaacatggagaaaccccatctttactaaaaatacaaaattagcagggcatggtggcacatgcctgtaatcccagctacttgggaggctgaggcagaagaatcgcttgatcccgggaggcagaggttgcaatgagctgagattgcacaattgcactctagcctgggcaacaagagtgaacctccgtctcaaaaaaaaaaaaaaaaaataggaggtaatgacagcagaaagaaaaataattaaaccaatagaaattccttccactgtcctctcagataattgttatttacgttttgccaattttggttttcagatcttttcattaaacattttgcataataaatttacataatttattcttttccaataataaatcttgaatgtctttctaactttccaattgtcaatcaatgttaatctacattgtcatttttgtaaaaacaacttttgtagagacagggtcttgctatgctgcccaggctggtcttgaactccagcctcaggtgatcctccctgcttggcctcccaaagtgctgggattacaggcatgagccactgtgcccagcttacactgtcatttttaatgagttaatttttattaaatttcattatatggatcattttaagtaatttagttaatctcttatttgtggacttttattgcttagttttttactacaataagcaagaatgacaatattgaggctaggtgcagtggctcatgcttataatcccaacactttgggaggccaaggcaggaagattgcttgagctcaggagtttgagcccagcctgggcaatgtactgagaccccatctttacaaaaaaaatttaaaattagccttgtgtggtggtgtacacctgtaagctcagctactcaggaggctgaggtgggaggattgcttcagcccaggaggtcaagtctgcagtgagccatgatcatgccactggattccaccctgatgacacagtgagaccctgtctcaaaaaaagagtgccaatattgtacatacatatttgtccacttgtccagtattcctctaggataaatcccaaaaagtagggttactagctcaaagagcatgcacatttttagggtttctgagatgaactcctaaagatccaaacatttcctgaactactttatctccacaacagcgttctagttataggttttcactcaatgatgttcatgctgaaatgagcaagaaagaagtcacaggttctctttgggacaatgattagttctacaagcaaggatattatttgagaaagataaattgaaaacaaaagatgaatggaaggtgaggaatttaacatttagaatgcaaagaagcagatctgtatgcaagtgagaacctgagcttccagaagcttccatgtgacttggcctctgcttaatagcagcagcagtcccaggcctcttgcttaaactctgtctacactcgcaccatcctgtctgatggaagaaatgacagaactggaagaagagccatcttagagatggacatgtgctcggcacagacaagcacttagtgtcctgttaagaagaccaaaaacataaacaagagaagaatcctctgtagcaacatcaacaaccatcttcacactcgcccttggtctcttaagccaacaggcctaaaattgagctcattgttcttttccatggactcttgctcctatcatccctatcttcaattagtggcatcgccattacttagcaagcctaagcaaaaaacctatgacttctccttctcctttaaccccaacatcgaaggagccaactatttgcatgtatcctatcctcagggtcttttctttccattctccttatagccctggatggagcctgcattgtcttttgcctgagagaaggtggtagtctccaggatgtgtctatggaggtttcaaaaccttctgatggctccatcgtctgcagctgatgcttccactcctcagtaagacagtaaaagcttttccaaaatctgaccctagccttgcttttcagcttcatccccgctacttcccttcttgtgctccagatacttggacttccccagcaatcgcctccctgtgcttttgttctggtggtttttttccccactgacctcactcctcttctcctccctttcccagcctcctgaactcattctcatcctcaaaggccaatgcaaatattaattctctgcaggtttctctggacagaatcaatcatcctctctatggtgttcccatagcattttgtctaactgctagagaaacatttagcatggtatcagatgcctcctgatagactgggatttcactgaggacatggaatgtgtcatatttatcttggataccaatggcatagctgaattccaggcatataggaggggcttagtaaatattggttgaattggattaagtcagaaatacatccaggtcactgactcttatccaatgtcttttttttttttttttttttttagacagagtcttgctctgttgcctaggctggagagcagtggtgcaatctcggttcactgcagcctccgcctcccaggttcaagctattgccctgcctcagcctcctgagtcactgggattacaagtgcataccaccacacctggctaatttttgtatttttagtagagacgtggtttcaccacattggccaggctggtcttgaactcctgacttcaggtgatctgcccgcttcaacctcccaaaatgctgggattacaggtatgagccaccacacccagttccagtgtcttttatattatcccaaagtgaatgcttgcaccgcgagggggccattattaccagaaggcagaatggaccaatctctcactcttcctgttcctttctgttaccccttgaaattccattggaaattaattattttgtgtatgatattgtctctagttacattacaaatatcccttctgctgagcattctagggataaaaaaattacaaatatccctgggagggattaagactttaaggcattatcatcaaggttaactccactaaaatttttgtgctgaaaatgaacttagaagttgttactcctaggctgggcgcagtggctcacacctgtaatcccagcacgttgggaggccgaggtgggtggatcacttgaggtcaggagtttgagaccagcctggccaacatggtgaaaccctgtctctactaaaaatacaaaaaaattagccaagcatggtggctcacgcctataatcccagctactcgggaggctgaggcaggagaattgcttgaacccaggaggcagaggttgcagtgagccgagattgcgccattgcactccagcctgggcaacagagagagactccatctcaaaaaaaaaaaagaatagaagttgttactcctttctaaagaaacgactaacctacagggactacctgcagaaggagtgggcatcgggtatgttaacaggagcactgagaggaaacagttgcagagcagggctgcgggggtgggtggtaagggccagttctgcatgaggtaccacggagggaggtatggggtggtgcaagtgcccagatgcctggggagggatgtgcagatggggagggaattagattgtgggagaggggaggagcaaggacaaattcttcctacttctcaattccgtcaagtgtcttccctgtgtagagtgatgattcttaatgaagatcctgacttccaaacacctctggtagatctccttttttgctagagtgccagaaaattcttaggtaattttccaattttaattcactttcatcttaaaaataaatacatgcctcatggcatttttaagaggggtgggtgtttgatgaaataaaatgagtgacaacagggtgtcacaactccagaaaggtttcatatcgctggtttagagattcccagtgagtaggagtttgatgaactgaaaaaatgaaatggcttccaaatcactctgccctactatgctgatttgaaacacataacctgcctacactgctgaaaagctcccagccctggggtgaatgaaccctgcaaagctactacttggcactcacccagcagtttgcaaaaggcagtgaaaggaaatgttcacagtcaattgatagcagcaggacccttagggagctagagtgagggatgggaccagccaaggccatttggacgggcatccaggtcaccacgcaaaagccttcctgggaactctcaggacaatgacggtttggagccctggcttcacatttcactttgaaagaggccaccacctaaatgggttgagatgctcctttctgcctctctctagtcaaaggttcatactgcccaggagaagagtgaaaagggaaaatcagccttattagcatgtatttatttggggccttggctctgaggcagcatttcgtggtgccttttaggactggaagagagaggctagaagattcctgctatatttgaaagcaattcatgacttaatttcacattttttagttctggattatgtagggtgcttatatattcaattattacctcgtattaagatttcaaattgtgatcttcctatttcccaaagaagagagcttgaggagttcattaggccaggattcttcttcctttgagagacaaccaagcagatggtgttgctaatgcgcagacacctgcacagatgccctgctgaggcccaaacaacatctgtggcttttcttcatacccaataaataacttacctttccctctctgatttttcctcttttaaaattctgtatagttactaatggaggtgataaggataatgcagggcaggacttttaaaacacttttaaagcaacaaaaccctctttcaattgaaatctgtgcctaacttcagcatgtaaaaccaaaaagaaaggccaggtgtagtagcccatgcctgtaatcctagcattttgggaggcggaggtgggaggatttcttaaggctaggagtttaagaccaacctggataatatagcaagactctgtctctacaaaaaatacaaaaattagctgggtgttgtggtgcacacacctgtagtcccagctactcaggaggctgagccaggaggatctcttgttttttgagatggagtctcactcttttgcccagactggagtgcaatgacgcgatctcggctcactgcaacctccgcctcccaggttcaagcaattctcctgcctcgcctttcgagtagctgggattacagacatgcactaccacacccagctaatttttctatttttagtagagacggggtttcactatgttggccaggctggtctcgaactcctgacttcaagtgatctgcccaccttggcctcccaaagtgctgggattacaggtgtaagccactgcacccggccattaggaggatctctttttattttattttatttttttttgagacagagtctcgctctgtcgcccaggctggagtgcagtggcgcagtctcggctcactgcaagctccatctcccaggttcatgccattctcctgcctcagcctccagagtagctgggactacaggcacctgccaccacacccagctaatttttttgtattttagtagagatggggtttcaccgtgttagccaggatggtctcgatctcctgacctcgtgatccgcccgcctcagcctcccaaagtgcttggattacaggcatgagccaccacgcctggccctggaggatctcttaagcccaggagtttgaggctgcagtgagctatgatcatgccactgcacttcagcctgagcaacagagcaagaccccatctaaaaaaaaaaaaagtagggggctgggtgcagtggctcacacctatagttccagcactttaggaggccaaggtgggcagttcacttgaggccaggagttcaagaccagccttgccaacatggtaaaaccccatctctactaaaattacaaaaatcagccgggcattgtggcacacacctgtaatcctagccactccggaagctgaggcaaaagaatcgcttgaacctggaaggtgaaggttgcagaagccaagattgcaccactgcactccagcatggttgacagagcaagactgtctgagaaaaaaaaagaaagaaagaaaagaaaagaaaaaaagtagtggttctttggttaagctgggatggggacctggagtcttgacctcctcgcttctggcccctgggaagcaaatctcacataaattccagaatgctgccatcatcccaatcagaatttctcaatctccaagggaaattttatcatctggcacttcaatggctgttttaaaatgttacaaaagatttggcaaggtcccaatgggaggggcaggcacctacatctgggcttggaagccaacgatgtgatatgagggagtctaagtggccactgccagctccgctctggggactgccagcctccaatcctgcttgctgtctacatcacataatgtgcctggttgagaaaaggccttaggaagagccagagagtgccagagaatggaaagagtatgacacatgcctcgctgaggtcggacagcgcgtcagccttactttcccagctgactaaggacgcctcccaccaagctgcttgcctgctgaagcctgtcttgaaaactgacagtagatggctgtgactacccagagttttttccccagcagttaatgaacacacagcagacgcatgcatgcaataccttggaatcatcccagaggctccaggtcaggtctccttgtctgaacgcccctacctagctgggccacacaagcagtttccatgctgagtccactaagtaatccaaaacaattgttccttgggatttttctgaaaaagagatagaaagtgctctgcctcggtgagcagagggagctgcttcagtattggaaacaaagataactgaaatgcagtctttagaatctgataaaccctcttcccaggacaagaaaggcatgaagtcaggcctgagctttggggctcatttcaggtacatgctggctttagcaacagaggaaaagccattatccctgtcttcttaatttccctcagcaatcagccctagcaggttcaccatgttctctgtgcagtttgagacaaactcactaaacgtcctgttctctgaaaaatgatccatccaagagggcacaggccaagagtgtttctccttttggtatcagggacaggttgtaatgctgccgtgatcaaaggcatgagttcctcaggtgagggggcagcccggctacagccctggtggggagggctgcacttagcgtaggagctggctatttcactgcccccaccccatcttcattgcttctaggcatccagagctctatggtgtaacgtatatcctggaatagttccaacatctctgttccaggacttgctggacacagaaccacttgtgatacggttagaaaagtcacttttcatctcctgtcctaagctgctaagaaaaacgaatcatgtagcctagatttacatgtttgcctttttctggtgatcatgagtgactgatctgagcaataagtatatgactgagaggccctcgccaggcatttgtggagcggattgccgaagcttggttagttaagcaatatgccagaaatttggagatcatgaactctgacttttgccaccttgccacatgctcttcagccagttatttctcctatgttctgcctttataaaatggggataagctatctctgaggttgttttaagaagagacactaatgaaaatgattgtcaagtgcctctctaaagagaaagtacagtaggcataagtgctttatgtgatgaaattccatctttcttcctccctttgcaacctgaaccatggaatcaataatgtttttccaagtgcagtgtccccaggacaaaatatgaatcagtttcctgagctcggcagccctcggatggggagtagcccctgccctctggggcctggtgtccagggtgtggctggctttactgctgtaagtgcccatcttatcctgggattccagccaagatgccagtgttgcaaatttctctgatttcagaggaagatttgtttaggggttgagtcttcacagtggcttttgccatctatctccattttattttctcttttatcgagtacctattgtaccccaggcactgtgctaaatgcattcacctacattatcttgtttaatcctctgagcagctcggcgaggggggtgtcattaccattcttattttacctcacgaaataggcacttggagggagtgaaacgagttagcaaggtaacacagaaaacaacgggcaaggccaggattccaacccaagctcatcattactctcccatgcttcctttcccacagttgccctacattcagacacttcccatttaagagaaaatcaaactgcagtttgagaaagcactaactagagagttcaagggagtggggtcttctgcccacacctatggggaatatgctgtaggcatggctattgggtactacctgccttggaggatgagggtgaagggaatggggtccttcctccttcacctggtcctgtagaccagtgcccaggcctgtgtgttctcagagcatttcctgcccatctgaaatgcagagcatccaggctgtcactgctacagcagggcccctaatgcactgccttacatcaacatgattgtcaactcatttcagctcaatcatccggccttgtgagagacgcccacatgctgaagagcctttctgcagttctgcattgaactcttcatgtggccccatctagtaatgagtgcgagtggtaagtgcaagaaacagagcaagggagaggacccttctcttgtagttctttttttctttttctttttcttttttttttttttttttgagacagcatctctctctctcacccaggctggagtgcagtggtgcaatctcggctcactgcaacctctgcctcctgaattcaagcgattctcctgcctcagcctcccgagtagctgtgactacagtcatgcgccaccacgcctggctaatttttgtatatttagtagagatggggtttcagcatgttggccaagctggtctcgaactcctgacctcaagcgatccgcccgccttggcctcccaaagtgctgggattacaggcgtgagccactgcgcccagccattgtagttctttatatagagaaaaaagtactgatgactagtccttgtatcagtgaaaactgagatgtagagcaaagcggagctgcctatagacagatcaactgattttttaccaaaataagggagggtccttcctgacaggtttgcttggggactgggggagagactgcagcttattgcataatatctgtttccctcttaattataaaactccaagtttatatggagcaaagtacccagctaaaatctacatttccaagtgttcctggccacttagatataagggaatattatacataaaaatttcaagaagtctgctgagagggagctgactcagagggccaaccttttgttgcttcgcttgtccttctccctttgtcctgctgcctggaatgcagacatgatggctggcatgccactgccctcttaaaccatgaggtagccttgtggatggaagtcagtgctaaggatggtgctgcagaaagccagaagcagcttgggttcctgctaacttcgtggagccactattcctgcccagaactgtagtcccctggaattcttttacataagaggataaaccttgttttctgttgtataaagtctaacttaatcctaattgacagattctgtttgatagaggcacctggaatttctagctagtcaaggtcacctgagccctgtctgctctatctacctcctaaaggcacatacctaagtcttcctgatagtctttgcacaagttatatgatcacctgtagaagggtaggtgtggagactttttagggaatactaaatgaattcctgaattctattttttgtggaacatgtatattgagcacctaccacacacgaagtaccatgctagatacactcgggtctactctcaggacacttaaatagagcattttaatagaccgacatggcaatttaaatagagtgagatggctgggtgcagtggctcacacctgtaatcccaacactttggaaggccgaggcaggcagattgcttgaggccaggagtttgagaccaacccgggcaacatagtgagatcccgtctctacaagaaatttttttttaaaaagttagccaagctcagtggcatgtgcctagagtcccagccacttgggaggctgaggcaagaggatcactggagcccagaagttcaaggctgcagtgaactatgatcacaccactgcactcaagcttgggcaactgagtgagaccctatccttaaaacaaacaacaaagtgagatgtgcactgtaagggagtactctaacagaggagttccctaacctagtcttgtagaaggcttgcaagaaaaaactagagcctgtagggcaagtaggagccagtcagatgtaaagtaaccaaatgaagagctttctgtggatgacacacaatcctttttaatgggctacagttgtctttcaaaacaggctatgacccagcagctgattcttgctaagcttgcaatgttcttgcaatgatcaatactggtagccactccattaccgtacccacggtttagaaggtagtttgtatttttccttctttttcttttaccacaaactttactccctcctagggtctagagtaaggaaaaaaaatgtgtgtagatcaggaagtctgattatgtaccaagagtagatttggggaaaattcagactggttgtatccagatgggtttgcagtcagtatgtggtcctaggccttggtcttggcagagaggcagtgcagggcaagggagcttccccagtgatcagtggtctctagggaacccgtttgactttgtcattctcagacctgatcagatccaggcagctctaggtctgctgcttctgccctgaacccaggttctaagtttttgtttacattcaagatgagactggctgggcacggtggctcacgcctgtaatcccagcactttgggaggctgaggcgagtggatcacaaggtcaggagatcaagaccagcctggttaacatggtgaaaccccatatctactaaaattacaaaaaattagctgggcgtggtggcacgtgcctgtagtcccagctactctggaggctaaggcaggagaatcacttgaatctgggaggcggaggttgcagtaagctgagatcacgccactgcactccagcctgggcgacagaacgagactctgtctcaaaaaaaaaaaaaaaaaaaaaaagatgagactgtttttgattataagtaacagaaaccaactaaagccagcttaagtacaaaaggataagtcagaggaccggtaaggattttcttttcttcatccagtggcaggaaagcgcaatgtcgaatgaagatatcaaagtcataaactagaaggtatcaggagtccccaatccacatggtaatgaataaatagtgctcgcggccagacgcagtggcttacgcctgtaatctcagcactatgggcggctgaggcaggcagatcacctgaggtcaggagttcgagaccagcctggccaacatggtgaaaccctgtctctactaaaaatacaaaattagccacgtgtggtggcgggtgtctgtaatcccagctacttgggaggctgaggcaggagaatcgcttgaacctgggaggtggaggttgcagtgagctgagattgtgccattgcactccagcctgagtgacagaatgagactctggctcaataaataaataaatagatagataaataaatagtgctcgctttggcagcacatatactaaaattggaacaatacagagaagattagcatggtccctgcataaaataagttttgtgtgtgtgtgtggttgttttgttttgttttgttttgtttttttgaaacagagtcttgctttgtcgccaggctggagtgcagtggtgcaatctcagctcactgcaacctccgcctcctgggttcaagcgattctcctgcctcagcctcccgagtagttgggactacaggcgcccgccaccaagcccggctaatttttgtatttttaatagagatgggtttcaccatgttggccaggatggtcttgatctctcgacctcatgatctgcccacctcggcctcccaaagtcctgggattacaggtgtcagccaccatgcccggccaataaaaaaaaattttaatttaaaaaagataaataaataatttgtaaaaggccaggcacagtggctcacgtgttatcccagcattttgagagactgaggtaggaggatcacttcaggccagtcctgggtaacatagtaagatctctaccaaaaaatagaaaagttacctgcgcgtggtgccacatgcctgtagccctagctactcaggaggcaaaggtgggagaatcgtttgagtcctgaagctcgaggctgtagcaagccatgatggcgccactgcactccagcccgggagacagagggagactgtgtccctaaaaaataaataaaaataacttctcaaaaaaagatatacacgtgaccaacaaatgtggaaaaaagctcaacatcgctgatcattagagaaatgcaaatgaaagtctggacacggtggctcatgcctgtaatcccagcactttgggaggctgaggcgtgctgatcacctgaggtcgggagttcaagaccagcctgaccaacatggagaaaccctgtccctactaaaaatacaaaattagctgggcctggtggcaggcgcctgtaatcccagctgctcgggaggctgagacaggagaatcacttgaacctgggaggtggaggttgtggtgagccgagatcatgtcattgcactccagcctgggcaacaagagcgaaactccgtctcaaaaaaaaaaaaaaaaaaaaaaaggccaggcgcagtggctcacgcctgtaatcccagcactctgggaggccgaggtgggtggatcacgaggtcaggagattgagaccatcctggctaacacagtgaaaccccatctctactgaaaatacaaaaaattagccaggtgtggtggcgggtgcctgtagtcccagctactcgggaggctgaggcaggagaatggcatgaacccaggaggtggagcttgcagtgagccaagatcgtgccgctgcactccagcctgggcaacaaagcgagactccatgtcaaaaaaaaaaaaaaagagagacagagagagagatgcaaatgaaaaccacaatgagataccatctcacgccagtcagaatggcgattattaaaaagtcaagagacaacagataggccgggcgtggtggctcacacctgtaatcccagcactttgggaggccaaggtgggcagatcacttgaggtcaggagtttgaggccaggctggctaacatggtgaaaccctgtctccactaaaaatacaaaaattagccaggcaccatggcgcacacctgtaatcccagctactcaggaggctgaggcaggtgaattgcttgaacctgggaggcagagtttgcagtgagccaagattgcgccactgcactccagcctgggtgacagagtgagactctgtctcaataaaatgaaatttaaaaaagaaacaagagctgctggcgaggttgtgaagaaataagaaagcttttacactgttggtgggaatgtaaattagttcaaccattgtggaagagagtgtggcgattcctcagagatttagaaccagaaataccatttgacccagcaatcccattactgggtatatacccaaaggaatataaatcactttgttataaagatacatacacacatatgttcattacagcactattcacaatagcaaggacatggaatcaacccaaatgctcatcaatgatagactggataaagaaaatgtggcggctgggcatggtggctcatgcctttaatcccagcgctttgggaggctgaggcaggcggatcacctgaagtcaggagttcgagaccagcctggccaacatggtgaaacccatctctaccaaaaatacaaaaattagccgagtgtggtggtgcatgcctgtagtcccagctactccggaggctgagaggcagaggaattgcttgaacctgggaggtggaggttgcagtgagctgaaatcatgccactgcactccagcctgggcaacagagcaagactccatctcaaaaaaaaaaaagaaaagaaaaaggaaagaaataaaacgtggtacatatacaccatggaatactatgcagccataaaaaggaacaagatcgccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaggaacaagatcatgtcttttgcagctatatggatgtagctggaagccattatcctcagcaaactaacgcaggaacagaaaaccaaacactgtatgttctcactagtaagtgggagctgaacagtgagaacacgtggacacagggaggggaacagcactcactggggcctgttgggggtgggcaggggaacggagagcattagggaaaagagctaatgcatgctgggcttaacacctgggtgatgggttgataggtgcagcaaaccatcatggcacacatttacctgtgttaacaaacctgtacatcctgtacatgtaccgaggaacttaaaataaataaataaataaataaataaaagttaaaaataagggccatgcattagctcctggttttgtttgtttgttttttgagacagagtctcactgtgtcgccaggctggagtgcagttgacgcaatctcagctcacttcaacctccacctcctgggttcaagcgattctcctgcctcagcctcccaagtagctgggactacaggcacccaccaccatgcccggctaatttttgtatttttagtagagacggggtttcaccatgttggtcaggatggtctcaatatcttgaccttgtgatctgcctgcctcggcctcccaaagtgctgggatttataggcgtgagccaccgcacctggcctcctgggttttaacatgagctcagcccagactgaatctcttagtctcaattctaggtcatgtggcaaagacactttgaggagcccatcctgggatgaaaaccatggccagggaagaggccacagcagagaggcagaggtgctgaaaccacttctgcaaccacaaggacgaaagtgcacctcattggtgagggagcgctggtgcctgcccccatgtgcacacagcagcccatagctaaggagtcacagagctcttacctcaatcctacctgatcagttcagccagaactgatctctcagccaagtctgtaccctggctagaatgtgatcttcaaaatgtgatcctaacctgttttgttcactcctatgaccccagcatccagaacaatgcttggcaccattggtaggcactcaaatactatacttggtacatcaaataacaaattaactcctccattctatgccttcttggaagggatacaggatggcagctggggagaggagagcacagaagaaagatgagaacaggatcttagaaaacttccctggggcatatttgtaggccctgacttacccagatccttggaacaggaattatggcttagggagcagtaggcaagccctgatcatggagcctggcagacccatttattccttcaacaaggatttatggaacacttaccagatgccaagtcctgctgtattctcagccttgccaggcctagctttcatacccttctggccctgtgatttctggctagctgttagcctctctctctgttcattcattggtaaatacatcacagggttcttgagaagattaaatgacataatatataaaatacttgcttgtgcatagtaactgtcctgtaaatatttttgctgcaaaacatggttgttgggttttctgttgttttgtggggggtggggagatggggcttaaggtacaactgtaactgtgtaatttaccactgtctggggttcctccagaagatggaattgatctgtataatcatcatttctcgtgcaagaatagccttgccttcacctggctgcttttatatgaaggaagtgctcttctttccataagagggcacagcttctggcgcagcagcaggaagctgtagatgcagcatgggttacttggggaataatcgggtttgcacagcaccacacaccttcctactcacatggggtgcccagggtgctggtgtcggcctggtcagagggcaggtgaagctaatggctgccatgcagtgaattcacggggctaccttgttctacttctctctacctcctccctcctggcttctggtcccaggtgtctcaagcacagttcagcgtctttgaatctccattcagggccatcccagtccctcaggttctctgatatgagagagaagatctcccaggcctccttcctccaagagaccccctctgtccccccccactctcccccagtttggcctcctaggcagacggtttttgtttgagtgtcatccctctcctccggacgccccatcattcaccttcagcatttaggaacacagcagcaatctaaaccaaatggagaaagcaggagaaatttttaaaagaaagaaaaaaaaggccaggtgcagtggctcacacctgtaatctcggcactttgggatgccaaagtgggtggattgcttgaggtcaggagtttgagaccagcctggccaacatggcgaaacccgtctctactaaaatacaaaaattagccaggcatggtggcaggcgcctgtaatcccagctactccagaagctgaggcaggagaatcgcttgaacctaggaggcggaggttgcagtgagccctgggatgaagccactgcactccagcctgggtaacagagcaagactctatctcaaaaaaaaaaaaaaaaaagaataaaaaagaacagataatttcaaaaggacattaagctctattcagagacacaatctccaatcaacaaaacgaaaggcaagcgttgccccacagggactggctgaaaggcagcctggcggtgagagcgttctggagctggcttctcacactggggagggcgccctcccagcaaccagccccacctgacgggatcaggcaggaccccaccccaggctacggggctttgggcttccctgctgaggagtttcctcccgacacagcttacaaaggctccctcacaggggtaacagcaggaccgtgcttggctgacagaatgctttggcagaaaactgctgtctgagtcagccctgagaaataattaaccctcatgatgtttcctggaggactgaagagggttgggtgtggaggatacagggagggcctgaagagctgggcttctgaaggggagggagcgcctgggccttcgggcctgggcctccagcagcctcacctgaggtgccaggaccccccagctagctcgcacctgctctctgggcctcaagattgttctcggggagggcagagagaagactcttacttttcttctttttttttttttttttttttgagacagggtctggctgtcacctaagctggagcatagtggtgcaatcatagctcactgcagcctcagcctcctgggttcaagtgatcctcccacctcagcctcccaagtagctgggactacacacacacaccaccatgtccagctaatttttgtactttttgtagagacagggtcttgccatattgcccaggctggtctcaaactcttgggctcaagtgatccgcctgcctcagcctctgaaagtgctgggattataggtgtgagccaccatgcctagccttttattttttatttatttttttgagacagtgtctcttatgttgcccaggctggagtgcagtagcatgaacatggctcaccacagcctcaatctcccaggctcaagctatcctcttgcctcagcctcccaaagcactgtgattacagtcatgagctgccacacccagctagtatttcttttcttttttctgtagagacaagttcttgctatgttgcccaggctggtctcgcactcctgggctcaagtgattcatccacctcagcctcccaaagtgctgggattataggcgtgagccaccggcaccctgcctgacccttacttttctagacactcttcctggaggcctgtttccattcggggcctttttgtaacatgtaagtcgggcagatcactatgcggagctgctcaccgtgtgctgctcagtgtggtaccaagagctcagagaagacacaagtaaaacataagatccagaccgggcctcagggaactcaccacctgagcagagaggggaggcatgaaaacccattcagttagatggcctctgctggtcatgtgttcatacatccagtgtgataggggaaaagagattttcttaagcctgagcagattactttacacatttagactgggggctcaaacacttgctaaggtaataatgttgcttgtgattcatatttgttcttccttcttttttttttgagacagagtttcgcttttgttgcccaggctggagcgcagtggtgcagtcgcggctcaccgcaacctctgcttcccgggttcaagcgattcccctggctcagactcccgagtatctgggattacaggcgcctgccaccacgcccagctaattttatattttcagtagagacagggtttctccatgttggtcaggctggtctcaaactcctgacctcaggtgatccgcctgcctcagcctcccatagtgctgggattacaggcatgagccaccgcgccgggctggttcttccttctaagaagcctccagagctccctgcctgtgtctttctgagagtcggtcagatgcccctctttcatttccctccattccaaggccaagatttctcatcctcatttcacaatcgggaaagtcaagacccatgccgcaggctggcctgccaggcaactggcccgaggtttacacacactcaaagatgcagccgaagatttgaaaatccccctggcacatccgtcttcatgcactgaatgtattcattgaggttttaattgttcagagcactcttggaagcggccgagtccaaagagaattggaggctggcagacacggtgctggggctttctctggatcgtattggtgagacaggatactgtggcatgctaacttagcagtcagcaaactgtttttgtaagggcccagatagtaaatagtcagtattttaggctttataggccaaatactgtctttgtcacattttcttctttgtttttggttgtttgtttttgagatggagtctcgctctgtcgcccaggctggagtacagtggtgccatctcagctcactgcaagctccacctcctgggttcacgccattctcctgcctcagcctcccgagtagctgggactacaggtgcccgccaccacgccctgctaattttttgtatttttagtagagacggcatttcaccgtgttagccagtatggtctcgatctcctgacctcgtgatccgcccacctcggcctcccaaagtgctgagattacaagtgtgggccaccgcgcctggtgtttttttgtttgttttttgttttttgtttttttaactatggtatagctgggcatggtggttggtgcctgtagtcccacctacttgggaggctgagatgggaggattgtttgagcacaggaattttaagctgcagtgagcaatgatcacaccactgtactctagcctggtcaacaaagtgagaccctgattctaaaacaaacaaaaaccaaaaaaagccaggctggatgcagtggctcacacctgtaatctcagcactttgggaggctgaggtgggcggatcactaggtcaagagatcgagaccatcctggtcgacatggtgaaactctgtctctactaaaaatataaaaattagctgggcatggggtcgcatgcctgtagtcccagctactcgggaggttgaggcaggagaatcgcttgaacccaggagacggaggttgcagtgagctgagattgtgtcaactgcactccagcctggtgacagagcaagactctgtctcggaaaaaaaaaaaaaaaaacagaccataccatggctagatttggcctgtgggcatagttggctgacccatctgctagatgaatagatacaagatccagatttggtaaaatgtaaacactttaatccaggacaaagcagtcttcatgcacatgagacagtactataatgcctctgttagactcctagctctgccacagactggctatacaatcctggacaagttacttaacctctccagccctcagttagcttgtcagtgaaactagaatgataattgaagctcccttatagagttactatgaagattaaatgagatagtgcacagaaagctcttggtacggtgtcaggcacatgggaagatcacagtaaatgttagcctctacatggatcaggaatgaaggaatcccgaggaagacaccatcaaggttgaagctgctggaactccaagatgaggttacattcaaatgtgttttctcaaccaggaaagcctctggaagcatgggggctgttaagagcagattgcacattgcttggtccccttgccctgggctcccgggtaggcagccagaaacccctgagcaaactggtattagctcaactgtttgaaccctgacaattcagcccgctgctccccctgccccttggcctggagcttccatgcagggagaggctgccacccaccagatagcgttcccaccaggcagaagtcagggtggccagatggtcaggaggggcagatgacaggggaagccacaagaaagagagcctgtggctagatcagaggtgctgaagccagccccagagcaggacagtcacctgctgtccacaaacatcctgctgagggaagttcttctttgccccgatgggtgtgatagttggcaacgtggctagaaacagactgacagctgtgctcaccctggctccttggcagacattggagaaatcaaggatagagatgaggattctgatactctcccctcaacactggaaatgaaaggaagcctcccagcccccaagtcctccccagtctgtcagcagcatttatggaaggcccactgtgtgcaaagcctgtacaatcaggagggagttaaatgggaaattgaggaccaggctccacatgcccatggagggctcgtgtggagcctaaacatgagactggctctcgaacacttgccaggcgaacaggatggagcctggatgtcccagccagctccaccactggcagcaactccttacagggtcactaggccctgactgaaagggcaccagctggccgggtagtgggtgggtatacatttggttttagagaaaaacaaccacagatccaatttcaaggctttgagtctcaccaacccctccttccagtcttttctgaatagcggcattaactgggaccccgaagaagggaggtgggaagcagacacccagcagggctctgcaggaatctccctgagccccacacccaggtcctgctgtctgcacaaggggcaatcatgactttcttctgtggcagggagacagtggaatctgtaggaggttccagacccagcgacgaccaagcctgggtggttctgacaccaagaacaaaacgcctgcaagatccacactgggaactcaaccaagaagaaagaaaagaacaaacaagatcaatttcttccccacaggagccagaattttcctaagtctctacgaatgttcagagacatctttatctcttgcaggaactctacctcctctcctgtctcacctcctcctgaaaaaagagacaaagtcccactcccatcaaaacacctctgaggtgtcagcttcaaatgatttatgaattacttctcccagcctgggttagcttcaaaactgggaatgggtcagggtgtcagcatgggaagaacctttaagaatgtcaggcttttagagcctcaaagccacaaatctctcaaatggtgccctctccaaccctgggcactaggtccgatgagcaggggatggaggcatatttggacaggggcctgcatctgagaccagcccctgataccaaaccaaatgtgtctcttgtatttttaactgcaagctcccaccaccctgagtgagtttttcccaaagcagtggtgtcacaagcagccattcagttggcctttgcagtcatgctgacccaggggtacttggtcttcatcggattctcagtctaagcatcaatcctctgacagagggacctaccccaggcacttccagctcagcagaaagcaccctgagctaataaaggaagatataatttagaggtcatgccccaaagccagctatttctgactgcagatccagctccaactaaagccaagccaaaaattaacattattttgcattttaaacaacttactagtctttcaaagggtactgattggtgaacagcaatttacaatgaagtaatcagttgcaaactaccaataattgctatcacttcaagtgtgagtttttcccctccccattttcttccccctgttctgtctctgtttttaaaccaacaaatatttatcaaccttcttttagacaaggtgtgagctaggagccatgagagataaaaagatgcggctgccaagtatttgcatgtgagatattcatagtctggctagggtagtaacatggtacacatggggaaaataaccaaatgtcaaaagactgataggtgatgaatgttgactctgtaaaagtgaaagttacatagaatgttcagggagcttgattttaagttgcctgagggttgtaaactactttccagtaaggtgttttcctctaccagtgcttcccaaacataaaagtctataaaatgatttttttttttttttttgagacagagtttcactcttgtcgcccaggctagagtgcaatggcacgatctcagctcactgcaacctctgcctcctgggttcaagcgattctcttgcctcagcctcccgaaatagctgggattacaggcacctgccaccatacccagctaatttttttgtatttttagtagagacggggtttcaccatattggccaggctggtctcgaactcctgaccctgtgatccgcccaccttggcctcccaaagtgctgggattacaggcgagagccactgcacccagcagttttttttgtttgtttgtttttatttttgttttttgagacagggtctcgttctgttgctcaggttgaagtgcagtggcacaatcttggctcactgcaacctccatcttctgggttcaagtgatcctccaaccgcagcttcttgagtagctggcaatataggcactcgccaccacacccagctaatttttgtattttttgtagagacggggtttcaccatgttgcccaggctggccttgaccttctgggctcaagtgatcctcctgcctcagccttctgaagtgctgggattacagacatgagacactgcactcatctataaaatgttgatacgagttctatgaaaaaaatgttctggccaggtgaggtggttcatgcctgtatttccagcactttgggaggccaaagcaggatagtggctggagcccaggagttgaatccaggagatcagcctgggcaacacagtaagactctctctacaaaaatgtaaaaaactagccaggtatggcggtacacacaggtggtcccagctacttgggaggctgagatgagacgatcacttgagcccagcaatttgaggcttgcagtgagccatgtttgtgccactacactccactgtactccagccagagtaaaaaaaaaaaaaaaaaaaagacagatttcttttctttcctttttttttttttttttttgaggcgagtctcactctgtcacccaggctggagtgaaatggcgcgatctcggctcattgcaggctccgcctccctgttcacgccagtctcctgcctcagcctcccaagtagctggaactacaggcgcctgccaccacgccctgctgcttttttgtatttttagtagaggcggggtttcaccgtgttagccaggatggtctcgatctcctgacctcatgatctgcccaccttggccttccaaagtgctgggattacaggtgtgagccaccgcacccggccaagaaaagcagatttctttatcacacaatgttgcagagcctccaagagccaaagtgcattgtgaatctgcacaagactatgaatgtatgcagcagattccagatttaaccatgaaatagcccctcctccatgccctttttctcataagcaatacaaattagcatctttctagaattgtagtcccagagagtctaaatagtctgcttagatggcaaaaaaaaaaaaagggtgctcaagcctcactttctccaacattttccccaaaagtccagcccatagtggatctcttttccttagattttcaaaagaactttggtatcgtcaatttagcacccaactcccgtctgtcttctgcttgtttatatagttccatgtcactcataccaccccagcttggtgcagaacatatagcaagtgctcactaacgacaaattacatagttattaaatatgctttttaaaatatttatttatttatttattttgagacggagtctagctctgtcacccaggctggagtacagtggcatgattttggctcactgccacctccacctcccaggttcaagtgattctcctgctttagcctccttagtagctgagattacaggcgcgcactaccatgcccggctaatttttgtattttagtagagagagggtttcaccatgttggtcaggctggtcttgaactcctgacctcaggtgatctgccctccttagcctcccaaagtactgggattacaggcatgagccaccacatggggcctaaatatggttcttatctgcttctttttttttctttttttgagatggagtcttgctctgtctcccaggctggagtgcagtggcgtaatctcggctcactgcaagctctgcctcctgggttcgcgccattctcctgcctcagcctcccgagtagctgggagtacaggcacctgccaccgcgcctggcttttttttttttttttttttttttttttttttgtatttttagtagagacagggtttcaccactttagccaggatggtctcaatctcctgacctcgtgatcccaaagtgctgggattacaggcgtgagccaacgcgcccggcttatctgcttcttatctcgggtaagagcagagcctggactctggagcccggagtgcagatactggctctggcttatcaactgtgcaactttgggaagttacttaacctctctgtttcgtcatttgtaccttagaatgttgctgtgagcgttaaactacagtgcccagcacacagtaacagtttaatagatgttagctgtttttattgctactcctaagtgtgttctacacctggtcaccaagcaaaggacagagcatggccagtgcatggagaatcagatttcaagggcagcccataacatgctcacaaaacacagggatattgtttgtttatctcttctaagatctcaaggcacttaaaagtctcaacttatcagttttcacaggactttcctgacataggttggaatccattatagtcaccctagggaggggttaatgacctgctcaaggttacttgccagggtcaaccacaggctaggaatagaaattggctctgcagtcacccctttgtcttagtaacttcctccctatgtggttttggcaaagacaaaacacccaggagtgatgcagcaactggaatgaaggtcaaagaacagcatctgggtttagcacggccttgatgaggccttttttcccttcatcctcccacaagcaggcttgtatatccagcagcctcctgtccctctttaagcacctcaaaatagtattccttgacctcctttcatccaggagatgccaaggagggcaacgcagatgcatccgagatgccaaagaaaggctttcacacacaaagtgactccctgcccttggatgtgtttgcatcctcacatccttctcatccctacgttcctactactgcagtcacaccagctcctaggctctgccttggacagaacccagtttcctggaaggaacaagttctctgcagtcggccccctgccccagcatccagggaccacattggccacagtcctatttacagcttccaaagcagtcaagtacagaaagccatgtaacaaagcgtctgagaagacctatcctggtgtgtgttttcaatcacccctctgccttccctctccagttactcagatctccttgctttcaaaatgagaacagtgaattatttatggagtaacatactgcactcagggtctcccatgatcacgcagattgtgaccgccctggggaatttactgcctaagtcattcggagagaatgggcaaatggggcataaggtggcaagtaagtgacagtgacataagttggggctccctggccctacgactggttgggagaagtggtatgaggaggtgacagaggacaaagggagagtctggtcttcctaaatccctggtggtagcgatatggaagcaggtgggaaaaatataatgaaaatataaaagaaacaatgaattcctgaccaagctgtcagataacctctgttgtcacaacacaggcctggagtgactactggggaaccaaaacgttcagctctctgcttatggtgagaagcatgcataggtagatgacggctagcagtctatccagggctgagaccccaagcctagggattctatccttcattacccacttattacctccagcaccactggccacttccttcttcttcttcttcaatttctttttttttttttttgagatggagtcttgctctgtcacccaggctggagtgcactggggcaatctcggctcactgcaacctctgccttctgggttcaagagattctcccacctcagcctctcaagtagctgggattataggcacccgccatcatgcctggtgaatttttgtatttttagtagagacgaggttttgccatgttggtcaggttggtctttaactcctgacctcaggtgatctgcccagctcggcctcccaaagtgctggaattacaggcgtgagccactgcgcctggcccagttccttttttcatacaaacgttttgctcattatttcacttgcagggcttcctgactgctctttattgctctttttgtagagaatatcaagaggtatctttccctgggtctctgacttctaacgtcttacaaaatatggcagaatagagaagagatatacacagtgctgattttacaagggaatgtgctagaatgttgtcctggaactatgttcttatgccaccctagaacaatgtttcaaaatctaatgtttaacactgatatttaatattcacatcaaataataaaagctgtttatttgcatttatatacattttaaatactttcctatataccttattttatcgaatttaagatagcaccaatataagtggtactttttacttttgtattccatcaagagaaacaaagcttcattggttgtaagatacaccctgatttcagagatattaaagtgggaaaaatgcacaccttagaatttatcaaaattatgctgaaaggaatctcattttcctcaagttcttgccataaatcagagaacaccaccctatgtctctccaagtctgatgtaaggcagcctcctttagagctgatatcacagaagaaaattaggagaaagaaaagcaaggggctagatgcggtggctcatgcctgtactcccagcactttgggaggccaaggcgggaggatcattgagcccaggagttcgaaaccagcctgggcaacaaagggagacccagtatctacaaaaaataaaaaaattagccaggtgtggtggcatgcgcctgtggtcccagctacacaggagggtgacgcaggaggatctcttgagcccaggaagttaaggctgtagtgagccatgtttgtgccactgcactccagcctgggtgacaaagcaagactgtctcaaaaaaaaaaaaaaataaaagaggaaaagagaaaggaaaggagaggagaggagagaagagaggagaagaggggaggggaggggagggcatgggagaggagaggaggaaaaagaaaagaaaagagaaaagcaaagcaaagcaaagcaaagggtgagatgggtttagtgtgcagatgtatgagatactttatgggtaaccgtgtctattcgtcacacctctgcttcctgggtctgctgaatctttcagctcattatcaatggagaggaatcagggcgaggttacagggagaggtgccgtagtccacacctgcagcagcacatggacggtgccatggaaatgcttccagcagtggtctgggcaaaggtttcacgcagaagagatttgacctgagtgtgaagggtgggaaggcaaaagcatctcgggatggaacaaatgcaagaagacaggaaaacaagcagcctgagggggcggtgatgactgcctctttagtgacagcggacagtgggcaacaaagctgggccagactttgaggttgtacacaaatggttaaggattttggaccatcttatgctggcagtgggccaccaaaagtttttcaagcgtgggaataattgatgcaaaacagtatttcaggggaaaaaaaaaacacaacagcatttcagaaaaaaatgaaaaccagaatttccagaagataaattggcagttctgtatatagtgaactcagtgagaagaggcaaaagttgaagggactaatgaaaataaaaactaccatttattgagtgtgctattgacagaaatagaattttttttttccttgagacagagtctggccccatcacccaggctggagtgcagtggcgtgatctctgctcactgcagcctgcacctcctgggctcaagtgagcctcagcctctccagtctcagcctcccaagtagctggggctagaggcatgcgccaccacacctggctaatttttgtatttttagtagatatggggtttcatcatgttggccaggctggtctcaaactcctggcctcaagttgcctgccctcctcagcctcccaaagtgctgggaatacagacatgttgccgtggctcctggccaagaaacagaaaattaaaaaaaagagctgttttgagatagcagtgttagagataatcaacttagatgataaatttgacaaaatagaagacatagccattaagtgggtggagatacagaaatgatgctgggaaaaaaaggatagaaaatcagatttaggaaccattttcatagaggtgaacttgagccgaggggttctaaagtcatgaaaaaagatgagatttagcctggtatggtggtgcacacctgctgttcccagctactagggagggtgaagtgagaagatgatgtgagcccagaagtttgaggttgcactgcataatgatcacgcccgtgaatagtcattgccctctagcccgagcaacatagcaaaaccccacctctaaaacaaaaaaagaacaggccaggtgcagtggctcatgcctgtaatcctagcactttgggaggccgaggcaggcagatcacctgagatcaagagttcgagaccaccctgactaatgtggtggaaccccatgtctaccaaaaatacaaaaattagccaggtgtggtggcatgagcctgttattccagctacttgggaggctgaggcagaagaattacttgaacccaggaggcagaggttgcagtgagctgagatcacgctactgcactccagcctgggccacagagcaagactccgttgcaaagaaaaaaaaaaaaaaaaagatgagatttagcaagaagaaactttaggacctcaattaagaacaaaatttttaattacaaaatatttcacatatgcagaatagtacagagaacaataatatataacactccatgcctaccacccagatattccaatgtcattcttttgatatatttgcttcagattcttttttatatttttttcctaaaggaacaacaaacattacagatacaattgaggccatctccattcccttctctccttcactacagatatgtactatccttctattgctctgtgacccttctaattatttttgtactcttatgacatagagagagccaaaatattatgctaggtgtaaattaggtatgggcttggtgcagtggctcacgcctataatcctagcactttggcaggccaaggcaggaagattgcttgagcccaggagttcgagacaagactgggcaacatggcgagaccctgtctctataaaaaaattaaaaattagccagatgtgggggtatccacctgcggtcccaactactctggagcctgaggtgggaggatggcttgagcccaggaggtcgaggctgcagtgagctatgttcacaccactacactccagcctgggcaacagagtgagaccctgtctcaaaaaaaaaaaaaatatgtacatgatatatgtccatattctttttaaatttacttttcttttattcaatattcatatattttagaaattcatccacaattatatatgtgtatatatacaggaatatgtgaagtacattcattttaacttctatatagtatgccattacattaatatgtcgtgaaatatttctccattttttctagttttagcttttataaacaatgttgtaatggacagccaagtgtatattccaagcatatgtgcacacttgcccaagagtttctgaggggtatagagtccacatttcttctctttcttttgagccagggtctcactctgtcacccagcctggagtacagtggcgccatcatgggtcactacagcctcaaccccccagctcaagtgatcctcacgcctcgggctccctagcagctggaactacaggcatgtgccaccgcatttcgccttgttgcccaggctggtctcaaactcctgagctcaagtgacctgcctgcctcggcctcccaaagtgctaggattacaggtgtgagctaccccacctggcctggatatacacatttctaacagataataccaaattggtttctaagtgcatgaattctactctacatctccatgaatacttatattgccagatttctaatttttgctaatccaacaggcataaattattgtcttgtcctctaatttgcattttttgatcaccactgagtgtggacattctcatttgggtcccttcttctaggaatgaaattgcttactgtaatctttgtccttagtttctatgaggttgagggtcttttttcttttctttcttttttttttcttttactgagttataggagttctttatgtattttggataggaatcttttgtcagttgcacatgttctaaatgtcttctcccagtctatggcttgtcttctaacacaatttactgtgcctttaggttttttttgttttcgtttttttgagacagagtcttgctctgttgcccaggctggagtgcagtggtgcgatctcagctcactgcaatccctcctgggttcaagcaattctcctgcctcagcctcccgagtagctgggactacaggtgcccgccgccatgcccagctaatttttgcatttttagtagagacagggtttcaccatgttggccaggctgttctcgaactcctgaccttgtgatctgcccatctcagcctcccaaagtgctgggattacaggcatgagtcaccacgccaggccaagtttttttaattatgaaaatgttcaattgctcacaaaagttgagaaaacaatatattgaaaccacattgtctgttaccgagactcaaaaagtaacaagattttgctatacttgccttatcgctctctttttctttcttacattactgctaacatattttaaagtaatcccagattgcatgtcatttcactcctacatacttcattaagcatctatacaactaaggacattttcttatatagtcactatgtgccaatcatgatgatttctatcaaaattaacaactattctttcatatcacctaatagatggtgatttgggatacctggaagtttttaatgaggctgcaatttttctgctgcaaaacacagatattgcattgcctggcctgggattacaattgctgtccttcctatgtgatgatgacccatgggtgattccactactgactgatcagcaggtccttcttcaggaagcaggaaggcttttctgcacctgggagacaggcgacgcctgcttcagtctataccactggcagctgcttacaaagcatatgaccacttaagtcattgtctctgacacttctgttggaaaatagccatccacctcagaggaggtggtctgtcggctgccgatagttcccaggaaccacactggtgcttccctctgaggtctggaaattcacacataaaagtcttcataacctttagggaagaggcagccagagaaactggattcaagtcaggatggtttgggggatgggctgaggttaatccctctaccgtgttctcagaatgaagaaaacagacatttactgagaaaaagaacagctctgaatacaaatactagaatagggcttttcaaatgtgtgccttctgtggctccctttatccagagaaaaagagtccatggatttctccccatactgcttaacgtggcaaaagaccccgaattgctggaattaatgggaagactagagcagctctggataagacaccagtgaggtaatgtctggtttttgttaaatatcccaaacagattactcactcttgctagataaaaggtaaagacactgtcgtgctattaacacaaatcctgctgcaaacagggcccccacgggtccctggactgggaagctgccatgctgttcagtggtgggggcgggagagagaggcagtcacagtaaacattgtccagagaagaaaaccagtcagctctgtgatctttgcaaactcctttttgttaaggaacccagaacaccaatgagaccctgggaggctcatatttgacagagccagaaagaaggtccttgggaaagatcccttctctctgtcttcagtagaacttggcagaactggacagccaggcccaaaggctccgctggctcctcttaccctcggggcctttgattctatacctggagcaattccttccatttacagcacctttttttttttttttttgagacaaactcttacaaagcccaggctggaatgcaatggcatgatctcagctcactgcaacctctgactcccaagttcaagtgattctcctgcctcagcctcctgagaagctgggattataggcccgcaccaccaagcccggctaatttttgtatttttagtagagatgggggtttcaccatgtcggccaggctggtcttgaactcctaatctcaggtgatccgcccacctcagcctcccaaagtgctgggattacaggcgtgagcccaccatgcttggcctttttttttttttttttttttttttttaattattttttgagacatggtctccctctgtggcccaggctggagtgcagtggcacgatcttggctcactgcaatctccacctcccaggttcaagcgattctcctgcctcagcctcctgagtagctgggattacaggcttgtgccaccacaggccagctaatttttgcagttttaatagagatggggtttaaccatattggccagactggtttcaaactgctgacctcaggtgatctgcctgcctcggcctcccaaagctgggattacaggcgtgagccactgcccccggccccatttaaagcactttacaaagaatttccacatgcattgtttcaactgctcctcataagagccttgtaagatgagctgagaatattgaggctcagattggttaagtcgtcaagcagggtcatggctgttttcctccatttattgagagttggataaaagtctccgaggtagttcccttctcaaccttagagtctagggttgtcagaggcctgggagaggctgagaagagagccagggaattggcagagcttccgttctgcaaacagacaaatggaacaccaggaaactggacctttttccccaaggattcttgcttttagccaagtcatcccacacactctctgactctgtggtagggtccttgaaatttcatctcacaatttcctggcagatatcagggcagcggatggtaatcccgttattgttggccagtctcccaaacaggcccaaatgctgcctgctcgtcctgttgcagacttcctcctcccctctaccattgcctggccagccggcctttaatcttggtggtgagctctgcaaccttgccaagaagtctcccagacaagtgaaagctccttgtgattgtgagaaaacagcaaggctggcatccccatcacacctgccatccccctcactcacttccatttataagcttgcactatatgcaggacctgcctttcagaagccctgagacacagtgaggctcacaggagctgggaactcagctccttcagacctggaaggacctgggtctgcgctgggaaatgtttgtgctcatcacgtcagatgcatcatccatgaacttttcctctgaaaagctcagcacatctcactatgattcttgctgctcccagttcctctttctaaaggaaatcaccagcctcctctggtacctcaaagctttagtaatcaggaactaaataacatggaaaacatggagaatcgcatggaggcaaaacagtaccacagctgtacctactatttataatgaaagtcagcccagagtgcctgcctttttcatcatctctcagttatccacatgctcaacctgggggacaggaggaacagggagaaaatcatgattatcctgtggttcactttacagtttacaatgcatttttaaaatttacatacacttggccgggcacggtggctcacgcctgtagtcccagcattttaggaggctgaggcgggtggatcactaggtcaggagatcgagaccataccagctaacacggtgaaaccccatctctactaaaaatacgaaaaaattagccgggcgtggtggcaggtgcttacagtcccagctactcaggaggctgaggcaggagaatggtgtgaacccgggaggtggagctcgcagtgagccaagatcacgccactgcactccagcctgggcaacagagtgagactccatctcaaaaaaaaaaaaatttacatacacttaaaatatgttatttctctcaattctcagaataaaaccatatggtacataatagatacaaattttggtttctctcttttttcccaatgaggttggaaaggaagatattactatttctaccttaccaaggagcaaatcaaggttgtaattattcaaaatcaaataaatatattgtagtggactctaaactcaaattcagctttcctggttataaatgccagaatcccagattcctgggatttctatacgaccccttccttcctcttaagtcctttgctccctgtggagctgtagctttgttttgttttattttattttagagacagggtctcactctgtgagaccagtacacagcatgatcctggctcactgcagcctctacctgccaggctcaagcaattctcccacctcaacctcccgaagaactgagaccacaggtgtgtgccaccatgcctggctaattattttattttattattatttttgagatggagtcatgctctgttgcccaggctggagtgcagtggcgcaatctcggctcactgcaggctccgcctcccgggttcacgccattctcctgcctcagtctccctagtagctgggactacagacgcccgccaccacgcccggctaattttttgtatttttagtagagatggggtttcaccgtgttagccaggatggtcttgatctcctgacctcgtggtccgcccacctcagcctcccaaagtgctgggattataggcatgagccactgcgcccagcttattattttattttttgtagagacagggtctcgttatgttgcccaggctggtctcgaactcctgggctcaagcaatcctcccacattagcctctcaaagtgttaagattacaggtgtgatccaccacgccaaggcaattttactttattgagacagttctcgctattgaccatgttggagtccagtggtacaatcacagctcattgcagcctctatttcctgggcttaaacgatcctcccacctcaacctcccaaatagctaggactacaggcaaatgccaccatgtcaggttaatttttattttttgtaaagatggggtcttgctatgttgcccaggctggtctcaaactcctgggctcaagcagtcctcctgcttcagcctcctaaagtgctgggattataggcatgagccactgtgcctggcctatagctttaaaaatttccccagtgtataccatcctcactattcccaggcacagttctaagtaattgaagtctactgaggtaggtatcaatattattcccattctctagatgacgaaactggtgcatgtagcagttaggaaatatgcccaaaggtacactgctcgtaagcggcagagcaggaatatgaatccagccagtctggttccggagtctgcattcttgatcactgcactataccaactttcactttgttgtgagcacctgcctatctcagacatcagtcagtaagtcccttgaaggcaagaactgtcctttgatccttattcctgagccctaggcattacatttggcacagagtatatgctcaataaccatctattcatgcatctgaacaaatgcatggataactggtcaggaggggacgccagcagaaaggccacctgtttaaacctaaaatcgcagaactcaaactggtcctccattctttcttctgcttttctctaagatattacatagccacaaaagcagattcttgattccaatctagtccatcctttcatagactttgagtgatcagccctccctaaggcagtgcccctctcaaggacccaatgcagagctgctggggaccccgcccgaggtccatctttaggctcccagggctacacttctgtgtcagggtttaggtcagcaggattcacacagaaactggaaatcagacccatggacggcatctacggtgaagtggaatcaaacggtaagggcttcccagaacatccgagtgaatcagctgctcaggctgggacgaatccagaacacatgcccacaaggggtggcaagttgtaaattgagatctaatatgagccatctggtctggcaaaatggccaactggagagatgggagcctggaaactgcccagaagcaaacttatcttggggaaatgatgagtcagctctgtccaaaaacaaaagcctttaatgaagtccttcacagtaagccccacagaatctttctggagcagctagagttaagtaactccatctaaaggttacctctggtttcaaagttttcagatgcctggttccaggcttgggtgtaacagagcatgaacacaggcgaggtaaacccacactgctttgtgggggtgggatgggattcaagaatcatttcacagccagatagatgtgtcaggtaagatgtgacgagacatgcaggactagctggggtccagcatttccccctagcatggggacagtttagccttggtcctggaggacagcttttcagtgtcttctcccagccacagtcgctaaaaagcaaccaattaccaggtctaattatcttccttcagcctctttactggcagcagctgccaaggctcttgccaaaactctgcttcaccaacatcctgatccaaaaagccccaagtcaacgaggagaaggctctgcgggcccagaacagctgtgaggcttcccaacaccaagacggggcacaagaggtcagcgccgggagcttcaaagcaacttgcccccttgagcccccttggcctcagcatctggatggaggagaagcagtggcgccagccacctggaaccacaccagaaaatgacacaacggcaatcaacacactggccccaaccacccccgccccaggaagttaggaagctttttaaaggccttgtttgtgcttgtggtggaagctccaaggtcagggctggcctagagctcagtgtgtgcctcacagctgagcgtagctgggaggtatgtcaggaattctctaggtcggggctgggggtctctcagggcaccatgccactgctgatccctacttccttgcactccaaagtagcttgcctacttctgcccacaggtgagcctgagacctgattagcctcttcctgcacggaacaagaggtagcttcctcctgaaagatgtcctgagtcgcagaagcattctctgacttgcacaagaatgagtctccaaaaccccagtcacctggggggcctggacttgtctgagcagggagtggggaaaaccaggcggccatccactcggcctccaaccttgcagccccaggggaagaagggccaggtgcagtttgctgggcagttatgaaacttgagaagctggagtgactttgggctggtgctttgagaacagggaggtattgtgtgatgaggcgcagagcgggtatagaatacccaacagttcatgcacaaacacgatcccagccttgtgcagagaaaggggcttccaggggcctgggtggtttcaaactggaatgtgaggagaaaggtagtgcccatgaggctgttggtgacccatacccaggaggaggcccagaagccaagccagccctcacccctacgcacagacagttccacagatctcaacacgtatgccctgagacatcatctctggggatacagaaattctatccgtcagcaattaaagaatattttcttaaaacttgggtgggtatcttccccatgtgttgtcatcttggtcatcagtaaatacccactgagcaggactatctgcatggtcctgtcagaggtattatggtcacaaaggccagtgcctgccctcccgggccctgcgtcctgacgacagggcaccaatcgtaagaggcagcaaaatagctggagattgagcaaccagacacaccagccttgcaactggtcaaacaagagatgcagtgcacctcatctgtgcactacaaacaaaagctttacatgttttacaatttttctctctcacagtggctggaaagctggatgaggtgagaagagaataagagcaaagcagagaaattgggtagagaaagtgataatggagtgataagccaggggagctgggaacagtggctctcaggtctgagtcgagaaggatccaggacagacacctaattggttatgatttcaccccccctctctgggcttatcttctccatctgtcctcccacagttcccagctcagggcgctgagctctgatagttctcaaacccttttctccctttacttactgcgagaaagctgtggttatcagcatgctggctcttgcagccccaggtgccacactaagctcctaggccagtccctaaccctgttgcctctaaaaaaaattaagtcgagacagggaggtgggaggaccttccacaccatgttccagtcctcactgcccactccagtgccttctttctcaaacggtcatctcagacatctctgccatattcccacccccaacttccccctggagaagggctgcatctgcttcctaaaagcttgtcttctgggccttttctcatgcccaccttgtatctgaaagcctgaccattccatcagtcatcatctgacctttatttcccaaatccagctcctctctgcagctttccctaattgccacccccaattaaccagtcccaatgaacctgagcagaggctcagcagaattttgggactcgatcgtaaacacagcttattatagctagtggtatatgcagacattaccttattcatgttgtgtcctccccacaacctccacaaaacccaagtgagcctttgcgccatgttggactgcatgactgatgacatgacagctgtgatcaatcaagattccgcaatcaccattctgcaggccactgggagcttttctacaccaaagccctctgctgagtggagatgtcatctgatttattaattaatgcaaacactgttcatccaaatgctccagggcatggtttaaaaaaaaaacagaacgtttaaaaaatgataaaaataacttttgccagcatagaaatagctgaagttttcttgttgttgttgtttttgttttgagacagagtttcgctcttgttgcccaggttggagtgcaatggcacaatctcagctcactgcaacctccacctcccaggttcaagcaattctcctgcctcagcctcccgagtagctgggattacaggtgcgtgccactacacccggctaattttttgtatttttagtagagatgggggtttcttcatgttggtcaggctggtcttgaactcctgacctcaggtaatctgcccgcttcggcctcccgaagtgctgggaatacaggcgtgagccaccacgccagcctagctgaagttttattcctggccctttcatcccagcagcaattcttccctccccagccccatcacacccctcttccccctgcagcacccccacccaggtcgctgtccccctttcccaccttccctaccgtgcttctttgtcaattaacagaattcctgccgctgtttgctaattgggttaatggagtgactgcataattgttctctctctcttcacagcccaactcactatactggctgctttccgacaacctacctctcagctgttccaggatcactaatttgcaacaacagcttccattgtcgtccacatctgggacttcgggattttaagtgaatctctctaaggcggagaacagaagatgctgctattttggtttgtctggtctacaatggggccattctgcggagtttctgttcagtgcggggctgcccgggtgaaggggaaattggagcggtgatgggattcagccagagagctgcatgctgaggactagggagggaggggaggaggggaaggggatgggaggaggtgggaggtgggggcaaaatcttgaccttttcttcccagccatatgggtttgcatttcattttaatcagtttcagatgaaactgacaagccaggaacctcaggaatctcagtgcccccacctttggcctctggtctctagaacagccagcagctgaggttggacagggtgtgacctggcctgacccagcttcccccagaggaggcagcattgagggtggcctttgcgatacccaaggttccatctgagcctgttttctctcaacgtccttgggaaaaaaaaccaagattttttttcctctgttgttttttgaaggtgtttgttcggcttgaaatctgtttcacctaaaagggatcattacctacccaaagtatagaaatgatcacattcttggagtggggtgcaactggggcagtgacagaagcctccaggaactctgagatgtccctgggggatgccttagtaggtaggggtggcatgagggtgctagtacagtctttggtctagaggtcccttgagcccccttggaggggctatatttcttaggttgacttctttttttttttttttcctagatggagtcttgctgtgtcacccaggctggaatacagtggtgtgatcacagctcactgcaacctctgccccccaagttcaagcaattttcgtgcctcagcctcccaagagtagctgggattacaggtgcacgccaccacacctggctaagttttgtatttttagtagagacggggtttcaccatgtttgtcaggctggtcttgaactcctggcctcaagtgatccacccacctaggcctcccaagtgctgggattacaggtgtgagccaccatgcccaaccttcttaggttgacttctatccctgccttctttgcccttccctccccactgttctcagccccggcccccaccccagctgcaatccttgctccagggcttctgatcggaatcccctagggagtgctgaatgtgggtccctaggggtcagctctgggctgctcccacacatacacaaggaagaacatttttcggcatttcatacagtgacactttatattgttctatcttgtaattggtttacttcctgatttccccaaacagctatgagggtaggaaatggtcaggcctctctgaaaccccagtgtactgtgccctgttatggtaggtgcttcatccatgcttatttctgccttcagttttgattatttgtaaacttgcctaatccctgcaccctcccctgctttcattacttgtaagcttcttgtgcatatctttgtagtcattgtagcacccctggtagggtgacaggcccggattaggtgctcagtaaggaattaataaattaaactggattggagattcctggtaatcaaatgagagcccttgtgaaaggaagtgttgagattgagcaaaaggtaaacaagtccaccaacatgatttcagctaagctgggtgtatgtactgatgtactgaatgggcgaccatttccttccagaaaggctggagtcagccctccgggatggctgtctctgtgtgactgtctgcacaccactgccctccactggacactgaatcaaagctgccccagacccacgttggtgtcaggactccctcaggtttccttccctccctatctgggacacaacctcctgggcaaaccggtttcttggttggcttctcttaccaggtttgttttaccctgtctgccttgcattgaatccatgaaacttgggaagtacaagaggaacaatgtcttctttcactcctggcatatagcggggtcaataaatatttaataagtgaaaataaacatgacacacattcctggcaagccagcagcacttcggactagtactatgattattaatataagaatccatttaaggacctatatatgttcttagtctaaagcagctacagtgctgattgtttttagaagacaactgaggaaaacaaagaggcaccaaaacttaagcaaaagaaagagttcaaaaacagtcactcctctttatcttaacaaccaccaaactttcctcctcttgcatgcctccgcagacctttgggaagatacagaacaggatgtaaagggaggggaagtgaacacaggtactgccaagcctcagggattagactgctccctccctcgctttgacgcgctctccagcttcagctattggcatttgtgaacttgccttattatctctgcccctgacctcactagcttgtaaattgccttgcccagcacaatgactggcctataaaaggtctgccatacacagttaactgaattctggtggttgaatatgcatgttactaataatttgccaacagtaataataaaataggttgtttttttttaaagagacatcacatttacagcttagaaattttgatttggtgagaaattgttttcaccttccacaattcaactctggggttagctgtggacctggtaggcagtgggatatatgaatctgaagctcagggaagaagcctggacgaagtaggaatccaggagcctcatagcatggaggttggggttaaaactcaaagggtattgtccaggaagaactagagaaggtgaaaaccagaggctggtgtcttgggatcccaatcctgaagaaccaggggaggcagaggaggtcaggacagagccagagcagaagtcagagaggagcgagaaagaatggggccaaaaaagccaggggtctgggaagttttcgggattagagggtggccagtggcctcaaatacagctgaataatctagtcacaaaggattgagagatgtctgctggagtgggtaatataatagtcagctggtgaacccatgaaagcaactttggggtgagagggtagatacagtggaaatgggatgggaaatgggatcagaaatgggatcaggaatgggaggcaaagacatgaacacaatcgcgggaggtggtgaacataaggaaaagtgcaagggcttttggttttgaccctgcacccaggctctgctttaccgatctagcttctgtatttctactagttacactttctaaaaatcaaaattaatcctgtcacttccggttatgattaacatccactggcttttgccatttgctggacaatccggagcaaagtctggggccaatctgtttagtgtcacttatttttcaggtttggtttcttcatcacctgtaaaggagagtggcacaggactataatcccttgtccgaaatccttgaggccacccgtatttcagaattcacagccttttggatcctagaaaggtgatacagtgcacatgtggtatattacataataccaccagcagggtctgtgccccaccctggaaccaaacacaccaagtgaaacaaataaagactaagcaaccttacttgaggtcaggtcattttctactaatggagttaccaagatacttttgttttccagagcttttcagatttttggaattgtaataaggctcactgaccaccctggcagagttgtttgaaagctcaaataagatatgtgtgtgaaaatgaagcagaaaggataaccacaaagggtacagaggccctgatcttcttgactgggaatgaaaggaatttttccttttctgacattgtgcatgtgtgagcaatttataaaggacactctctgatagcctttcagaagccacagcaggaaaggaataacctagtttaaaggatgcatccagcagccataaaaaaaaaaaaagaatgaaatcatgtcctttgtagcaacatggatagagctgaaggccattatcctgtcaacgaacgtagaaacagaaaaccagatacagcatgctctcacttataagtgggagctaaacaatgggcactcatgtggcttggctctgtgtccccacccaaatctcatgttgaactctaattcccagtgttgggggagggacctggtgggaggtgattggatcatgggggtggatttcccccttgctgttcttgtgatagtgagtgagttctcacaagatctagttgtttaaaattgtgtagcacttcccccttctctctctctctctcctgctgccacgtgaagaagtgctggcttccaagcacttgatttggcccttctgccaggattgttaagtttcctgaggcctccccagtcatgcctcctgtacagcctgcagaactgtgagttcaattaaacctcttttcttcataaattacccagtctcaggtagttctttataacagtatgagaatggacgaatacgggtacacatcaacataaagatggaaataatggacactggtgactccaaaagggggagggtgggaagatggaaagggttaaaaaggtaccaattgggtacaatgctcactatttgggtgatgggtacactagaaacctaatgcccaccagtatgcaatatacccatgtaacaaacatgcacatgtacccccgaacctaaaattaaatttttaaaaaaagaatgcatcctagtgtgactggggacatttgcataatcaagggcaattcccataacttcttccttatcttgatttctctgcctctgtaggggctgaggctgggctaagcttggagatgctggaactcacagtgatggggaccctcacaatggagatctgttctttactgtcattctctccataactgtgagctctatgaggcagggactgggcctgtcttgttcactgctgggtctctaatgcctagcccagctcctggtgtttgtccagggtggacacttgttttactttttgctgaattgaattgaaactgatctcttatgttccttgtgacagaaggcaaagttggcattgtcttaacttccattgttttcatcttcagggaaaaacccctacacctgggggtcattctgcccaactctgccctctctgcctctgctcattgctctttatagcttccctcaacacacacacacacacacacacacacacacacgtgtctcattaaatgaggatttgggtccctggctcatagccttctccttcatcttattccttttcttactcatagaagactttgactttgtgtggacaacccaactataaatccagcctcaccagggactattgctactctaaaatgttaaaccccaatatccaatctgactaaaacttatttcctgctatattgaattcagatttcctttaatcctggttccttaacttctctcttttgactcaattaattaccagctatctagcatggatcccataatttatcatttcaatcattctcttgccagtaccacctacaacattcttgaccctttgttcttcttcctcatgtaccctataaatccctaatatctgtcttttccagtccaaaatccaagcttctgggtgttgctggagacagaccctaattggggctattcccagatatgatctccagtttcagctttttactctacttgacatattgcttttgagtttctttttttgttgttgttgttgttgttgttttagagacagagtcttgctctgttgcccaggctggagtgcagtgatatgcgatcttggctcactacatcctccatctcctgggttcaagagattctcctacctcagcctcccgagtagagtagctgggattacaggcacccacgaccaagcccaactaatttttttatttttagtagagatggggtttcacgatgttgaccagggtggtcttgaactcctgacttcaagtgatctgcccacctcagcctcccagagtgctgggattgcaggtgtgcaccaccgcttcccacctgtttttttctaataggcttccttattcatttctcacaatggcttttccaaaccttctcctcaaggatccaaacccatccttgcttcctcaaagatccaaaaccacccttcctatttacgaaggtggtctcctgtcttaggtgacaagaaaatgtaccttcttgccctcgtatctacatgctcacctataccctcacccgacttttccctcctcctcaccccatcaaaggcaataatgcacctgtttttattcatctgggcctttggtcttccccttcatatttcccgagacctcgctttcttctttctcttgtattttttatttttctatctcttatgtgtccttctctaaaagttataaacatgcacaaaatctttccatctcaaaatataataccctttacctggtgtcccctgcaggccatcttctttatttatttacttttgcgccagcgtcttcctctgaagcccaggctgggtgcgtagcgcgatcatggctcactgcagcctcggactcccgggctcaagcgatcctcctgcttggaggatcagattttttatccttgcagaagtgataatatggcttcttcctcatctcctaaacaccagtcatctgacatacactgcagatctaaaatgggcctacgtgttctgcccttccttgcctacctgttgagcttgcaccgcttctgtgagtctccccccacccacaagagatccttcttccttcgcgctccactaacccgacataaatgtttatcatataaagttttccgttgcactcttgtgtttatgtctcctggcttcttcaccaagctgtgtgacagctgggccctgtcgcctccttcctcgtatatgcagcgactatcgcagagccgcttaatctttgttgaaggcagctgcggttcagccctgagggccacgggacggacgccactcattcagccctaccgggggcgctgtggcagccggcattggttgccgtgccctccgcttgtctcgctcagctctcgagccacacgccctgggctccgcccactccctgacaacatccctcctgcccattgggcgagcatggacggggctgtccaatggagcgaggcgttggtgcgaggaggcgccgccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggtaaatcgctggcggggccgctgctttgggccccagcccaggatgtcttcccgccatccactcggcccctggagcttccccagcgctcccaggaggtgctgggaatgaacacaaatggaccctgccaagttaatgttctgctctctcgtccccttcttccctgatctagcggcccagtgaggccctgaagctggcaacagccaggttcatctcagccctaaacatttctgcaatcgatcttcccgccccagtccctcagcttcctttatggcttcggttgttttacgagtccctgaagccagggctcctccccctgcagcttcctgtcctttgtcttggttcacttttcctgtaccgcctaggcggtaagggtacctcatgtatataaaactgatgatgttttttctactaccgctcagacattcttgaaagattccaatttggaagcatctgtaccccccagaatattggttcttagtattttgggagtcacaggctttgggaccataagaataatatttgcacctttcctcagaaaaatggtataagtaaatgtataagtaaatgtttgcaaacaattttaagggattcatggacctctgaaatacattcttagcccccacaaaaattataatggaggtggatgtcagaggttagctcattattaaaaagcaaaggagtccaagtgatgggagtttagcattcgggtcttacttttcgtctcttgaggttttggttattttattgtcatgtctaagaattatttgaagcatcttcgtgttaattaaaagttctgcttctttttagaactcagcatattgaagggattttatactgaaaacctcagacctggttatgtatgatgcttcttttgttttgtgtttgttgtaactcagttatctcttttatgctgcattcatttcccactctcgtgttactgaccccaagttaaattaggttctgtgggagacacaaaggtgaatgagattccgttcaacccttaaggagctggtattattggagggtattatagatccagtgtattgtgactgtatccctcggagaagaaagaaaattaaaagcagataaaatctcggaaaaccggggctcaggatctttttttttttttttcaatagttttattttttttgagacgaaatctcgcactgtcgcccggactggagtgcaatggctcaatctcagctcgctgcaacctccacttcctgggttcaaacggttctcctgcctcagcttcccgagtagctaggtttacaggcgcctgccaccacacctggctaattttttgtatttttaatagaggcggggtttcaccatcttggccaggctggtctggaactcctgacctcgtgatccacccgcgttggcctcccaaagtgttgggattacaggtgtgagccactgcgcccagcccagggctcaggatttactgtgtgaaactattgatgatcattaagtaatatgaattatgttttaagtgtatgcagtgagctggtaacctgtaactccaatgccacatacagtttatagtgcatataagtttaaagtgtgcagcaagaaatgttgataattatgattaaaaatagtattagacccacagaaagacctagctaagtaacaagctgtaaaacatacttctattttttacaataaaatgatacaataataaatgatggaaattgtattttttaaattgagtaatttgtttataacactggtgacttctggttgcttcatttggttagcttcccttgttggcagggtcatttgtttcttcattcagacaatgctactctgagaccacacaggacttttatccagaagtacccacagtataaactaaaaatacttgagacaacagtaaagaatatataaattcacatcaagagtaactgtactgtaagaatgtgatggcagtggtagggaaaatgaaaataattagagcatcactgtgagcaaagcatgtctagaatagacaagaaagagaatatttcacctcttacccagtcagaaaattgcagttggcacaggctggagtgcagtggcacaaatcacagttcgctgcaccattgaactgggctcgagtgatcctcccacctcagcctcctgagtagctgagactacagacatgccaccatgcctgcctaattttttttttttttttttttttttttaaagacggggctcttgctttgttgcccaggttggtcttaaatccttgcctcaggtgattctcctgcctcagcttcccaagtagctgggattacagacacaagccatggcgcctggcttgactgatatgttgagaggggagaggatgagtgtagaggaagagcttaacagttttttttgtttgtttgttttccaagatggagttttgttcttgttgcccaggctggagggcagtggcgccatcttggctcactgcaacctccgcctctacgtgacaggcattttacatatgtttatatgttacaggcatttaatatatatttatgtgtgtttacatagatttatacataatatatgaacaattacagcaacccatcaaagtatataaatgaatgattttatatctgttaagtgatatacctagtttcttgagagattaagatgaaatttggacccagatctttgaaccccaagtccattctctttctgctagggctaaagaacaaattttgtcaggtctctggaatctgttttccaaaattctctgtcttctctccgcaacacatttaacctgttgattatacccagtatctttttaccactctgtcttgtattgctgtaattgaagatggcattaccactggattatgtaataacctctttgttggtctgtcagcctttttagttccttaacactcttgccacaactgtctaaaaaacaaaagttgaattcttcatctcctgcttaaaaactggctctttgataactggatatagtcccaactcccagtcacagtctgacccatctccagtctttctggctttgtctcaccattttcatgatcttcagctctagtctcatgaagctaccggattgtatccttgttcagaatgatttttagcctttcttctgccttcttctataaggttaaaacaaaaaaagcatttcaaagccacctccttttttagactttcctttttcccagtctaagttacttgttttctctctttagcattttatctgtatatccctttataggacttaattcattctgtccttgtgttttggttatttttggtaaagaaccttgatttttctttctttatggcatctgacatggtgacttggcaccctctaaattaccaaatggacccttttataaacacgattggccttttttcttttctttttctttttttttttttttttttttgagacagagttttgcttttgttgtccaggctggagtgcagtggtgcaatctcagctcactgcaacctccgcctcccgagttcaagcgattctcctgcctcagcctcccgagtagctgggattacagacacccaccaccatgcccagctaatttttgtatttttagtagagacggggtttcaccatgttggccagactggtctcgaactcctgacctcgtgagtgaactcctgccctcccaaagtgctgggattataggcatgagccactgcacccagccatgattggccttttaactctcatttctcctaaatgaaaccagtgagtgttcctttaactgagagttaaaacttcacatagttgtcatgcttagtatatttttaagtgtttcgtttctagagaactgaatttttaaaatgtgtaaaactgaatttactagataaataaatagaatcaggtattctaaagataattaacctagttactactatttatacctgcttaaatgcttgatgagttccctttcctccttcactcagacaaatcgcatatagtgatgtaacttttttttttcagtctcaggaatgcaaagaccgtaatggggaaagctgtaggttgcagttccattagccctttttatttagtttccagaattgtcttgaggcctctggtgctagattgtaaccattttaaaattatgtttctgttctggcttgtagataagtagcagtttttattttattttattttatttatttattttttttgaaatggagtctcgctctgtccccaggctggagtgcaatggtgcgatctcggctcactgcaagctccacctccctggttcacaccattctcttgcctcagcctcccgattagctgggactgcaggcactcatcaccacgcccggctaattttttgtattttttagtagagacggggtttcaccgtgttagccaggatggtctcaatctcctgactttatgatccacccgccttggcctcccaaagtgctgagattacaggcgtgagccaccgcgcctggccgatacttagcagtttttaaaacagctagctaaacaagagttactgatactggttagggaaaaactgcgatacactgtgcttgaatccatcactgaaaaaaaataatgttcgtggaagtgttcttgggagatgtcttataggaatatgctaatatctaaatgccttggcaatctgtagaatattgaacataaagtattgtgtaacatggaacttcagtataggagttattctggtttttggaaaagttgttggtggagacttcaaggcagaattctgcttttatgtaataatgcgttatgttctaccttcgtgataaagacctgattttgctgaatattttagtctgaatctgcttgctaagatttgtggaaaaatggaaagtgtgagttgcactgacctgcagcactgtttgctaatgaatggatttggactttttaactagccatttctgctaaatgttttcctccctttcctgtcattcctctgtggctaggtgtgttggtgtatattcttattggcaagaaatgccaccttataagtctcacagacattccctgaatgtggatgtgttttgagaatgttcagtacatctcttcaaactggctgcaaataaaatatccaactttttaagtcttaaataaatggtagcaaaggaatgaactaaaatagctgattttttttttaacttcatttcggtttagtttatagtaaaaatgcctttagatgtttgggggtatttattctaaaaggatccttttcagcctacctgaagactaaattatttataagaaatgtcatttgtcttcactgtttctaaatatgtatttttgtttcaggcacgtgtggttctcaaatataggcattctgatgggaacttgtgtgttaaagtaacagatgatttagttgtaagtatacatttttatttgttacatactttcagatttgtttgagttaattatttgtttgaaattatttacttagagtttatggagattacccattaggatgcttattttgcatttcatttaaagatgaagaacctcattctagcagctacttttatagaccctcaggaaattatttaacctgctttcttaatgcattatgtcaagtgtctttaataagtgctgtcttcagaccttaagcaacagaaatgtagagaccaaattggatgtaagggagtaaaagtttcctttaaatgacagtgtttgaacacaacttacaggctttattgtatttcctgtctttgatatgctcattcttgttacttcctcatatcccattcattccttaaccctctgccatttgttttctgcatatggtactccagcgaaactgctctttgtgagagcacatcagcagctcctttcttttcaaacccagtggtcttattattcatatgttatttgacctccttgctgcttttgatacagaagcccactctttcatagaaataattattttggcacttgtggttctgttttatcttggccttactattctgtgtttctgttgtttcattcttctttgctgattgttttttttttgatgtgccccatatatatgtgcttctctaggattctgtccttgattgtcttttcataacagcttctggagcagttcatttaactgagtctaatactgcatctgtctatgtctacttgcaaatgtgtgtttagttcatattcttctgactttctgactagcatctgtatctcacataccctcaaaattcacttatctacagtggagtttatcacctgttctttttttttttttttttttttttttttttttttttgagacggagtcttgctctgtcgcccaggctggagtgcagtggtgtgatctcggctcactgcaagctctgcctcccgggttcatgccattcttctgcctcagcctcccgagtagctgggactacaggcacccaccaccacgcccagctaatttttttttgtatttttagtagagacagggtttcaccatgttggccaggatgatctggatctcctgacctcgtgatccacccgtctcggcctccgaaaatggtgggattacaggcatgaaccaccccacccggcctatcatctgttcttaaactagctctttctcatgcctgtaatcccagcattttggaaggtcaagtgggcagatcacaaggtcaggagatcgagaccatcctggctaacacggtgaaaccccatctctactaaaaatacaaaaaaattagccaggcatggtggcgggcacctgtagtcccagctactcaggaggctgaggcaggagaatggcataaacctgggaggtggagcttgcagtgagcagagatcgtgccactgcactccagcctgggtgacacagcaagactccatctcaaaaaaacaaacaaaaaaactagctgcttcttctgttcctaccttcctacctttagttgcattattttccacgtggtcagaaatctggggattttttttaattaaaaaaatttttttagagacaggatatcgctatgttgcccaggctggtcttgaactcctggcttcaagcagtcctcccactcagcctcccaagttgctgggattacacacatgggccacagtgcacagcccagagtgatttctatttagacggagtctcgctctgttgcaaggctggagtgcagtgggcgatctctgctcactgcagcctccacctcctgggttcaagtgattctcctgcctcagcctcctgagtagctgggactacagccgtgcaccaccacgcccaactaattttttttttttttttttttagtagagacggggttttcaccatgttgaccaggatggtctccatctctttacctcatgatccacccaccttggcctctgaaagtgctgagattacaggggtgagccactgcgcctggccttttctttttatttgtttgtttgtttgatggagtctcgctctgtcgcccaggctggagtgcagtggcgcaatctcggctcactgcaaactgcctcctgggttcacgccattctcctgcctcagcctcctgagtagctgggactacaggcgcccgccaccacgcctggctaattttgtgtatttttagtagagacggggtttcaccctgttagccaggatggtctcgaactcctgacctcgtgatctgcccgccttggcctcccaaagtgttgggattataggcgtgagccactgtgcctggacttttttttttttttttttttaaagaaggagtctggctctattacccagactggagtgcaatggttcattcttggctcactgcaacctctgccttccgggttcaagcaattctcctgcctcggcctcccaagtaggtgggattacaggtgggcaccaccacacccagctaatttttgtatttttagtagagatgagatttcaccatgtcgcccaggcggctggagttgaactcctgacctcaagcgatccacccacctcggcctcccaaagtgctgggattacaggtgtgatccaccacgcccagccccagagtgatttctgaaaggctaatttgattgttactcccttgcttagaaacctttaaactccacccttgcatcctctctaatctctgtcatttctgtattatgtaagagctcctttaatgtgctgtgatgtgttaggcctcagtgctttcaaacattctgtttcctcctttgcaatattgaatcccacctccacccctaatgtggccagactgctgcttatctttcaaaacccaacttgaggattacttcatttcttgcttttcattttggctttttgtgctgtatcacaattcttttatcacatttgtctttttaatagactgcccttcaagacaatagagatagatcagtaatattcttacatgtcttatttccattgcctactatgatgtcttgacccagagagcactcagtaaacattttttaaatagttagttcttttgaaaattttatagagtgattttaaaaatcactttttgtctttggtcatatattgtatttgtgttcagggttccattatgatgagactgcatgaagttagaccttttagtgattaccatgtcttctaagaaccaattgaatgtagtgagtagctaaacatgtggaaaaggaagagtgaatcgagatgtagtatactagacatagattgaagagatgtgaatcctagcttagtcatttactagcattttggccttggaaaagtttaggccaaaaatttagccttctggtctcaatttcctcatctgtaaagtatcatagtgatagtaaaaaaatatatgaaagtatctaacatgagtgcttacccttggtagattgagtacatgtattcttttgtttgttgattggttggttgattgcttttttttttttttagagacagtgtcttgctctattgctcaggctgcagtgcagtggcatgatcatagctcactgcatcctcgacctcctgggctcaagcggtcctcttgcttcagcctcctgaatagcagagactacaggtgtgcaccaccacactcagctaatttttaaatttttttgtcaagacagggtctcattatattgcccaggttgatctggaactcctggactcaagccatctttctgccttagcctcccaaaccactgggattatgggtgtgaaccactaagtacttcttaaatcttgacattccacacagaaaaattttaattgtgattgtcacagagtggttaggtatacttgctgaagaaaaacccctatgtcctgtcttaaaaataggggaataggccgggcgcggtggctcgtgctggtaatcccagcattttgggaggctgaggtgggcggatcatgaggtcaggagttcgagaccagcctgaccaacacagtgaaaccccgtctctactaaaaatacaaatattagcatggtggtgggtgcctgtaatctcagctacttgggaggctgaggcaggagaatcgcttgaacctgggactgggaggcagaggttgcaatgagccaagattgtgccactgcactctagcctgggtgacagaactagactcggtctcaaaaaaaataaaataagggaataaatgcagaacgaattttaatacaaaaggccttatctccaattgatggctctttttgccctgttaatgattgaatataattaaggatccatgttaacttcgacttttttataatcccatgtatccatcatttttctaatcccataattgatttagaatactgtcttctatggacctaaaatctttttctgtcagaaatttcagtgagaaggtatgtacattctctcataggacatgtgctaaaattttgatgatgaagattaatatggcctttttacaagattgccgcacaaatttgtacaatgcgtggataaaaatttttttaagtgagttgtttaaaaggctcacttaaaaaaatcagttgggcatgatgaggttgaacttcaagttatttaagttgttgacttttattataggatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaagcctgggcaacatggagaaaccccgtctctactaaaaatagaaaaattagctaggtgtggttgtgtgtgcctgtagtcccagctactcaggaagctgaggatcgcttgagcccaggacgcaggttgcagtgagctgagattgcaccactacacccccaacctgggccacagagtgagacactgtctcaaaaatacataccttcagcaaatcaagattttttttttttttttttttgagacggaatctcactctgtcgcccaggctggagtgcagtggcatgatcttggctcactgcagccctcactcctgggttcaagcgattctcctgcctcagcctcctaagtagctgggattacaggcacacgccaccacgcccagctaatttttgtatttttagtagagacggggtttcaccatattggccaggctggtttcgaactgctgacctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatat

SEQ ID NO: 35824 - DNA, 9499 bp, Homo sapiens
ctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgagggctcggcccgcggtccccgtggtccctgcagcccgggccgggcctgaccctggtgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggctggcgacggggtcgcgcactggggtgggaaggaagggggtgtggagggctcgctgcttgacagtgcgtaagggtatatagggagccggcctggacttggaggttacactcccacaggtccctgcacacaggtgtgtggagggggggagggggcgtgcggggcgttatcgaatggcggccatgagtgcacgagatgacggcgtaggggtagaagtcaaacctgggctcagggcgtggaccttgtagggctctccaccaacacgccatcccatacacatgccaggctgccctcaagattccagggtggatgctggggttactagggggttctctcaaagaggctgtcagctcaggctctggaggcctggactagggttgtggccaagtgttgtccagcctgcagccagggtgtcagtgtctggagacagattgagagattggggaagatagatctaggccttcctgggtcaggtggggctgggggcagtagccaggagtagccaagacaaggtgagcagtctcatgcctcccctcacagagtggacccagagggacctggaacgcatggagaacattcgattctgccgccaatacctggtgttccatgacggggactcagtggtgtttgcaggacctgcaggcaacagtgtggagacccggggggagtaagtttgagggaggaagcttgtgggcaaggccacagccgtccgcaatgcaagccttttatgaatgctcaccatgtgcctagaagggaggccagcagccaggttcttgcccccttgggagctcattcagtttctggtgacatggcctgataagcactggaagcttgctccaaactcagcctggactagagcccatggtggcctggggagttgcagagagtagagtctctgcctcagggaggaaaggcaaggtggggctagaggtgctccagaagctggtgtggggccagagcctcaagaatctctcctaagaggtgtgcccagtagggagcaggaaggggttattgcaagataatcctgacctgtgctaccccatgtccacagactgctgagcagagagtctccttcaggcaccatgaaagctgtgctgcgcaaggctggaggcacgggccctggggaagagaagcagttcctggaggtgagtctgcatgggaccaggtagtgggtgacaagagagaggctctgccccacagataaggctctgttagcgggcaaacagcctaatgcccagatgtcctcaggtctgggagaagaaccggaagctcaagagcttcaacctgtcagcgctggagaaacatgggcctgtttatgaggatggtgaggcatctggctggtgagcaggcagggtggacaggaggggtagccgtagccctgggccccccctgattggccctccctgcacccagactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttttaggaagcagagcaggtcctatagacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccagaaaagagatacatcaggcttattccagttcccccatctcctggggctacctgaggcaaaaggggataggcacagggcactgtgccctaagggaactgcctgtcccctactggacctgaccattgtgttctcttgcagtatgactggtataccaaggttacctcagtggtggtagatgttgtgcctcggcagctgggaggtaaggcatacctggctgggtgggtgcagtggggcctgtagctctgctttcctgccgtctgttgcatccctgccccgttcttctttcctaggttccttctgagggccctacctccctgctgggccagccttatgcccagcatcctcagggagcggggctgtcaccatagggagcggggctgtcaccgtagggaacagttcaatagcaaggagtggtaggaccaagctgagatcagagtggcccaagttgatgatgtattatttcctgtgctgcaggtcataattagagttttcttatttttccaatggctggttcaaaccaaaaccatgactccttcaagtgggtctcaggaagtgcactaggttggaatgtcacactcgagaggctctggacccgagggcatgatattatcccatccaccatcctaaccccagcaacctttgtccagtctaagccctgaagtcagctgggtcttcaggagggtggctcttggctgagaggctcccgtctcgagtgttgatagctctgcttggatcctcctggaccatctcaaggatgagtctcttgttttctcaggccacccggtcagttccaggagttcagtggacaagggatagcctctttgtcttctctttgggttgcagggatgcagtggtgggaacctagtatgaatcccagctctgccctaaattagctgtgtcctcagacagggtcctggcctccctgagctcccatttcttcatggaggggtgattgtgtctgcctgcctcataggatcatagtgagtgttaagtgagtgatgatattaaagggtaggatttactgagccccctgtgccaagcgctgtgctaagcaccacagtggagataagacggacagatgatatcttggttaaagcacctggtacctacctgggttcaactggaattactcaggagagcaagtgcttttcctctgagcacccatggtttctctctggagctcttgagctctgcctctctgggtcctctctgggtcccaagaggcctctgcccctcagccacctactcaggcagctcctcatcgcgtagcgtgcccccatgtgtgctacaagctgcaggggcctgactggtgcctgagtagggccctgggtgaattccccagtaccctagccttccttgtagactaccctccctacctccactcctggatgcagcctcagccctcctatctttacagagaacttctctgggatctactgcagccttctgcctttgggatgctggtcagctgacagccagagagtggtctttgactcggctcagcgcagccggcaggtgagggacgctgattgtgttgaggggcagcccctgtggtcaacccccaggagccctgggggttgcatgtgcatgcccctgggtggaatgcccagccacaaagtctcatcagccccttaaaaccctgcctgcccatcctggactcatttctcctggaggggactggctgccctggtgcaccacagcagaactcaggccttttcgtctgaggcagagatgcaacccctcccaggcatttctagctgggggtcaaggggactgccactcgggtgggtccctgaacactctgtaatggcagctgatggggacaggactgaggccttcccccagggatggagtaaagccactcacagtgtgccaggctccttttgggtgtgatatttggtccttgtgccaactcaaaggggctcaaagccattccttaccttgcccagggtcacccagcaagttgtgatggtgctgggatttgaacccaggccctcacactactccctactgcactgagtaaccatcaccatagctgtccacagccttggtctggccagggctctccaagagggtagagaggaggtaggggagggacccataggtagagggagtactcttggatgtggtcgcacctgtggccttgcctctgcttcaggacctgtttgctgtggacacccaagtgggcactgtgacctccctcacagctggtgagcaaggctttggggatgggggtaagggcagggctggtgagcaagccaaccaggcagcgggggactggagctccaacatgtggggcagtgatggcattctcagccactcagcaccactgactgttccacagcctttactaacaggtccccaaggcccctgtctgtgcagacccttacccaaccaacagactagcttccctgctctactgccctttagcactcaactctgttccatgtgtcctggcccagcctcagcacggcccccacctctgctcctaaaacccacaaaactctctcttatcaagatctgccagactcatccttctcgctctgcaaaccttgggtgcctgtctcaggcagaggcagctctgccacctgagggcccaggaaaagcccagtgttgactcccccgtcttccccatacttaggcctggtgattctgcctttgaaatgtgttttgagtcctccacctgacctgactgtatccgctcctccacaaagctaccaaagtatcattccaaagctacatctcattgtacaactgcttggacaccactgccccaaatcagcacgctccccgacccccaacttcccggtcccagctgccaccctgcacacagcagccatcgagggacaggcagatgtgcctgcatggtctgatgtgtcttaaggtttggcagttcccagcccagccagtgtctgtcagatgaacaacagactgagagcaggaggctcacccggggccatgtgcagttgggtgtttgtgaaaggcacttctcggggagaaaagggcacctttccatagagtctccagcctgggactctgttacagagaagcaggtaagaaaggtgatggctcctgctaagcacttaatggcatctgccttttccaggagggtcaggtgggagctggaagttgctcacaattgaccaggacctcatggtggcacagttttccacacccagcctacctccaaccctggtgagtgtcggtgggtcccaggctgtggaggcaggggttctgggcaggcagagctcaccaggtcagggaattggccccagagtctgacctggctggtcagcatacagacgggccaagacacaggcccagcttggcatggtccatgagggtttggcactcacagggacgaactactaggctagaatctgctccgtacaaaacaaggtgcctggggaagtgctctgtcttggtattacagagcaaaggagacagcagagcctagaagctgaggagggaggggtgtgcctgtgtgtgattgtatgagtatgaataccttggtatataccatcccacaacaggaagccatgctgtaccttctggaggtgggtagagggcccagcatagtgagagctgcctatttcccactgtgggcagaagggaagggcagggaggcagccaggccacctatgacacattctttccccttggcagaaagttgggttcctgccttctgcagggaaggagcagtcagtgttgtgggtgtccctggaggaggccgagcccattcccgacatccactggggcatccgggtgctacagccacccccagagcaagagaatgtgcagtatggtgagctgggccaggggcagagggatgccttctccaggttccccagcacaaagcctctgcggtgacctttgctacctcctctctcacattgtggggtttctggtgatgacctctaagaggttttctgttcctcttgtggatgggcatgggaagtagcatctagacatctgagcgcctgctctggatatcacctgggcttcaccaggccaaatcatctgtggttggaagacccaggtccaaagaaaataggcctcatacaagcctcagtgaccacacctcatcccgaatgctgttgctgcaggatggggttccctgacgagggcagaagaagtatgagccttctggggtccatgtgtcatggtgtggactaccttggccaggtctctgacccagaggtcagccccacacctgcagctagagatggggccttagttggggaagcccctaggctcaccctgctgactgctgccctctccctgcagctggccttgactttgaagcaatcctgctgcagcctggcagccctccagataagacccaagtgcccatggtggtcatgccccacggtaggcatctggcgttaagagcccttgccctcccagccctcttcctagctggccctttcaccctccgctccctgtctgcaggggggccccattcatcctttgtcactgcctggatgctgttcccagccatgctttgcaagatgggctttgcggtactactaggtgagtgagcagggacccacagttctgttaggactacagtggagtgacgggggtggacctggtttgtataagtaccatgggtgccactctagtctccaggactttctctagcctagacctagtaaccactaccaggaactgctggggcccagcctctggttctgtggcatagtgataacaaggactaactcgggacttccaaggaaagggcgctgtggtcactgggtggcagcctcaaatctctgagtcccttccccttgaccccttgacagtctgtggtatagctggccccagggcctacttcacagatgtgtgaaaagagcgtcgagggggctgggaatgttgcctgactacactgtctggtccctccctgccctcagtgaactatcgtggctccacgggctttggccaggacagcatcctctccctcccaggcaatgtgggccaccaggatgtgaaggatgtccaggtagcaggggctggggcttctggacaggctgaaacatgggctgccagggggatgcctccattcagctgagcgggcagctggctgcagcatgctttgtcccaccctgcagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtaggcatacaccacaggtccctgcccttccctcctctacctcaaattctcatggagccccgtagccccagaattcctggggctgcaacagctcggtgtcttgcaggtgcgtggtggaggctggctttcctttcagcagtgactgcctgccagacctcagcgtgtgggctgagatgctggacaaatcgcccatcagatacatccctcaggtatgcagccccctccttgccctgtgtgctgcccatccatccagaatccagggcccagctcaacacagctccccactcttccccaaacacccaggtgaagacaccactgttactgatgttgggccaggaggaccggcgtgtgcccttcaagcagggcatggagtattaccgtgccctcaagacccggaatgtgcctgttcggtgagtgcagcatgaaggccctggcagctggtgggcaggtgagcacaggaggaccctccaaccttaaatgttgctgactaatccctacaggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacac

SEQ ID NO: 35825 - DNA, 2937 bp, Homo sapiens
gcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggtgagttggactctccttttgccacctattccccgtccgctctccagccccttcccctggtcccagattgcccacggcaggaaaagttaaaaagttcgcgatcgtttgcgggtagccgtttctttaagcactctccccctccccccgaagacgtgtcgggacctcttggtgggagcagccttccgaggtggccgggctggacgagatcagaggctccccgtcgatagggtcggagacccccgtccctcactgcggcagccgcggcgcccctcctgcgcaccgcgccgagtctcacgcgtatcttctcccccttccaggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagaggtaagatgcttgtggtttggcccctttaaaaaaaatactagtccccatagtccagaagtttagtaattctgagaccatgtatggtgatgctttgttgttggtagcttggcagaaaggcacatgatttcagcagtctggaatgcaattcagtgtgtctgggcccaacgaaagcgcatacggaaaagtgattcctgactaacttattgttctggtctggagtctccggggaattgtagggaactttaccataaattgaatttaacagcagaaaatatgtatgagtttcaggcggtggtttggaatcttaactttatccccttctacctttctcttttggtgatctttgcagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctggtaagtggagactgagcacttcagacactgtactgagatgcatttctggtctaaatctttgtagaaatgagtgcttgagcctgtttgtgtcggtatgcctctgagaagtcttccctcttatatgtctctagtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctctcctttctcttacagaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaat

SEQ ID NO: 35826 - DNA, 6464 bp, Homo sapiens
aaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcggggaggaggccgggacggcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgggctccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttgggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccgtcctggccaacatggtgaaaccccacctctattaaaaatacaaaaattagctgggcgtggtggcgcttgcctgtaatctcagctactctagaggctgaggcaggagaatcgcttgaaccccggaggcggaggctgcagtgagccgagatcgtgccactgcactccagcctggtgacagtgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaacgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgctttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccaaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaagctacctttctcgtcttggttcatgacacatggaggctgcttgtttgtggttgccagtcatagtgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataatgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacaatctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatt

SEQ ID NO: 35827 - DNA, 15165 bp, Homo sapiens
ccccctcggccccgcgcgtcgcctgtcctccgagccagtcgctgacagccgcggcgccgcgagcttctcctctcctcacgaccgaggcaggtaaacgcccggggtgggaggaacgcgggcgggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcaggttaggaaagctccctttactgcgcgttggggggctgggggagctggcggagccccgttagggaggtcggtggcgccggggtgtctcagcgccccctgcaccccgcgcgggtccggcccagcgggcgatcgctggcgcccagggaactccgggagggccgccagcgggctccgcagggcgcggggcggggaggggcgcctgggggccgcggggctcgcgctccccgcccgttggccgcccctcggaggccgagatcggggcccagaacgccccttggcaaggcctggcgcttccgcgatgcccagagggtgcttggggggatggagagaggggcgcccgccgggggagttccgggagcctcggtgcctcccgccgcagctgcagcgttcctcccgggaggcggcccagcccttcatcctcgccgcctgagcttctccgaggggggctgcagccttgcggccgttgccaccgcctggagaagcggcccacgcggactgacgggcgggggcggggcctcgggcctcggcgggggcggggtccggggaggccccaccctctgttctccaggggcggggagagaggagctgcaggtctgcggcctggccccaggtgcgatggcggaccccagcttggccagtcacattcctcccagtccccctggagggagaacgctggccatggggggctccaaggaacaaccagcctcggatgacgacccttgggtcaccggtctccccacctgtgcggcaggcgccttcacgtttcattattaaacaatggggagaaatccatgtttactgtcctttttaaggaattttttgctcttctctttgaggtggctgtaggaaatagattttttttttaacctcgcaattccaccacggtcacatccatcctcgccatcgcagagccacagctctccgtttttgtttcctagcctccagattctcacacaacacagtgcagtttcactgctgtaatgatgaggatcttcatggccgcgttattttcttgttctgagagcatcacggtttaattagcagttccccatatgatttgaagtgtttcccgtttccttagggaaaactcctggtagaataggattaaggatttttacaaatataattatcaaaaacataggaacagggaattggataaatatgttaaacttctggaaaaatcaacaacgctcttagatttgtagaagaaaggaaaaaatcaccagtggaaaggagcaattttacttacacaaacacagagaaggtcttacagtgaaaaaaagctaaccagtaaggggaaaagcaggcagaggggtaggatgtgatttgtatgttatttatatctaacacaagtcttccacaccgaaaggaaaatattaagattataatagataaatggcaaaatgatgagtcatttacacaataaaatgcaaattagagcatgtttgggttatcattttacatctattaaaataaccaaaataattaatagtaacagcaacccttgctggaaggttgcccaaaacttggcattttcaagtgtctggggaggtggcagggctttggggtcacaaagatggttctgcagtcaattttgtgaccttggacaggctacctaatttcctgatcctccttttgtccattcatagaatggaggaaatgatagctactttctgcgtctgtatgtatgagttattgggggcatttcgaaccagtgacaaacattttgttaagcaatctggtgatgcattaagaagctggaagctgtgacccagaaaccccactcctgagaacttacctgcaatggaagaaacaaacaaacaaaaacaggcatgtattcctagcagaatgatctaaaattagaacacctggaaaagagcctaaatgtataacaccagggcagtagctaagaaaattatgacacattaactgaaatgaacattatgtaaccactaaaaatcatgattttggagcctgtgatatgtggggaaaaactgacaagtaaaaaagtgggttattaactgcacctgcttactctaacgtgaacgcatatgtgaaaaatctgaaaggaaaagcacagaaaatggacgttttcattgaaattgtcggtgatcttaattttcctttggtgaatatattgctctcactaagggcgtttaaaaaatagttcacaggttttaattttttagatgaaatggacccacagttttctgtaagagaaaggagagattgttatatttgctacttagaataaaagatttttagccaacgttgtttcctttttcaaatatttttccatttttttagttgattaatgatttagtaatttgtgtattgggtttttttaagaatcagttcttagattcatttatcaattctagttttttgttgttgtttttaaggactcctgaatatttttcaaaactgaacaatttcagccatgtctgagctttccgtcttcctggaggcacaaatctagtttagctgaaccacaacagattgtacatatcctgcagaacctctgtggtcttaggaaggttgaaagtcaccaaatgtcacagaaaatgagggtcaggaaaggctgtgatcacaagctcttgatccagaggccactcgggtgcatctgtgtgactgacacctcattgcatcatcatttcttgtaaaatcagcttaattttgcagagaaatggccacagatttttagaattatgctgaattatgtaagggagcagccattttaaaaataatgtaatcaaataacaataataacataacagaagtttctgcaccacactgacactgaacatggctgtcaaccaactagccaaaccaaggtgaaagattctctgaacttcagttttaacttacttcgtccattctcccttttcagatcttatttcttcttccaaggcaactatatccactgtgaactgctgcatattaaacattcaaaacatgtctgtatctaacccagtgatggctacagcattataaaataactcctaagtgaatagtgtgtgcagcaattctcacagctaggagaattttttttgtcgatgtgttaaccattcctttttctccaactgcattctacttaaactgttacagtattgtgtgatcactttaagggaggtaatccttcagtgaaaagcattataaatgttgaagattagacccctgaggacctagcactgaagcctgatcacgggtgccaattccctgagaagcttttatagattcccaaatcccatcgctaggcactctctgactggcttgtgatgggttccagcaatgttgttttttaaaagctcctcaggtaattctgatcatggaccaggttggggaccctttgctctgttcagtttgtggtttctaggtgccagtgagaaacccctacccccaatttttgtgcaaaatttttttcagcttacatcaagttctttatgaacctcagaaaattaaaatataacaagggaatttacttagctcagaagagacaagggacattatggggtgaaggtcgggggttgtttgacatttgccccttcccgatgtaactaattaagcttcaagttgtaatgtgttttatgggctagaaggctttagtgcctatatttggatctcagctccaacaccttggactcttacaaccttgggataagttcttactagctctgactctcactccccatctataaatgggaataagatgaacggggtaatttatagattttttagtaccctctctctagttccgctgttttgccattctgctcatgcaccaatgccatgtgatcttattgtagctttgcactctgacacctggcaggtcaagtgcacccttgattatcttctcattaaaaattttcttcagtcttttaagttttgagtataatttcataatgtcttttaaaatctcttttgaattctttttcaaatttatttattttttctttgacagataagattatatgtattgtgtacaaaattagaaagagatcttttcctctaagatctgaaacaagacaagaatgctcacacgcactagttctattcaacatatggtactgcaagtcctagccaggacagttagacaagagaaagaaataaaaagcatccaaatttgaaaggaaaaagttaaattgttcctatttggagacgacatgattttacacttataaaaccctaaagactccaccagaaaaccattagaactaataaattcagtaaagttgcaggatacaaaattaacatacaaaaatcagtagtgtttctatatgccaacagtgaactatcaggaaagaaataaaaagaaagtgccatttacaatagctacaaaataaatatttcagaataaatttagccaagaaggtgaaagatctctacactgaaaactataaaacactgatgaaagaaattcaaggagacacaaatagaaagatagcctgtgctcatggggggataattaatgttgttaaaatgtccatactacccaaagtgacctacagattccatagaatccctatcaaaataccaatgacattcttcacagaaatagaaaaaacaatcctaaaattgggtgaaggtggcatctttgtctcgtttcagatctaagaggaaaagctctcaatttttcaccattaagtatgatgttagctgtgaccttgtcatatgtggcctttattgtgttgaggtacaatgcttctacacctaattcattgagagtttttatcatgaaagaatgttgaattttgtcaaacgctttttctgcatctattgaaatgatcgtatggttattgtctcactctgttactgtgatgtatcacacttattgatttgtgtatgttgaaccatccttgcagccctgggatgaatcccactgtatcatagtaaatgatctttttaatgagctgttgaatttgcttcgctagaattttgttaagaatttttgcacctatgttcatcagggatattggcctatactgccattttcttgtgtgtttttgtgggactttgacatcaggataatgctggtttctcctgttattaatttctagttttataccatcatgcttagaaaaaaaacttgatacgatttcagtctaattaagtttgttaagacttgttttatggcctaacatatgatctgtcttggagcatgctccatgtgctgttgagaagaatgtgtattctgcagctgttggatggaatgtcctgtatttgtctgtttggatccatttggtctaagtgaagtgtaagtctgatgcctccttatttattttctttctaaatctcccgtccaaaaatctaagagatccaaagcaaacagggggttataaaattacctttgaattctgactgaaattgtgtttactttgtagattatttgctggtgacttggtatctttcaatattggtttcccaaacaaaaaacattgtatgtctttctctttttccagtcttcttttatgtctcagtaaaattttgtagcttgcctactacttattttcaggttaaatcctagatattttcaattcttactgccattatgaatgaatgtttttccccatgaaatgtttaactacagctgatttagggactcactgagttttgatttgttgatttgaaaaactaccaccctgttgagctcatgtatttattctaagacattttttgagattttccaggtaaaaaaattatacctagatgaatttatagaacaacctaatagcataaaagcaatagattattgttcaccacattaatgggaatgcctttcctcttaaaattatgatatcttgggctttgtgtttgtgacagcatttctttatgatggaaagagactatccttccagttctatagaaacgttttaaaaatagcttacatttttaaaaatttaggaatgatattgattttcattgaaaacttttcaacatctgaagaaaatcttttcttcctaacctattaatagagctcctgattttcaaccattcttgtattcctaaaataatccatattggtcataatgtattcttcttttactaaactgttaaaataagttgggtgctgtttttttagattttggcacctgtgtgagaggagggtgccatggcagggtggctaagtgtgcccacctgtgtactagcattgaattttgaccctttatcccattggctctaaacactacatctcaggtgaagacgcccaaatgtttatctctactgagttacagattcctataacaattgcttaaattgatactcccacttgaatgtctcataggtgtggcaaagtttacatgtctatactgaaactcttggttttctctcccaggcatgaccctccaccagtttgtcctatttcagtagatggcatcaccgccatctccctggttatggaagtcccagacccgggcaactctcactcctccatccactcaaccagcaggtcttattggctctttctgtaaaatatgtctcatttattcacagcctgctagctgcatggactccatcccaggccacgccaccatcttcctgcagcagtttcttaactggcctctccattccctttcttgtcccactaaattttcttctatttaagaaaaaatgttttgtagacatggggtttcaccatgttgcccaggctggtctcaaactcctgggctcaagcaatcctcctgcctgagcttcccaaagtgctgggattataggcttgagctgagcttttgaaaaaacattctatgatgttactgtcctactaagaccctttaatggctccccactgctttcagaggaaaatagaaatttctctctgtggaccatgaggccctcatgatctgaccctcaccacctccctagtcttagcagtccacctgccactgtctcatggggctccacagatttgatctcctttttggtccttaagcccaccaagctaagtatcttattcaaaactgtgtcctcagcccctagcacaattcttgacccttagaattctgacacttgaaatgtgtgttaagctaatcaataaattattgtgccaggcttggtggcacaataatgtgttgtgggtcacctatatatagctgtggctcacacctataatcccagcactttgggaggctgaggcctgcagattggttgagcccaggaatttgagaccagcctgggcaacatggcaagaccccatcactattaaaaatacaaaaaaaaaaaaaaccaggcgtggtgttgcatacctgtggtcccagctactcaggaggatcacttgagcccactgggtggaggttgcagagagctgagatcatgccactacactttggcctgggtaagaccctgtctcaagaaaaaaaaaaaaaggttatggtactgtaaatattatattacagtgtataatttttgacagctttttttctccatttcttctatggttattggtcagttctagccttctatttttttttttaagctgacacatactggctgggcatggtggctcacacctgtaatctcagcactttgggaggccaagacaggaagatctcttgagcccagaagtttgaggcgagcctgggcaacatagcaagaccccatctctaccagaaaagaaacaacaacaaaaagaaactggcacatactagttattccataaatatttcttaaatgaattaattctaaagttgatttttataatttacatcttaatagaaagacaatccatctcagagatatttttattcattaaggaaagttgcataaagtaatttattaaccttttaaagcattctctaagcctatttccccttatagagatatgttttctagtgatgtgtgtatgttacattttcaaataactcttaattttatttagaaattccacatttttgtgggttttatttattaaattcgattttcatctctattattaatttatgacagtttattttgaagttttctgttttcttccttttgagttgaataatcatttactttattttacttcttctattcagttgtattatccatgttcctctgatagccatgcaggttccaaatcctcacatttttcaacttctttaaaagattttttttgtgctatcctgataagcgttaagtgttatatcattttttttcatttttattatattcttaatgattttgattctctttttctatccttttggttttctttcttaggtaaatgatcagttatatcttttggccatttttttctgttggaattactgtctcttactgctctgtaagaattccttgcaagttctagaaatgaatcctctgttgattttaagtactaaagtcccctttaccattgtgtactctttctattaactttgtccagagtcagctttatcgtgctgaacaagaatctttacattttaatttttttttttaatttttaagttcaagggtacaagtgcaggtttgttccataggtaaactcgtgtcatgggggtttgtcatacagattatttcatcactcaggtactaagcctagtacccattagttatttttcctgatcctctccctcccttagccctccgataggccctagtatgtgttgttcctctgcatgcgtccatgtgttcttatcatttaggtcccacttataaatgagaacatgtagaattgggttttctgttcctgtgtcagtttgcatatccctgcaaagaacatgatctcgttcttttctggggctgcatagtattcgatagcatatatgtaccacactttcattatcccagctatcactgatgggcatttaggttgattccatgtctttgctattgtggatagttttgcaatgaacatacacgtgcatgtgtctttgtaataggatgatttatattcctttgggtatatacctagtaatgggattgctgagtcgaatgatatttccgtctttaggtttttgaggatgtaatcaaattcatcaattatttgccttatggtttgtgctttttgtttaaaaagttcttcccccattcctcctccaggtcacaaagacatttcccaatattttcctcttctagcgccaaacttgtacctttcacatgtaagtcttggatccatctagagttcacttttgtatgtagttagggatctagttttctttttcttgtttcccagaagcatgaaaccttcctcctttattggttcgtggtgcccatgtcagcacacatcaagtccctgttaaagtgtatctacgtgggtttctctctcaacttgcttttctgtttcctttggtctctccgtctattcctgagctttaccgtccagtcttcgtcactgtggttttgtagtgatttcatgtctgctttggcagattccctcctctttacactttttttttaaggttgaccttattattcatggacattttcttccccatagaagtttactgaacttctcaaaaaattgagattacctggaattttaactggcattttattgcaactaccagttcatttaggataatggacatctttataatactgagttatcgccatcaagaccatggaatgcctctccatttttttcagaccatcttctgtgttctctgtataatgtgtcacccatcagaagtcttttcttagttaagtcaattcctagacgctttacagtttggttgttactttgaatatctgtattttcttctggtcagttattgctactgtagaggaatgccgttggttttcgtaggctgaccttcagtcccacaaccttgcactctagcgttggttctcatgttatccctgttattctgttggattttctatgtgcatgatcacactaattgcaaatagtgtcagctagagcactttccttgccattcttacacctgttacttctttgcatatggccttggacagcaccttgagtcccatgacaatggatgtccctgttgtatttctgagtgtattcttagcattcttcttagtaataaacaggtattgaccattaccatatacttaataggatatcttgaaatatgccagaggactaggccactacttgactggtgacagagagtatcttagatgtataggcccccagacatgccagtgtcctctctcaccacccatctccactccaaagttgtctggcctcacccaccttctgtgcctggttcttctcctctgtgcttctctcactatgccatgtcctcgcctgttcaggtgtctctaagagctcatagatccttaactcttacagctttaaatgaggcacattcaaagcccgactcagtgtcattccctgcagtctcctcttcctcccatcttacccatttcaggtaatatctccagccagccagagtctactgcagtagctggcacatgaaataaatgtttatttaactgaattgaaaatgttagctggccattgtcaaaaatactattttgtaaatttataaatatggttctctttgtatatccattataaatatttagtatttagtttgattattccttatgctttataacatgtgttttcccattcattcatttatccagcatttattttgcatgtctatgggtcaagcgctctgtctaggaacactgctgtgaacaaaaccaaactcccgccctaaaggagcctgcactcccgtggagaacatgaataataagcacagaggaaataacataatatctcaagtagctgtaactgctccagagaataatgaagccaggaaagggggtgggctagggggtgctgttttaggtagagtgatgggaacagccccactgagcaaactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagaggagagcgctcaatggcagccaggggaggagcagggaggctggttgggaggctgttgaagaaatcaggtgagaagtgatggaagcaccgaataagatggtcatgttggaaaaattgagaagctgaggtgcttagcattgattttcaaggtagagctactgagatttgctgatagatccaatgtatgctgggagagaaaattcagtcactctagagcattggctggatttgtcacccattgcagcgaatggagaaggtgctgacataaaagccctttagactgaaagctactgactgaggggatggtgccctagtttgatttcctggggtgtatgagtagcagggaggccaagagctgggcctcacgagattgtggggactacatcagggaagcaggcctgcaaagaacctgcaccacagacccccacctaaaagagcctccaaaaaccctaactggcatgacctgagtactttaactctgcttgtaactttcaaatatattttgatttgcttatgaccaccaaggcaaaacttcccatttcaataatgttagtagaaacataaacaggatgttaatttatttatttggtaattctttttatgaatattatccagtttaatcattagctctgaaggagatgaaaaataattttctaatttttagaaaaatttgcagctaattgggtgataaaggtaaggggtttctgagttcacaaaaatgttctaaaattggcaacagtttcggttgcacgtttcattaaatgtactaaaaaccattgaactgtacatggtatatggtgaattatatggtatgtgaattatatctcaacaagctgggtattgtttttttaaaaaataaaaataaaaaaggagaaagagagagagaaaaacaattgcagatcatcccagcactgaggacaagactaacttcagtgttccagtatatgccattataggttttacggcacacagtgatgatttggagcctatgatttgacctagggtacagcaggtactgtttagcaatcattttactattgtcataggtctctgctcttggagctaagtgcccagggtaaatgagatctttaatttgaaaagagatttttgatttgatgaatgtacattctccaaagggtcataaattgtcattctggatgtttgatctgtttgttgttttggtacaaaaattagaagaaaataattcactcataaaatgttaaataatgaactaaaagtcattcatcaagtccataacttagggtcacatttgtccttggagcaggagaaagagttgtgttcacccttttcttacttttgcttttgtcctaagtgcttcagagaagtacagggtggcaacagtgtttctactgagcagctgataccattgctatgcactcattcattatgcaggaaacatttagtaatttcaacataaatatgggactctgacgttctcctcttcattttgcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 35828 - DNA, 84336 bp, Homo sapiens
gtgacctccgcagccgcagaggaggagcgcagcccggcctcggtacgaggggtaaaggggctccgggccgggggtcctgggctcagggaacggggagcgtggcccgggagcgtctcgcggggatgcccggctccgcgctgcaccccagagtgggtgctcgccgccggcttgcgggcaagcccgggcggccacagggtggagggggccagcgggccctggactcgctccgggtgggcgagagggaggcgagcgcggtgcttaaccgctggcaccatccaggacatccagggccgcttacacggctcaggacgcgggtcagagaccacggcagttatttattcagtccatgtgctaggctttgcatcaaaaagaaaggaccgagataatcttgcctgtagctaactcctcctaacacctcttacagtttactttttaattctttactccatttaagaaacttactcctttctcctagatccttaccactttcttaccttctcgtgtgtctaatgccctcggcacagtgcccggcacatcggagtctgattattatagggtccatgacttgagttggctggtggcgcagtctcagcattttgtcatgactttgaccagctggagactttggtgccaaggaggaaggcttctcaaccatttaccggcagaagtgacccccggggcaatgcaagtcttctgagctgacagagcagagtgggtcctgcataactcgtgctttacatggaactgggcatctgctctctcctgctgacagtgggaaggatagataaggtgtccctctccaagttatccattctcctgcccaccagtccatgacaccccaccacccccttccactccctactgtttgccctttaattttttgttttgttttgttttgagacgaggtctcactcctgtagcccaggctggagtgcagtggctggatacagttcactctgcctcccaggctcaggtgtttcacccacctcaacctcctgagtagctgagactacaggtgcatgccaccacgtgcctatagtctcagctattcaggaggtaactggtaactctattgataaccaaaccctagatttttttttttgagatggagtcttgctctgttgcccaggctggagcgcagtgatatgatctctgctcactgcaacctccgccttctgggttcaagagattctcctgcctcagcctcccgagtagctgggactacaggcgtgtgccaacacgcctggctaatttttgtatttttagtagagatggggttttaacatgttggtcaggctggtcttgaactcctgacctcaggtgatccacctgccttagcctcccaaagtgctgggattacaggcatgagccaccgtgcccagcggccaaaccctaggtttttagttgccagggaattctcagacacaggtggaagagcaagtaggagaggaagtggacagggataagaaaacggataaccccatgacccaagagctgctgactctccagagccctatcaggccaaggccatcctcattcagctcatgtcagatttctgttgattgaagatagagacacaagtacacccctgcccccacccacacatagacaggcacagacacacaactactggatcaagggcttctgtgaatttccctcctagatgttcttgcatttggttagggataatgtttctctgcaagcaatttagagagtaacccgcacagtcaagccatgtaccactccaggccttggtgtttaaagggtgagcctcctggtcatccccaggctcatgtccagtggcatgtttctttgtttatgtccagccactcatttgttttcctgagctcatttattatctgcttttagactaagcctgcttttctccaagggagataaagatgagtggcaggcactggggattgtgggcagtgtgccagggagtacctgaagttccagaataaacaaggggtggggaagcctgggcaacatagcaagaccccgtctctacaaaaattttaaaaattacttgggcatggtgacacccacctgtagtcccagctacttgggaggctgggagggagtttcacttaagcccaggagttcaaggctgcagtgagttatgatcacaccattgcactgcagcctgggtaatagagtgaggccctgtctgaaaaacaaacaaacaaacaaacaaaaacaagaggaggagattttctttgagtgtcatttttacacaaatatttgaaattaaaaaacactttttatactaaaacaatcacagatatattttgaagtagaatccaaaaattgtataccttttaaatctaaaacaagaaacctcaaaaacattttgcttgggatttgagctgcaatttggtccaaacctagcccttgagggtttgttttcactgcaattagggctacttatggaggcagtttgatagacactgcagtgtcctccctggagcaactttgagtaacactcatcctaggctgtcttatctaatcttcacttcaacctgcaatggggttattaacgttggtttacagctgaggatcccaaggttccatatcataatccttggtcaagttcagaccatttgtgaacgaaagcttaaatccagctgccaggatacaaaagcctgttctcttatcctctctgccctaccataactccatcagtgcttggttcatagtaatttggatttgtggcttcgtagattgttaactaaatcttgaacaagtgttttcctttttcttattttcttcttgtcaagctgatatgaaatggggttgaatgaacaagaactgtttcaactggaaagggagcacactgctgttgtcccagctacttgggagcctgaggcaggaggatcccttgagcccaggagtttgagactgcagtgagctatgattgtgccactgcactccagcctaggtgacagagtgagatcctgtctctaaataaaaagaaaaaaaaataagtttgcagtgagtgtgaggggtgcatgctagccagcagccctaaatgccagaggggtttgacatgtggataagggaataaactcgctctttgaggtgtttggcagagctgggtggtgggctctggttgaatttgaggaagtagtttttaaaacccataggctgggtggccttgatgttggcgagagctctgtcactacaagtttaggcagaggttcacagcccttttctgatggagctgggaagggttagcagattaagctcagttaacttctaaatctatagttcccaaacttcagggtgcatcagaatcacccaggaagcttgtacaatatgcagattctgcttatttaagcagctccttggatgattgtgattcaggcctcactttgagaaactatgctttattttttttatttttttattttttgagacagagtctttctctgtcactcaggctggagtgcaatggtgccatctcagctcactgcaacctttgcctcccaggttcaagcgattctcctgcctcagcctcctgagtagctgggtctacaggtgcatgctaccacacccagctaatttttgtatttttagtagaggtggggtttcaccatattggccaggctggtctcgaactcctgacctcagatgatccgcttgcatcagcctcccaaagttctgggattacaggtgtgagccaccacgcccggctgagaaactatgctttagaaacacttatatgaatatgtgcatacttcataaattgaataaagcattaataaaaacatatcaccttcccaaggaaacttaggttttggtcattatgtataaactctaggtaatgtggtaaatgctaaaaccttccttctcaaggatagttcttttgtttgtttatttgtttgtttgttttcgaggcagaatcttgctctgtcacccaggctggagtgcagtcgtgcgatcttggctcactgcaacctctgcctcccaggttcaagtgattctcctgcctcagcctcccaagtagctgggattacaggcacacgccaccatgccaggctaatttttgtatttttagtggagacggggtttcaccatgtttgccagggtggtctcaaacccctgacctcatgatccacccgcctcggcctcccaaagtgctgggattacagatgtgagccactgcgcccggccaaggatagttctttattataccaatcacatctcccttgtgatttgattaacaggttttttttcccctgcaaactcaccacatagtcttatagtgctaacacctctagaacaatgtagagctccaactaaaggtttttttgtttgtttgttgtttaacttaattgaaactgaatagattactacattaattccctgaggaatttaggatttctatctaaggcttgttgttggttttatcgggagtaatttattagtgtttggttttgtttgaactggactgagagcttttgctatgggaacctgaaccaccacctttgaagaattctttttaaagattcaagttgtttgatgtcagtaaattgccataatgcttcttggtccacactgcttgacgtgaaaaaacagagtgaatattatattgcagctaagtgtcagactgtaaattactacggaaaagaccttctacagcctggtcaacatggagaattctgtctctaccaaaaacaaacaaacaaatgaaaaaaaaaaaactataaaaattagccaggtgtggtggtgcactcctgtagtccaagctatatgggaggctgaagtgggaggatcactggagcccaggaggcaaaggttgcagtgagccaaaattgcactactacactccagcctgagtgacagcaagactctgtctcaaaaaacaaaaacgaaaaatccttccattttcctcctcctccccacgaaataactaacccttgaggcctagaagaaacacacagaacaagcagcctgacatgtaacagagcaggaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataaaggggccctgtgattactgggaacaagttctcctgatttatatgcgattgaaccatattccctggagtaggtcctttagagctataagcccttgccatgatcagcccccagcatcttctctcttactcctctacaggggacttaggaaaacattttctgagtcttacccaactttagcttctgctattgctactttttgatgctgtgcaagcacctgttgactcagtggttctcacccttcttggagtcacagacccttataagaatctgactgaagccatggatcctttcttgataaaaataaatacacacttaacatttttcgtacaatttcaaggagtttatagacacacttctaaactcagtcatggatacaggttgagcaatgtgtaatgagttgcagtcaaaactacacaaaattgttacttttttaattttcagaaagggggtcttgctctgtagtccagcctggagtgccctggtgtaatcatagctcaccgtacccacaaactcctgggtttaagcaatccttccacttcagcctctagagtagctgggactacaggcatgcccagcttattattattattatttaaaaattttgcatagatagggtcttactatgttgcctaggctggtctcaaactcctgggtgatcctcctgccttggtctcccgaagtgctgggattacaggcatgaaccactggcccgaaattatttaaaaatattgtataaaattactgtgggggacaagagaacggatcccctttgccctctgaaggtttgctgaaaaatcaactcacaaaaggagataattagagaaaaggcaagccaggcgcggtggctcatgcctgtaatcacagcactttgggaggctgaggcgggtggatcacgaggtcaggagattgagaccatcctggctaacatggtgaaaccccgtctctactaaaaaaatacaaaaaaaattagccgggaatggtggcgggtgcccgtaggcccagctactcaggaggctgaggcaggagaatggtgtgaacccgggaggcagagcttgcagtgagccgagatcacgccactgcactccagcctgggcgacagagtgagattccttccgtctcaaaaaaagaaaaaaaaaaatgagagaaaaggcacacatgcggaaaatacatatattatgggggaatattaattttgcattatttttcattaattttacattatattaatatattaattataaaattataactatcttttataaattatattacataaattatgttaacttgcattattaattttacatattaatttcacattaattttatattaatacatattttatgggggaatattcattttcccccatattatacatgaaggaaaatcacagagtgaatttacttaatattccagtggggtgcagatgcttgtataccctacttctttttttttttttttttaatacagggtctcactctgttgcacaaggctggagtgtagtggcatgatcgtggctcactgcaccctcgacctcccaagctcaggggatcctcccatctcagcctcctgggtagctgggactataggtgcatgccaccacacctggctaattttctgtatttttttgtagagacgaagttttgccatgttgcccaggctggtttccaactcctgggctcaagtgatccacctgcctcagcctccccaagtactgggattacatgcgtgcaccactgtgcctggcctacaccctactttttagaggaaagagagttgaggaagtgtggatgttttagggaggtggcaactgatgtttgggggaattcagctggctcgaagaacatacaatggcccgggacagagcctcttgggcccacagaacagacaatggtttgtgacaaaagtccatccaggtgtgttgacagacttttgtctttcctactacaatatgaattcagctaatgaaaactcagggaagggactaggggtaatggtttccttttttggtaggtccagactttagtcagataagggaacttcagagaacaactttgggagagacagaggattgagagacaggaggtaggaggggggatgtctttggttcagcatgtcaaagcaccatattttgggatatcagtttctgagccccagcagacatacacattgcagccttgtttgtagtagcaaaatagtagaaacaacctaaacatcagtaaagatctggttaaattatggaacatctatgcagagtaatactatgtagctattaaaaaatggtgcaggttgataggaactgatatagaatgacagtgaagatattttttaaaaagtaaagtacagctgtgtgtggtatgctaccattttggtgtataaaaatgatggaggctctcacacctgtaatcccagcactttgggaggctgaggcaggcggatcacttgaggtcagaagtttgagaccagcctagccaacatggtaaaaccccgtctcttactaaaaaaaaaaaaatagctaggtgtggtagtgcacgcacataatcccagcttctagggaggctgaggcagaagaattgcttgaacacaggacggaggttgcagtgagccgagatcatgcccctacactccagcctgggtgacagagcgagactctatctcaaaaaaaaaaaagaaaaagatggaggctgtctatattctcatatgcttattagtgcattaaatacttctaggaggatacacaggaaaattataagagtggttgcctggggagggggaaggaaagtcttacagacttgttgttatgtacttatttgtactatttgaatttgttatgtttatgtattaccaattaattaaaaaaaaatagtgttacagatatcacctgcccattgaacattgtttgtgaagaaggagaattaaatagaaatgaagaatgtataattatcagatttccaaccttaaaattaacattcgatcatatacttccttatatgtgtacaaaggactagcatgcaagtatccttcagtttccaatgagatgaagcagccaccgctcattcttgccgtgtgtttcacttgggtagctggttccaaaagaatgtaaagtgcctctagttggatggtggagaaagttctgcttttggttttgttttgtttttgtttttctaagacagggtctcactctgtcaccctggctggagtgcagtggcacaacaatggcacactgcagcctcaaactcctgggcgcaggtgacccttccaccttagcctcccaggtggctggaactataggcacgcgctgccacacccagctaattttttgtattttttgtagagacagagttttaccacgtttcccaggctggtttcaaactcctggagtcaagccatctgcctgcttcagcctcccaaagtgctgggatgacaagcatgagccatggtgcctgacctagctctgtttttaaatggtctgattggttccagtgtgtctttagctgcagaagcagagagaggaggtagatgggataaatcagggcctgtagactaggtagacctgctagggcaggggcctttgtcagagaaatgtctcccagtgatatcaatggccatgggcactgaggggcctgaccttggctttggagcctggacccctatcttcagccagactatgtcttagtctgtgagggacctgcctctctctgctggagatgttgatagctaatgttcaccaagtgtcttctatgatcctgaccctgtgccagacatctggtatgatattttattaaattttcacccatattaggtgggtactagtattatcattgccaatgtaaatgaggaaactgaggcacaaaggggttgagtaatttgctcaaagttgcacactgacgagcttcacagccaggatttgaacttgtcagtatgactctatatcctatgctttaccactctgtgtaataggttaaaagtgggggaatcaggccagccgcagtggctcatgcttgtaatcccaggctaagcaggtggattgcctgagctcaggggttcgagaccagcctgggcgaaaccctttctctaccaaagatataaaacaattggccaggcatggtggcacactcctgtagtcccagctactggagaggctgaggtgggagaatcgcttgggccttggaggcagaggttgcagtgagccaagatcgtgccactgaactccaacctggatgacagagtgagaccctgtctcaaaaaaaaaaaaaaaaaaaaatacaaagtggggaaatgagcagaaaaagacagggctgggagattaagctatggggatgaattctttcagaggggaaggaggagagcctaagtccaaaccacttgtccaagatgaacttgatattgatttaggtcattctgagtatctaggggatccaggtgaggagtggagagcagaggctgaatcaggaccatgtgctgcatcatgactctggtggcccatccttctgggatcaagacttagggcagcatctaaaggcaggggaggcagctcagaaccttggcgtagggtcttcaagaggtaggcaggaggtcagtggcctctgccaaatgggcaaaggtgcatttatttattatatatgtaagtggcgggcactagagattcaagaatgaaacacactgactcagggagataagtaaatcaataattaaaaaatcataggactgtatgatcagtataataatttgatatatatgtgcagactgccatggagtaacagaagaggtgcacctaactctatcattagtggtcacagaaggcttcctggaggaggaaggtttatattgagccagggctggagaagaagggcttatgcacagttgtggagatgagaaagctaagccaaagcacactgaaggaatggcatgtctgttacagcaggcaagtcccagaggtggagatggaggttccttagaaactaagtccattctgtaggtgtatgggagacagggcagatgagtattgagggacaggtcctagagggtccaaggatcccatgtaaggaactgctggcctggaatataaatccctacttccctttgcatctgttccagtgcctggcaaagttatgtaataaatgttttcagataaaatgaaagtgctgggtaccaggaaggaaatcaaggcagagatttagccttggagaaacatgactccttgcttccctgcttaccctgtccagacctccaatattcatcttcgacatggtctccttccctgattgacataatctgggtcaggggcctctcctacacactcctgacactttctgtgatttccccagcatgggaatgggaatgttcacaccttattatatctgatcacatacctgcctcctctcttcagctttgagctccactgagggcagggacgatgcagccccctctggctagcacagtgctgctgagcacatactcggcccttgctagaagtgtgcagtatgaatggacaatttcccatggcctagaaaatttagtccaccctctaggcctggcctgccacaaaaatgatccagttttgaaaattacttctgtagctcttgctccgttcatggtgtccttaaactcccactcaactccaagctaactagtcttttccaaataagtcttaacgttcataatcatagcaggagctttgcttttactgtttactctgcttggaaaattctttccctattgaaatcccattattattcaaagcctaagtcacgtgagagctcttttaatttcttaggtggacgttgtccatcttcccctaccctgcaattcgtaatagttctcacatgccgctttgtctttaaactagttatgtacctgttctatttctcttagattacgtgcttcttgagagcaagatcatgtctcctccatctttctcttgccatgcctagtatatgataggggcaaaataaattttaagtaaggactatgagtgcctgcacacatagcgagtggcagttttggaactggggtctgaaaaccacttgcataagaatcagggcctgggctgattcttatgaggagaatgccagggttgcttatttaaacttgattaaatgaagtctctggggcccacccaagatttccagagtcaagggtcctcaccgaaaatctatattttaactgctccccacgtgacttttgtgtacttttgaatttgagaactttcctcaggtaacaagctagacagatgctgtacaatcgatattaagtagaatccttttgaagctgtagctccagacatcatgtcctgacaacatccagggccaggagaaagggggaatttggctggctgactctgtctttttagcctggaggaacttcaaagcgtcttagcaggtttgtccttatttctttttggtcagaagtgggtcacatggccactcctaacccattcatggctgttcaaagggggttgccttggaccacttattatttcctcctggggctagccccaccttcctggtttaccaaacccaatctccaaacagaaagaagtttctcctaaggaagaaggaaggtgtagtggaggttgacattattgctgattcttgcaaaaaagtctgtgcattgcaataactgctactatcccaattttatgccaaaataaaccagctctcataggtggggttaaatctggagggcagaacagggactggaacttggttcttgttctggattctaagcctgaatgatcttcatgacagcctatgccagcatccatctgtgggaagagaatttaatttgaagtttcacagatatcatggaatatcagatctggcctaccaggagtaatgcatgtttgcagtggatggttttgagaactctgctgtttaaataatctttggcaaacacagtatttcctaagtcatgtttatgcaagtgttttaaaagtgttataacttcccccattaacataacttatccccgttcccatttcctcatacttgatgtaaggtcatgattggcgatctatacttacgaaatgcccatggtgtggtttggggaccctttcagacatcaatagtttgagtctagaattattactatagaaccagggttctcaaacctcagcatgtatcagaatcacctggcgggattcttgcactttacaaagattatttatttttattttttagagatgggggtcttggtatgttacccagactggcctcaaactcctgcactcagggattctcccacctcagcctcccagtagctgagattacaggcacaagctaccatgcatggcctggaggcttcttaaaacccaaactgctggatcccatccccagagtttaggattctgtagatctagggttgggcctaagaattgtactttgaacaaggtcccaggtgatggtgatgctgttggtctggaaaccacacttttagaacaaatgatactgatctgggtttattgaaaagatgatataataggattttatcatgtgtaccacacacatcctatcctttccaggttcttttatgctccctcctaaggctgtcctggggccttcccctctggctgtgttttgcacagagggattcacctagccttctgtattttggtgactctaggctgggcttgttctttggaagtgagaaggtagagtgaggtctatgtatcttccctccaggcctggttcattgtctgtatacgaaggtggctctaaatgttggtcttgaaattttggtttcactttaaaaggaatgaaattctattagatggtacagcatggacaaaccttgaaaacatgctaagtgaaataatccagacacagaaggataaatgttacgtgattccacttatataaaatacctagaatagtcaaactcatagagacagatagtggaatagaggttaccaagggctaaggtgagggggaaatggggagttactgtttcacgtgttcggagtttctgtttggaatgatagaagagatctaggaatagatggtggtgattgttgcaagacattgtaaatgttcttaatgccactgaattgtacactttaaaatggttaaaataggccaggaacagtggctcacgcctgtaatcccagcactttgggaggccgaggctggcagatcacttgaggtcaggagttgaagactagcctggacaacatggtgaaaccctgtccctacaaaaattagccacgcatggtggcctgcacctgtagtcccagctacttgggaggctgaaatagtaggatagcttgagccagggaggtcaaggctgcagtgagctgagatcacaccactgcactccagcctgggcaacatggtgagaccctacctcaaaaaaatttttttaatggttaaaatggtaaattttgctatatatatgttaccatgattgaaaaaataaatcttgcttttgttattcttctatctcccagtgatgtgctgaattgtccttgtatcagcccctgagagctagttgttaaatttttagaggttttgcaagctgattgttaaaaatagccagccgtgatttaaaattaaattatatgaactaatgagtaaataagttatattgaaatatgaatatttataagtaatttgtatttaaaacaattcatcatttcctaattctttttcctaccttttaccattatctatgctctcgagggtatttatgtctattatatctgtgtggtgaaactagtattaatgtgtaatggggtgctactgaccatctactcccaactccaagttgagtgacatcacattagtaacttgaaattggtcagggtgcaaagatttacaccaaaaaagtggctacacatcagggtgtcctttccttggagagctggctattagctttatcagcatatccctggccttaccttgtgggttagggttggtgtaagtttgtaggaataaaacaccagtcacttggaagctaccagcccagctttctttaattgaatcctaaccctttccaaatagccctgccttggggcgtttttgctgtgcctaaaaaaaaagggtggtggctgagtttagtagcaggggaagatgagtcacatagtcagctagttactttttaacctcatgggtgcctttcctcaactgtaaaatgaaaggggtgggagaaaaactagtagaaataaagtaagatcatttttctagcaatgagaaagagatactttttaaaaaaagtttttattactgatcacagccagttacagagatttctttgttccttctctacttgtactgtttcccttgactagctttaaaaaaagcttttattatgaacattttccaatatacacccaagtgagagaatagcaaaatgaaccagacttttctaactattgaaatattataatgaggaatacaaaggaaaagatggacaggtataatttaaattttttcttccaaattttgactatacaaaactaaaagaagaatattaaattggaaacatacttagaattaatttttggtataaaatattaaaatttataatatatgcataatgtatatgtcagtaaagcaccaagatcctaaaaatgggcaaaaaatacacaccaataattcacaaagaatacaagttttaaaaaaagaaagattcagtgttcctactacttattaaattaattaattaattattattttttttttttagacagagtctcactctgttccccaggctggcgtgcagtggaccatctcggctcactacaacctccacctcctaatttcaagcaattcttctgcctcagctttccgactagctgagactacaggcacgtgccaccatgcccggctaatttttttgtattttcagtagagacggggtttcaccatgttagccaggctaatcttgaactcctaacctcaggtgatctgcccgcctcagcctcccaaaatgctgggattacaggtgtgagccaccgtgcccagccatttttgttttatatatatatatatatatatatatatatttttttttttttttttttttttaggtggagtctcgctgtgttgcccaggctggagtgcagtcgcatgatctcggctcactgcaagctctgcctcccgggttgatgccattctcctgccccagcctccctagtagctgggactacaggcacctatcaccacgcctaattttttgttttttttttttttagtagagacagggtttcaccatgttagccaagatggtctcgatctcctgacctcgtcatccgcctgcctcggcctcccaaagttctggggttacaggtgtgagccaccatgcccagccttttctgttatattttaaaagataaatcccaagaagtagaattcttgttgcgtggtgcatacaatttactaatggccaaattgccctccaaaagtactgtccagggccgggtggggtggctcacgcctgtaatcccagcactttgggaggccaaggtgggtggatcacgaggtcgagagattgagaccatcctgggcaacatggtgaaatcggtctctattaataaaaatacaaaaattagctgggcatagtggtgtgtgcctatagtcccagctacttgggaggctgaggcaggagaatcgcttgaacccaggggatggaggttgcagtgagccaagatcgtgccactgcactccagcctgggcggctgaatgagactttgtctcaaaaaaaaaaaaaaaaaaaaagtactgtccaatttatactccccacctgcagtacaggagagtatacccaatattgtgtcttactctttttcatctctatcccagtgtagtaaacatgaaaacaaatatttgcaacctctgcctcctgggttcaagcaattcttgtgcctcagcatccggcatagctgggattacaggcgtgcaccaccatgcccaggtaatttttgtgttttttgtagagacagggtttcaccatgttcgccaggctggtcttgaactcctggcctcaagtgatctgcccatcttggcttcccaaagcgctgcgactacaggcgtgagctaccgtacctgacccctactactaaggttaaaaggagaccaagcacagaggcttacgcctataagcccagcactttgggaggctgaggcaggaagattggttgaggccagaagcttgagaccagcctgctgggcaacatagggagactctacctctgcaaaaaaattttgaaaattagccggaagtggtggcacatgcctgtagtcccagctactcaacaggctgagatgggaggattgtttgagcccagaagttccaggctgcagtgagctatgactgtgctactgcactccagcttgggtgacagagtgagaccctgtttcttaaaaaaataaaaatgataaggcaagttaataataataaggttcaattttacgcctaaatattaaattaagaataaataaattgagcaagcaagctaacttatgggtggttgggctttggatatccttataaattttgaggacaactagaaatgttcataattatcagatatcacaaggaataagccaacagaagtaagtatctacaaggctaattgtaaagattataggccaggcacagtggctcatgcctgtaatcccagcactttgggaggctgagcctcgcagatcacctgaagtcagtagttcaagacccgtcttggcaacatggtgaaaccccatttctactaaaagtgttctaaaaattagttgggtatggtgacgcatgcctgtaatcccagctactcaggaggctggggcaagagaatcccttgaacacgggaggcggaggtttcagtgagccaagatagcaccactgcactccagcgacagagagagactctgtctcaaaaaaaaaaaaaaaaaaagattataattctgagatagaaaatctgaacaaccaatagtagggacattgagtaaattatatcagtttgatggatgactatagtaaaatagtaaaataataaatatggtgattgtataaaatatagaaaattaagtagaagagtagaacacaaaattatatacatactgtgattacaactgtgctgaaacactggaataaacagaaagtagatggtaagtttacattactttaaaaaatgtcctttacagtgtttaaagttgatttaataatctacaaaataaaatgaaagggtgaaatagatgattgctaaaggctttccagtctctaaaattctatgaaagttaatcatttgtatttgtaagcgtggaaagattcattattttcaacactgcagtgaaaaattctacctctacctagattctgcagggtttggaaaacaagtttatcagatcacacagtttactttaataataacaataataataacagctagagggaaggagaggttaatagtgataaataaaaccagcactgactgtccaggatgcatacttcattgttactgccataagatcctgaggctgctaaaacaaaaccaaaaaataattttttggcgtgtacatatattatctttaaaatttaaaattaaataaagattaatattaaaaagacaattagtattttgttttatcttttttttgagacggagtctggctctatcgcccaggctggagtgcagtggtgtgatcttggctcactgcaagctccacctcctgggttcacgccattctcctgcctcagcctcccgagtagctgggactacaggtgcccgccaccatgcccggctaatttttcgtattgttagtagagacggggtttcaccgtgttagccaggatggtctctatctcctgacctcgtgatccacccgcctcggcctcccaaagtgctgggattacatgcatgagccaccacgcccggcctgttttatctttttttgtgattttttgaggtattagtattacattttctatgacctctgcagttagtcttcatttcttttaggaaggattccatttttatgaaaaaacaatttcattgaaaccaaacagtagtgaaaagagtgatatttaaatatgagttggtaagtcgtttttgaatacacatatggtttaaaaatctaaaatctcttgacacttgattaaatagagagagggaggagaaggatggtcatagaaaatgaatcttgcccttgatgtgatgagtatggaatatttaagccaaaatctgtagtctcaaaggatttattgatgttttattgccagccagtcttcttccctgtttagaatgctatgtttttctgccaaacactgaggatacctaatagtttcctaagtgtttcttctgaataattaagtggattattttcagagatagactcttcttttaagtattctggggctttgtttttttcccttgttttctagcattttgacataggtgcatattatgtttttctttttcttttttagcaaatggggaaatgaaggcactgagaagataaataaacaagtttttgtgtgcgtgatttaaagagatagtctgaccattcatgtaaagtgttcagaacagtatctggccataataaatgttcaatcaacattagctataacaattattatcaaataagataaaatatgtgtagagtttgctatgcagtagaaatacaaagtgaggctgagtgtggtggctcacactggtgaaccactttgggaggccaaggtgggaggatagcttgagctcaggagttcaaggtcagcctgggcaacatagtgacacctcgtctctattaaattaattaattaattaattaattaaaaaataaataaatataaagtaagccacaaatgcaagtttgaattgtctagtaattacattcaaaaaagtaaagaaacaggcaaaattaacttaataatatagatatattttacccaatatacccaaagtaatatcatttcaacatgtaatcaatataaacattattaatgagatattttataggcttcttttcgtgctgtgttgtagcagtctgatgtgtattttaaactgatagcacatccaaatctgaatgcaaatttttcatcaaatgtctgtatttagatttcatgaaatgttcagttttcacatcaatttacatgctcaaattatttcaaacatacttcaaaaatttttccaataactaaatcaagtacctaaaataattttcctttaatatttgcatccacatggaaaaaactgattcatgttttttaaaagaatttcacttcgaagtgaaaaggctctcgcttttaaaactgcatctttccaagttaattcacgaactctcttgtcaattccatctcttgttctttactgtgccagccgtgatgcttctgctactccactcaattgtacatcagtaacgtgcctttgttttaaatcttaaaacgtagctgggtgcagtggctcacgcctgtaatcccagcactttgggagtctgaggtggtaggatcgcttgagcccaggagttcaagaccagcctggacaacatggtgagaccccgtctgtgacagagcaagatgctgtcttaaaaaaaaaaaaaaaaaaacttaaaatgtgtccatagctactttttaactagaaaataatttaattatgttaaaataactcaaacttgtgctgtctgtaaaacttcttcaaataaatacattaaaatattgcatcagtgcctagaaaaatatcaaagtgaataaatctgttggcaccaactagattagtgattacgtgtaatactagaaaagatgccacatgcttgacatgtgccctacacatacaatggttgaacaatgtagccctaccagagcaataaagctgtgtgtaatggggaaatatttcatactgcatcaatttcaaaatttaaatataattaaaatgaaacaaaatttaaaatttagtttctcagtctctctagccactttcagttgctcagaaacatgcagctggtggcaccatattggggtatagagacagtctgtcaaaagacagggtgaggagccaggcgaggtggctcatgcctgtagcaacagctacttgggaggctgaggtggagaatcactggaccctaaaagctggaggctgcactgagctatgatagtgccactgcactctagcctgggtgacagagtgagaccccgtctaggggaaaaaaaaaaaaaaagacatagtgaacagaacactttagtgccaccacgtgcacctttctgtgttagcatcagctttacagcagaggagggattgtaatgggcctggtctaattcccagttgctagctggttttccctttgttcttctctgcttctttttctgtcacaaatgcctggttctctgggcaaaaataaataaataagtatgtatttatgtatattaaaaatataactcctagcatggatttctgctagggtgcttctcactgatcatgcctccttgaatctactctgccaccatgattcgcgccccaacacctctcggcctgctttggatgaggagggccagctatgggcctacctcacagctcctcacctcagggtagggtgttctgaatagatccccacatcagacagagctgctagagaggcagaccccatctccctattgtctcataaacacacacactcactcacacactcacacacactcatactcactcacactcacatactcttcatccagctccatctgccgtaagtccgtttcacttcctctcagcttctaacattatctcatgaccatcctagtcttttccattgtgtcatgagtttctcccttttcttccctgtgccttcacgagaatcttgaatgagaaactgggagcggctgctgcatcagaaatagtaagttcctcacgtgaatcagaaatccactgtggaagaattttacagttctgtttttgtgctcttctgccggaatcagcttgaattttggaaagatgtggggacagaaccctgccctggcccagagagggaatggctgatccaaggggaggaggagttgcccacagagctggaacttgatgacttcggggcgcgggaggccccagaacaaagtgagactttgaagagagcagtgcttactctctgctcagttccagatctccgaggtggagccagttgaaatctgtgtaggaaacaaagctgcttttctggttcatctggaaagagagggctttttgttttttccccacgtgggcaaatagaggtggtgatgttgtgtttttagagccagaaggaaagttctgggctgcataatgcctatattccaggcaaatagaacccaacaaggaaaatggtctagctttatcactgactcactgcaaatcccttccctcctgtactttaatttattcattttctttttttaaatgacaaactgatattatttttaatttttaaatacttcagtgaccacaggacataatacttttttttttttttttttgagatagagtctcgctctgttgcccaggctggagtgcagtggcgtgatctcgtctcactgcaacctccgcctcctgggttcaagcaattctcctgtctcagcctcctgagtagctgggattacaggcgtgcgccaccacgcctggctaatttttatatttttagtggagatggggtttcgccatgttggtcaggctggtctcaaactcctgaccttgtgatctgccctcctcggcctcccaaagtgctgggattacagacgtgagccaccgcacctgaccttagtttttttctgacgtggtcctcttcttttatctctaagacttatgattgctaagacaacaaaagataccatcgttactggccaaccttggaatttggtcttgggaaatggaggcctgtagtttgtaacccataagaagagactgaaggggcctaagtgcagatgagaatccctggtgatagaacagacaagaactggagatcaatgccaatagtttgtgatgaacgtcttggggttcctgtgtgatcaacctgttgggatttctgtattagtttcacactcacctgtaatagtttaccaatggtgtttctgaaagatgaacatgaaattaagcgatctttcatgtttcctcgagggactttgattctaaaataactctgagaacagatcaggaaacatgatataaccctaaccatgcttgacacattttctctttaaataacagttatacttgaggagaggattttactcatgatgctgtgcaaaagccacatggattccactggtttggactttgccttagagtgggcgttgctaagtgatggataacagcagcgtgcttccctgagaggccactgtgagcctcttacttaggttgagaacttgacctcttacttaggttttataccaccataaaatgcacccatcttaagtggttagtttgatgagccatcgtttcttttaaggagttaacatttaaaatcaacttttaaaaattgtggtgaaataaatacacatgaaattttaccatcttaaacattcttaaatgtaacagttcagtgacattaagtatattcacattgttttgcaaccatcaccaccatccattcacagaactcttttcatcttgtaaaactgaaactctgtactatttagctgtaactccctcttccctttcctccagcattatcattctgctttctgtctctatgaatttgactactttgagtacatataagtggattcatgtagtattcatccttttgtgactggcttatttcacttagcttagtgtccttaggttcatcagtgttatagcatgtggcagaatttccttcctctgtaaggttgaataatattccactgtatatattccactgtatatatgtgtatacacacacacacacacacacacaccacattgtgtttatccatttatctgttgagggacacttgttttgcttccacttttggctattgtgagtaatgctgctgtgaacatggatgtgcaaacatttcttcgagttcctgcttcctgttcttttgggtatatgtatacctagaagtggaattgttggaccatatggtaattctatttttaatttgttgaggaaccaccatactgtttttacggtggctgtaccattttactttcttaccagcagtgtagaagggttcaagtttctccatatcttcaccaacatttgttgttttctgttgttctgttttgaatagtagccattctaatgggtatgagtggagttcagtgagtgttggcagatgtatatatccgggtacactaccccaatcaaggtaaagaacattttcatcaccccttgatgttgcctcatgctcctctacagttagtatcccttctgcctcaccagtgcccccaatcactggccccagacaaccacttttgcactttctagcactatatattagctttgttcgttctagcgtttcatgtaaatactttgtttggcttcatttagccagaataatgcttttgaggcttatctaaaaccctagtctaaaatcaattgtggatggaaaataaaccgcagtgtgactggagttcgatactatgctaatggttggttagagaataccatgggtctcagaaagaaagtgagaggaggagaggggggctgaggaagcaggagagggcccttcctagcaatgaggccttcaggaagcccaaagagccatagcaattaatgccagtcctatggcttcgggggcagccagttcaattaatcagcaggcatttcttgcaggcccgctatgtgcaaggcactgctaaaatttagaaacaggaaagtagaggcccaggatgagaatttggagagggaagatgctgccttagaattcatacaactggataatgcttttgtcagaggacagacacacacagaggaccttacggacttggtgaccaaaagaaccacaaaggaatctagtttgacttgttggtaaatgtgaaagcctgaactctatacgccacagatgtttttcatgtgggtagatttggtaaccccaccttaaacagctcactaaacaggtaatgctagaatactgtagatgtgataaagattacttggagagaacagtaatagaagaatagctaacatctgttgagtacacaatgtctgcaccattctaagtacttacgtgatgtaataacttgattaatttttgcagttgtcttataaaggaactattgttattaactctttgttacccatgaggaaactgaggcacaagagattataccttggcccaaatcacccagttagaaagtacctttaggaggattataaacccaggtggttgtgctccagggctccaaccactttgttatagaggaaggatggggtggtcattgaaggagaagtttccgtttatctgaatggcccatgatgtgaaattagcaactaggccaggaagttggctgcaccatagttagacctgtacttttcctttttttctcatcagaagggtggcatagatcacccatcctagggtgagcttgtgttgcccacagtgccagcaccttccagaccttgggtcagctgacagaacctaacatgttattaccaagcacactgcccagaaggcaaacccatcactcgcctgtagataggcctgtttcctagctataaagtggaggggtgggtctgatgcgctctaaagtcttttctaccctaacaatccaatctgggagaaatgcactctttctggggggcaagaatttcccctctatttctactcccattttctttgcatgcttatattgtagccttagaattactctctcatgtatggtttacttcacattttgatctgaaacagggaaaatcaaccttgagtgatcaaaagaagggttgtgcctttaagcctggaggggcgctgcctccaaaagcataagcaactgccatccagggctggaaaaaacatgttgcagctgtgccaactccatctgaggctttgaatgaaagcccataatgttttcagtttgtagcaaaagctagaagagctatttttggcattcctttctctactggtatatactggatagtcttaatattgctggtgctaaaataaacataaccagatggggtcattatatctaacctgtttcgacactggattcagataccccgaagtcatgatgcatcagtagtctctgaagcaggctgtactttgggaactttgctattgtggttggatcagccatgacctcccaacctaaacacaggatgctgggccctgttttaagggagggccacagaatgtgcttgggtggaatctttatgtcccttttagctggagatggcaaaactctgaccatgtgtctgcccaaagagacatattacagagccatgccacgttgttctcccaccagaaaggccgtatggctgaattagagcgtgtggggattagaaatgcgctgctttcttgaaatggccaccagccttgtactaaacatgtttgaccggggccatctgtctgcccgtcaaaagtgtggtccagtttccatcagataagtctggaagaggacggtttttgttgttgttttgttttttgcatccagcttgttaaaagatatgaagaacgagaaagttttagctcagcaagaaatgtaacaatttaaagtttttattctgtcatgattctaaaagcctctagaattgtcatctgccttttcacctaattatacgcatatgtacatactctttatatatatacactttgtatatattatgcatattatgtaaatatatacatatgtacacatatataatattcatataattatacacgtatacacatactatatagtatatgcgagtatatattatagcatgtattcagcatggtataatataaaggtctctaaagacaggcagacctatgaaaacatagctcttatcacctattactgagtgacctggggtactatgcttaacttctctaaaacttaaattatcatgtccagtccactggaaaataatagggcaaaatgatataatagtgacaaaacacataagcattcagtacaactagctcaataactacttattttaaaataaagtccctctggctctagaggatggaataaggaatacaaggccagctctcctgatggttacagctgcttagcagtggcaaagcctacctgtggaggagtgagcgcagggccagagagaggatgactggaagctgggagaggaccattgagaaaggtcgtaaagtctttacagcaggaagttcaaccacgtcatctctgtagcttccaggatttttttaaatggcaggttactcttaaacctacaaggcataggggatcatatactgtcatgaaaggtatacaggcggaaaggaaagtgtgccgtttagtaaatcaaatggtacctgacatggggcaggcattcagataatgtgtgttgaatgagtaggtgaatgaacatgaaacatcagtaaaactgtcctgtaagtcccatgatagaaataatcagcattactaccacatcagcttcttgtttctcaggtcactggactgaggggagggaaatccaaataatttgtctgcaattaaaaggcagaaggtcaggtgcagtggctcatgcctgtaatcccagcactttgggaggtggaggcaggctgaccacttgagcccaagagttcaggcccagcctgagcaacatagtgagaccccatctcaaaagaaaagttaaaaaacaaaaaacaaaaaaaaacctccaccaacaaaaaaccagccaactgaaattccaaaggtctctagtccacaggtggcactaggggtcactcagaaaataaaaattaaaaagaaaattacttaggaaagtctaaagcactatattgggtacttcattatatctgaagcaagttgatgatggtgcccagaaaaacaaggtagggaagctgcacatttataaagcgtattagaatattctttgatttatgcactattcgaagcttgagcctgggaactaaggccatacaacaaagcaaggattaaactatcaacatgtgggacccagtcagctttcccagcaatcattgaggccactgtgactttccttattgttataaaatgtagatatttagccctacctcttaagacaagatagaactcaccacaaccagttttcactactgtagtatctagtggctttcaaatcaggtaaactaggtgttttatcccagtctggcctcatgctaacttcaggcaaattacacaacttttctcagtttttaacttgttaagtggaaataatagtcattgtcccagaggttattgagtagataagataacatggaggagtgtttaataagtgttccctccctccttcccctgccttttagacaaagcaatcattggagtaaaaactggctttggcatgatgtgggaagagcagagaaggcgtgggatgttttaaattatatgtaaaatacatttttttatttttttgagacggagtctccctctgtcacccaggctggagtgcagtggcgtgatctcggctcactgcagcctctgcctccaggttccagcgattctcctgcctcagactcccgggtagctgggattacaggcacgtgccaccacacccagctaatttttgtatttttagtagagatggggtttcctcatgttggccaggctggtctcaaactcctgacctcaggtgatctgcccacctcagcctcccaaagtgctgggtttacaggtgtgagccactgcaccaggcctaagatacatgttttttaattacttgtggattgaaaggattattattgccctcaacagtgctgtgaataactggccaaaatatggacaaaagaccgtccgtaagttactagctgggtgctaggctggaatcgattcttatttaagatggcctagtaggcaggcctccaaatttgttttcattcctttaccttctacatcttgcctttgaatacacgtttaaaatgttatttctcccaactcaaaccccgtcactgcaataaaacttcctttacttttagaaggatctaagttccaagaaaaaaagaaggaaaaaaagagagttactctcattttcctatttcatagacagttttgaaagcctttagtgtttgggtggggcccagtcacaccctttgcaatctgcagaccagtggtttaaatttgtcatccttgtgggctgtaaaatgaaaccatgtaccaaagaaaaatagtgaatgactcactcacatgtgatcttccagcgaagggaaggattcagtaggaatgtgccacaaggctggcaggtcccttcataataggctcaggtggcctgttctgggatgtgggtcaatgttaggaacctgaatggaggccgccaagttgtggtggggtctgaaggagagcttcagttaccggggtgaattcaccacaatgcaacatccagcagacccagagaaactctctctcagcacgacaagaaagggaggattcctattcaccaggctcattaaacctgtacgcacacacacatgcaaacacacacgtgcagacacacacacgtgcagacacacacatattgctaatttatttatattaagaaatacagtgccaggcatggtggttcacacctgtaatcccagcacgttgggagggtgaggcagacgatcgcttgagcctaggcattcaaggccagcctaggcaatgcagcgaggccttgtctagaaaatttaaaaaaaaaaaaaattagctgggcgtggtggcacgtacctgtagttccagctactcgggaggctgaggcggcaggatctcttgagctaagtagttcgaggctgaagtgagctatgactgtaccactgcactccagcctgggcaacagggcaagaccctgtctccaaaaaaaaaaaaaagaaaaaaaaaaaaaaaagaaaggaaaaatattatttaggcaaaaatcctcatgctccaatatttgtagacaggttgatttgggaagccaaactctagcctaaaaggtgcttggcaaccatggaacaagggagtattagatggacagaattcatcttcacagtggggaaatatctgacccccgaccactggcttcaccctttccgtaggacagggcttagatgaatatttcaaagtaagcatctgtgccagttttgcatggagcttgctctgctgatggacacaagttttccttaaacatgctaatatcttccagcaagcctgcttcaacccaggagccgttctttcccattaaaatgagtttgcatatctttgttttgatgggtgtttgctgattttactagtctaatgcttagggaagtatctactttgcccgctttccaaatgctgggtgagagaggagaatgcaccacactgttacctccacatatagcctactaaataggacttgaaatcagaagttcttgttccacatccctgcagtctgccataaggacataagaaactttctagttgagtcagcacctggcttgcccatttctggcagatacaactgggcaatttgtgttacagtgtattattatccttctggacatcctggaaaccagtatagatgtattctcaacatacctactttttctttatgaattcattgtaaattatttccatgaatttatgtaatcttagttgaaataagttgaacttatttacaacttatttttcccttttgtaactgctattgagataggtctcatatgtttaattcccaactatctttcagttgctccaaaactatgtcttaaaaacttcagatccctatcctaagccctagtcgtagagttcagatactgttaagaagctgtagtcacccacccatgttcttcataaccctaggtttttaagacatcactaaaaagtgtatcaccttcagccttcatctttccatctggaacagtcctgatgcttttagagttatttgaatcacccccaaaatgggagcgtgtttgcattttacagatgtaaaaactgaggcatagttgctaattatttcgccccatctgtgagcagcaaaggagcttttaaacccccaacacagtctgagtcattgtggacttggtcacaatgtgcagcttatggattgtagaaagggcttcagagagaaagaacaaaggaatcaaggaaggtgagatagcaaagaatgtcgggcagaggctctgctaagagcatggcactgcgaggcaggtggaaaatgaggtgggaaggttataggtggaacttccagaagaaaggcttttcagcccttgggagctgtcattctgtgcagctaagagaggccttagcaattgctaagagaggctgtagcaattgtgttttggggggtgcatttctttcctctttctgctccccccatccttgtgccaagagttattgaggccttaccaggtgccaggctctatgctaataagcatttgtgtagactgactttacacatactatctgatataacaatgaatcgaggagtaccattttctgcatttatttgtatattctatttagaaatctgtttggtggccaggcgcagtggctcacacctgtaatcccagcactttgggaggccgaggcgggcagatcatgaggtcaggagatcaagaccatcctggcaaacatggtgaaaccctgtctctactaaaaatacaaaaattagctgggcatggtggcaggcgtctgtgatccaagctacttgggaggctgaggcaggagaatcacttgaacccgggaggcggaggttgcagtgagccgagatcatgccactgcactccagcctggcaacagagcgagactgtctcaaaaaaaaaagaaagaaagaaagaaagaaatttgttttgtactagtaaaactttaataaataaacaacagctgtctgtatataaatgtgtatattacactgtgtgctgtccaagtttcaaaataaattgaataaaagtacccagtgttcaagtatgataccttctttttccttaagtgaaatatttctagctccttgtgtaatgactctcagtatttccagaaggctttgctcaagatgtctttccacttcttgatgtggtaaaaaggagtggaatgttcatattaaagcttgcctcttttggagaggtgtcccccttccctgcctcctcacttgtcatttattccaaaactacatgaaagcaaagggaaggcccttgctctgaaaagcagtatctgccagggttgtcagccaattagcatatgaatcatacttaccaagggatatgggtacatgtggatcattcacatgacatgaaacagggcctccagaccaaggactggctaagatctgtgaaggtcttaagttttgcccctgattttttgtttgtttgtttgtttatcaatatttgttttattctcctttcttttcttttcttttctttccttcttttttttttttttttttttttttgttttcgacagagtcttgctctgtcacccaggctagagtgcagtggcgtgatctcagctcactgcaacctctgcctcctgggttcaagcaattctacttcctcagcctcccgagtatctgggattacaggcgtgcaccaccacgcctggctaatttttgtatttttagtagagacggggtttcaccatattggtcaggctggtcttgaactcctgacctcgtgattcgcctgcctcggcctcccaaagtgctgggattacaggcatgagtcaccgcgcccgtcctcaagcaattcttgtacctcagcctccctagtagctgggattacaggcatgccaggctaattttgctatttttagtagaggcagggtttcaccgtgttggccaggctggtctcgaactcctgacctcaggtgatctgcccgcccctgcctcccacaatgctgggattacaggcgtgagccatctcaccctgccctatgtgttaataaccatttaaaaatttccaccctgctaagactagtccgtgactctctgtgcctttctccattcttctcttaactaacctcatgtttttattagcatctgtaagacccataaggggaaactgagagagaaaattcaataagactcccttggttttgcagcagtaaggttatatgaggtgtttatgtaaaaggagccccccccccccctttttttttttttttgagacagagtttcgctcttgttgcccaggttggagagcagtggcgcaatctcagctcactgcaacctccgcctcccaggttcaagtgattcttctgcctcagccttccgagtagctgggattacaggcacccgccaccatgcctgactaattgtttgtatatttagtagagacggggtttcatcaggttggccaggctggtctcaaactcctgacctcaggtagtccacccacctcggcctcccaaagtgcagagattacaggcgtgagccaccgcgtccagccaaaaggagcccccttaatcacagcgtttaccatgacctgggtaacaggcatattcagcagacaaataccccgatgatcatcaagccagtcctctgtggtttgcatatgaagcacatcagctgcttcatcaggggtattctacttggcatttataaggggagaggaacagtcccccttctcagggtaaacagaccttagtgtggcttttgtccagtccaccaggctggatgttctctcaggaataacctcctatgtgtctggaccacctgaaacatctgcgattgctccatagagagctgtgggtcctgcatcaacccaaacatgaatgctagcattttgaatactctgcagtgttcgaaacctaagacactgtcactcacttagttactcacacaacccatttgaataaaggttcttcaggaagtttatgatactgatctacaaaatgaaataacttcttcacactataccctgtggtttcaatcgtttcatggtttgccttccaccccacataaactgccttcttggttaccagagttcttagtgatattgtctaatctcagcatgattttgccattggtgggtggctttgcagttactggctagagcgcagactcactgaaatctgagcttggtctgacccagcactctcttttaattttattttatctgttacagataataaccaagggactgaatatatcgccttttcttattagtttgcatttccttatgcttccagtgagccaacaccttggggtagcttttacctttactaacagatctcagcatggtatgctactccgtaccatgagtggctgttaccaatgccatgggttcttgtaatcacccaggatagaaatcaagagcaatcaccatacatagcagcaaagagaaagtttgttttggctcatgcacaagggagccagtgctgagaaaggaaaagaaacagactgctatcggaggatagtgtgtgggttagttttatagggtctttccatgggaaagggttacatcagagcatgtataggagaggcttttctagcactcatgcttcttcatgcatcatatgcaacattagtattttaaatctccaccccatgcatttttagccttaaaatgaggaagggtaactgtaggttggactttaagtctagctatgcatgcagggctccagggaagtccccagccccctgaaataggaactcgtggttaataagcttcttgggtcttttgttattaattggctgagagttagataagttaaagcttgagtgaatggcttctatcattttcttccaggccattttatttatttttattttatttatttatttatttatttatttattgagacagagtctcactctgttgcccaggctggagtgcagtggtgcaatcttggttcactgcagcctccacttctgggggttcacatgattctcctgcctcagcctcctgagtagctgggattacaggcactcaccaccatgcccagcttaatttttatatttttattagagatagggtttcaccatgttggccaggctgatctcaaactcctgacctcaggtgatctacccacctcagcctcccaaagtgctggaattacaggcgtgagccaccatgcctggcccagaccatttaaaaatagggaacccaccagcctgcctatctcatgaccatgtggccacccaggaatcaaagtttctcatccccaacccttttgttctttctcttcccaaaccacatatttctgcaagccagggccattctagcaaatcccacttctgacaccaattgtataggaaaacaaactatttttccttatactttaacactttttcacttctagcaccagatgtgatgggtgagggggtggggtgggggttcccacatcaagcatcaagcagttcttcagttctctttggacaccaactgggtgtgccacaatttaactaaattctgacactatcaagttagcacagaccccactggttaaggcaggggtgtccaatctttcggcttccctgggccacattggaagaagaataattgtcttggaccacacataaaatacactaacactaacaatagctcatgagaaaaaaaaattgcaaaaaatctcataatgttttaataaagtttatgaatttgtgttgagccagattcaaagctgtcctgggccacatgtggcccacgagccacaggttggacaagcttgggttaagggatcagtcccacagtcctccaccacttcagatgccagtgtcaagtccagcttgtcacctgtgcttctgatggaatggctagaaatcagaggttcccatgaccccctgttgactttcatcatttgctagaatggctcacaggactcaggaaaacagtttacttactggattatcagtttatgataaagagctacagatcaggaacagccaaatggaagaatgcatagggtggggcacgtggggaggggctcacagcttccacggcctctccaggcgcacgtcttcccagcacctccatatgttcactaacctggaagctcttcaacccctccactccctatttcccactgtcctttgggtttttatggagtctttgttacataggcatgattgatccaatcattggccattggtgatgaaatcaatctccagcccttctctcctcccctgaggtgagaggttgggctgaaaattccaactctttaatcacagagtttgtttaccagggcaaccagccccccatcctatagttatctgggggctttccagacgtcccctcattaacatgaactcaggtgcggttaaccgggcttgttatgaataacaaaagatgctcctttcacccttattgttcttatcgcttacaaaattccaagggatttaggagttatgtaccaggaacaggaggagaacaggtgtatatcccttactctaagtcacaatattatatggcctgactgcatcttcatctcatgccactcttgcccttgttcacaatgcttttgtccatccttcaaacacagtaagccaatttctgctgcagggcctttgcactgactgctccagctacctgaaagagttctccttcagaattttgaacggctagccccttcccttcattcaggtcttagttcagatgtcaactcagagatgccttccggatcgccctgcccaggccagcttcttcctggtaacctgatcctgtcatcctccatgtcaggggtcagcaaatgttttctgtgaagggccagataataaatattcttagcttcctgggccacatggtctctgtcacaactactcatttctgctgttgtagcttgaaagtagccacagacaaaatataaacaaacacgtgtgactgttccaataagtcttcgaagtttgaattttgtacaattttcacatgtaataaaatatcccttatttgattttctggtcaattatttaaaaatataaagacattcttggcttgtaggttgtacaaaagcaggatttcacccatgagctactgtggtttgccgacccttgctctgtgctatcatcctgttatattttcatcatctcgccgaaatcagaaattatcttatttattcgttctaaaatttgttgttggtggcaaagaggttgaatagaagttataagtaagagttaaaaatatattttaaaattgtcaaagggttttagcagcctatgctgggcctgttaatatcagaactaattagagttagccaagttacaatgcatctctacagtggatatcaatactgtcaccaagtcaactgtctctggagtcagaaaaggcctggttgatgtatatctggcatttagaaagtaaagttgggctgggcgcggtggttcacgcctgtaatcccaacactttgggaggccgaggcgggcagatcacctgacgtcgggagttcgagaccagcctgaccaacatggagaaaccctgtctctactaaaaatacaaaattagccaggcatggcggcacatgcttgtaatcccagctactcgggaggctgaggcaggcgaatcacttgaacccgggaggcggaggttgcagtgagccaagatcgtgccattgcactccagcctgggcaacgagagtgaaactctgtctcaaaaaaaaaaaaaaaaaaaaaaaaaaaagagaaatcagagggccaggtgtgatggctcatgcctgtagtcccagcactttgggaggctgaggtgggcagatcacttgaggtcagaagttcaagaccagcctggccaatatggtgaaatcctgtctgtactaaaaatacaaaaattagccgggtatggtgatacatgcctgtaatccatctgtaatccatctaccagggaggctgagacagaagactcgcttgaacctgggaggcagaggttgcagtgagccaagattgcaccgctgcactctagcctgggcaacagagcaacactctgcctcaaaaaaaaaaaaaaaaaaaaaaaaaaggaaagagaagtcagaatgaatccttttttttttaatgaaataaggggagccaagtaatgatttatattgtggaaagagcttgaaaattatgtttgtaaaagctatttgtcaaaagataaagatgtctagttatgtaaaaaataaaataaaataaataaatgtgtcgtctatctctcctggtagactataaatgccttgacagcaggttcattgtcttatccactgcattatctctatcagtgcctggagaggtgctgtgagaggtcatgtaggaacatttggtgattgaatgagtaaatctacacagtccatgagtcactacttctgataaagtcttccttccagacatcccccatatatcatattccagtgccacaccctgcccaagcttttgcctctacccatctgttcctgtagctgtctctcaagccttcttaactccttctctctcactccagtctctctctttccagtttaccctatagtaaagtacagtaccttgttaaagcttttcttttattatggcatttgtctgcaaataacaaaaaactttccacagtattcccatgacctatggtattctgtagccagactcctcagccggccgtgcaaggcccataccattcagttcactttggcttttccaaccttgtttctgagccttccctggaatgagccctctgctgtcactcccgcatttcctcattattcctgaaactgcagctcattcccacctctgtacctttgctcagggtgtgtcccaggactagttggttctccccttagttgaacccccaggtaatagggggtaagtcggcaatgaatgatgggaaacaggaagaatgaaactggaaggtaaaaagcaaatgtgatcaaacaaggcctaaatggtaatcaggtgggttaagaaggacttagttatcatcaaaaggcacactgcttggtcagattatctagaccagtgcttttcaaactactgtgcaggcaaatgtttggggaatcttgtaaaaatgcagattctgggagtaggtgtggggtagggacctgagattctgctttttttctatctctctcttttgagacagtgtctcactctgtcacccagactggagtgcagtggcatgatcttggctcgctgcaacctccacctcccaggctcaagtgattctcctgcctcagcctcccaagtatctggaattacaggcgtgtgccactaccccccagctaatttttatatttttagtagagatggggtttcaccatgtgggccaggctggtctcaaactcctgacctcaaatgatccacctgcctcagcctcctaaagtgctgggattacaggcgtgagccaccacgcccagccaggttctgcatttttaacaagttcccaggaatgcatgtactcctggttctaggatgactctttgagtatcaaggatctaactaaactctgagaagaggagccttatccaggtggttcgcacctgtagtcccagtgactcgggaggctgaggcaggaggatcgcttgagtccaggagttcgaggctgcagagggctatgattgcaccactgcactccagcctggacaatggagggagaccctgactcaaaaaaacaagaaaagagaaggtgccttgtttatatgacttagatatgggaataggaggtggtgggctgccattaggggactgtttatgtgtcatgagaactccacaagagtcctagactacagtgaagacatttcttgcattctgaacaactgaaaaaaatgtgtgatgatgatgaaagagggggtgctgaaaaccgaggacaaagttgagtgtataagcctgcagcttaaagggaagaaaatctttaatcctagaatggtggcggtgaaaatcgccactgggaaacgaaaagattctaatgttggttgggctgccggcctgtcattacacacacacaaacacactcacacagatgcacacacagaggggaggctggtatgctgtactttcctctgatgcagttggattatctcttttctcaaagggggaacctcttctgatctgctgtaacattcagttcagaatctgtgtccagcttgagtacaagtattggtacttaacctaacaaaacaataggaatcctttctgtagtgtgtatctccaaacagaagaacaggtgggaaaatattttaccagtgtgataaagttgactttttttaacagtttctctaattagcccattccttgtatctttggctaatcagtaactggccttttgattaagttgggtgtcatttcctcatggcttagcttcatgcaaactgcaagttatcctgattaatgattttaatgccatttccttcatcacagtaatttcccctctgcttttatcacagaagaacttctgcttgggtggctgaactctgatcttgacctagagtcatggccatggtaagttgtgaaatacctcaaccctatctggtgccagctgccaacaggtacagaatgtgggctcagcaactgttagcttaaacaaagcattgtttactcaacagaggggaaggaggaggacatgaaaaggcaggtctatttctaaacatcatttaaatttcttttaggggtggtaagcaacttgaccttgaaaactgattcaaagagagaattctttgaattcttttaacatcctgagaatatagaaacaagttgtaattttctgtctgcagaagcgctacatgtttattttagaacatttaaaaaggaaaaactaaaaattctttaggttctaccacctgaagaggactgctatcgatactctgaggtagccacatcatttcaggctcatcaagaggggtgtttcttaacaatatgggtgtgttggctgcctcctgctttagacagtaatcagacaccttggaccttggttatttgctctttggaacaagcatcgaattgaatccctttgagagttctgtaaagttcagctctgaggtggaagctgagcctcttagctgaaaacatggctgtacctaaggctggacatctgctctccttctcttgcccaaatacggtttctgaatagacaagtaattctgatccgtggtcttctggaggaagcaataatagaagtagaaatcttatacctagagaggaactggagagcctgacagcttgagatgccttcctttaggaagatgggtgtgtaaagtaaactatcctgaacaaagagtaatatactcttaatttcttttgcattagatattccagaattttcttcatgatctctgacagtcaaaggcttattcatgtgtgccccaaatctctcatgctttagtttaaaatcattttcttgctgattgattctccctggccatggagaatttttttaaaaatatttacgtatttttattttttatagagatgaggggctcgctatgttgcccaagctggtctcaaactcctggcctcaagcgatcctcccaccttggcctcccaaagttctgggattacaggcatgagccactgtgcctagccaacgtggagaatatttattcagaaatgcttatggtgcccctactttgtggcagatgtgggactaggactcagaattaatgagatgctcttcctgtcttcagcaggctcacagctttcctacaaatgaagactgtaatcaagtggccctttgtgtgctttccactcggagaaaattacctcagttgctctcatctttcctcctaaaacctgtttttctatcatgactattatttattgacagataaaggacattttaaaaagaaaatcacactatacagtcgcaacattggaaacaccaactatttgccattttttaattttagaccttactcatatgtataatgatttttaaataagagtaataagagcataaataatagttttgtagctttccttgtaccccacttagtataggaaaataggaaacaagttattcactctgatcttatgctttatctcttctctatgctaatgagataatgtaatgtttatattacatttcatatcattaaaattatttactctagtggttatgagtgttttaattttcttcttaatttatttttatttttattttttttgagacagagtctcaatctgttgcccaggctggagagcagtggcgcgatcttggctcactaccacctccgtcgtaggtttaagcggttcccctgcctcagcctcctgagtagctgggattacaggcgctcgccaccacgcctgactaattttttgtatttttggtagagacagggtttcactgtgttggccaggctggtctcgaactcctgacctcatgatctgcccgcctcggcctcccaaagtgctgggattacgggcgtgagccaccgcgcccagctttcttcttaatttttaaaaaattttccaaattctctataatattttttaaatcattgtattcaagattttaaaacatgttttatggaggtataattggcatatagtgaaatgcacatcctttaaggttactggtcgttaagttttgacaaatacatatatatacccacataacctactctcatatcaaggtaggacattttatcattcctagaagctcctccatgcccgtttcatattaactccccttcccaccctccactccacacaagaaatgcaactgctgttctgagtgttatcataagttagttttgcctgttctagaacatcctatatattgaatcatagagtaggtactcttttgtgtctgacttctttttctgggcattatattcttttgcaattcatccgtattgttgcatcagtagttttgttcctccattcctttttattgttcattagtattccattgtattgtactctgatctttttggcatgtatcttcttcattattaatgtaataacaatatttcatcaattgtgatatggcacctatttctatctattcatttttgtcattccttcctatatcctctctgtttcctttgcctgctatcacaatgggccctcttgggacagaattccctgtcttcccagaatggataatggcctattatactctgaaattcaatcaatatggatatttatcatgctaacagggaacacatttcttgatctctttcttggagaaaaagagtcattaagaatgctaactgataaacggaaccacccttgccaattcctctatcgattcaccttgttatatattaatcctaatccatagtagtgtcccacagcaacgcagtttgcttaaaagttgaatgcagtgtttgagtgccatccaaaaatttttcaatacggaatttccaaaagaaccttgtgaaacattcaactcagaaagctgtctcatgctggggccaacagccatgttggaattctgacagcaagtcaccaatttgcgtattactactgatatataatagaagaaaagaagtaaagtgcctctgttagtttcttgaggctgccaaaataaagtatttgcaaaagtaattgcaccaacctaatagcacaaactggatggcttagaatagtagaaatgtattgcctcacagttctggaggccagaaatccaaagcaaggtgtcagcagagccatgctccctttgacacctgtgcagaagccttctgggcctcttcctagcttctgggggtttgctggcaatcctagctattccttggcttgctgctgcataacttccatctctgcctttgtcatacggtgctcaccccttgtatgtctctgtcttctcatatccacatcttcttataaggacaccagtcgtattggattaggggcccaccctacaccagtatcacctcatcttaactgattaatctgcagtggccctatttccaaataaggtcacattctgaggtgctggaggttaggacttcaacatgtcttttttgaggggggagatacaattcatccaataacggggcccaaggaagtcgatgtcatacatgtctaccttcctctgtcagacatatagagggtgatgaccaagtgccaaatgcttaccatatccagaacatgaaagcctggtcttgcagcagagaaggcccgtgccctgggtacctgaggacttggatgggcttgatgtgggccactatgggcctgagaggtccaggccagggtggtctagtgcagtaagctcaagtcaggctcaccagagaactgtgctaagggtataaaaatcctccattcctttagatggcccatattacattcttggatccaattagattatcagaaaactttagctctattccacactgtttatgccaccttgtacaaatgctccatcctagattctgctttggcattaccccataggcttgtgtggaggtataatacaagaaatagataaaagaatctcattattttatttattatggaggtacagctgaagttctctttgatgatgatgatgatgatgatgatgatgtttctgagtttttgttttagtgtttacttttttctgggttttgtgctaagtgcattcctgtattatcctgtttctgtgagttattattcgcaacatacaagtgagaaaaatgaaacgtccccaggtcacacagctagaaagaggtaaagataagattcataccccactccagtgcttatgctccttcccactaagcttcttagaccaagcgccaactactccctccttcctcagcctctggacagtgctcgatcctggatttcctatgagctcaaggaccaccccttctcagccatcctttctgggctctccccttttggacctgtactgttggagagacccaggcttatcctaagtccctgttccctattttcactttctttccaggtcatttcatcaagtaccacccaaatgctgatgcatcccgactttattatactggatgtgacctctagacttataccgtataaccaattgtctttttgacaattccacttggatatttaatggacatcccaaacttaacatttccaacatagaacgtctaaatcccactccacactgccactctgaatctggtagtcttcctccagttttctccatctgggtaaatgatacccagctgctcaggggaaaagatttagagttatacttgattcttttctttcctcacctcccacgtcagtccatcagcaagttctgtcgcctttgctccaaaacatgtgctgagctgtctgttcctctgtttatttccatcttaactatttcaccctagtctagctcatatcccacccccagatcttggcccaggctctcaaatggtctctgcatctctctacagcagcccagggggatcttttaaatagataagtcagatcacatgtccctatctcctttctcaaaacctgtcggtggctttctactgtacttagaataaaatacaaactccttacctggtttgaagggctgccttgctctggccccagcccacccctctgatttccttcttttttatttttaattcatttatttaaatatttttattatggaaaactttaaacatatacaaaagtaaacagaatactataaggaacccctttgtgtacctatcaataattattaactcatggtcactcctgttttttgtctttgtttttttgagacagggtctcactctgtcgcccagattggagcacagtggtatgatctcggctcactgcagtctccacctcctgggctcaagagatcctcccacctcagcttcctgagtagctgggactacaggcctgtgccaccatgtgtagctaatttttttgtatgtttttgtagagatgaggtttcaccatgttgcccagtctggtctcaaactcctgggctcaagagatctgcctgcctcagcctcccaaagtgctgggattactggggtgagccaccacatccggcctgtttcttctttatatccacttcctcccctttctctccacctgtgtgattttgaagcaaacccaagacatctcatttcatctgtaaactatttcaatagattaaacctcttttaaaaatgaaatatcaccataatgccattcttatacctaaaaatgttaaaaccaagtcgttagtgtcatcaaatgtcaagtcaatgttcaaatttccatcgtctcataaatgtcttttgctttttactgtttaatttaggatccaaattatggtactacaggttcacattatgatcattgatgttccttttcatatcttttaaactgtagttcccttccatctctctctctttaaattctccttgcaatttatttgtcgaagaaactagatcgttttttaagtgctgtgtctgagagtctggattttgctgactgcaaccctttggtgtggtttaacattctcctttctcctgtttactggaaatttgtttttggctctagaggcttgactggattcaggtttgatatttttcccttttggggagaacagggttccacgttggtgtagtttgtcttccccccactccttgcccaccaacttgagccacactggcctctgtcctgctttccctacaaactagttccggcctcaggacctttgcaggagctgtttcctctgcctgtaacccttgcctccatctttgcatgagcagctgcttcatttcattcagctcttaacctcaatgtcactcctcagaatgggtcctgcaggacctctctatctgcttcacagcaatgctcacccctaggcactttatggaattgtgaattgttggcttgtttactgtctgcctcccatgagctagagcatcagtcccggggagcaagagcttaatttttcatggtcactactgtacccctagcacctagaataccatctaggctatggtcagtgctcaacaaatgtttgccgaatgagatgcctccgtgttggtgagaggctgcctctcagtaacatcactctcttgtgtgctcaggcaaccaaaggaggtactgtcaaagctgcttcaggattcaatgccatggaagatgcccagaccctgaggaaggccatgaaagggctcggtatgtgtcctgctggaagtgaatcctcctgcgtgcattgcacatcacagggtcacacaggagggtgccatgtctgctggccatcacgtgggtcttcctttaataaaacacaagggaggctgggtgtggggctcatgcctgtcatctcagcactttgggaggctgaggtgggcagatcacttgaggccacaagttcgagacaagcctggccaacatgacaagaccccatctagactaaaaataaaaaaattagccaagcgtggtggcacacacctgtaatcccagctacttgggaggctgaggcaggagaatcacttgaacccaggaggtggaggttgcagtgagctgagatctcgccatggcactccagcctgggagacagagtgagactccatctcaaaaaagaaagaaagaggctgggcacggtggctcacgcctgtaatcccagcactttgggaggctgaggcgggtggatcacgaggtcaggagatcgagaccatcctggctaacacggtgaaaccccgtctctactaaaaatacaaaaaaattagctgggcgtggtggcgggcgcctgtagtcccagctactcaggaggctgaggcaggagaatggcgtgaacccgggaggtggagcttgcagtgagctgagattgcaccactgcactccaggctgggcgacagagcgagactccatctcaaaaaaaaaaaaaaaaagaaagagggaaagaagggaagaaggaaggaaagaaggaggagagggagggagggagggaaagaaaacacatggaacaagttgagataagttgggacaaactggatggggaggggcattagttcttcactttaataaagaatgataaatttaatatactcattatggatttcccctattgtttaaacctgctttgaattacgacatcatgaatctgcatattaaattttagaaatgtatttgttttccaattagtgctggtgtgtatatggtgccacagatttacaaagcagtttcacagacattatctcattggatatatgcaacaacctgtgatttagtgaaagcagctattcctattgttattttagccccattttacagatgtgaaactgagacccagagaggccgagtaactctcaccaagtcgcacagtgagtgaaactgagccatggctcacactaggcagatcccatctcaagctcggggtcatcagcactaagtccacattcttgccttgagtccgtctgcttgttgctgtggtgatagacacagctgtgacagcaccgacatgcaatgtgtggaatttaatgtgagaaggctggtgaagcagccttgttgtctggggtaaatactaaggtttttggtgtcatggccaaggagattgaggttgcagacagacacacacacagtgagtttggagcaggagtttaataggcaaaagaaaagaacagctctccatcacagagaggggtcccgagcgggttgccaagtggtagtaaaattgtcagggtttttataaatgggctactgaggagggggctcatgagcagaggaggtcttatcctcctagggtccagtggtttggttgggaccaggtgtgccttctatatagagcagagtttttttaaatcagctcttatcccattctctgaccacatagatggactcttattctgtgtttctttgtcttgcttatctgggagggagagtttctgtgtctgttcccacacatcttcttgcagctgcagacatccacccaagtctgtttttagctcctcaatcttactgcgcctaaagggaaggaatatgcttattaagacccactgttttactggggcccactgtgtaaatgtgaagtttggtgattacccaggagacttccccctccctttctgtgctcaagccatcttctctgtgttttacagcctgaactttcaggctgcttgttgttagaagagaagtgctttttttttgaactgcatgaggttagaaagggagctatttttgagctgctttttgttaaaaggaaagttttctgctggggactcactttaccctaaatgtctacctaaatcatttctttctgcctcctataacatatttcccccctcaggaatgaaatccataactgctgctaggggaaactgggtgacgatttcttctggctacttcctgctggagagtggcgttgtgtggggaacagcagctagggctcctcctggggttgatttaagggtccctcgtaggagggcagtttcattttcggctccattttcagcaccatctgaagcttgatggtttctaagcgagaagagataaacttcacaaggaggtttagaatataggttctaaatatgagtattaagattactattattaatgggggcactataggccgtaaccatgacaacagagtttgtttgatacctgtgagccattcagatgggttgtgctgctgtaagtgggtatatggggcttggctttgtttagcttccttggtcttactttcccaaaaaagggagaaaccctggggttctagtttacctggcaggatttgtaggataattgcccagaactagaacatgtttccagatttttctattaccgatgcctttctgttttctctgagctgcagccagagattcctggttggttgacaggagtaagcagggttagtttaaaatgtaggcaagaacttaaaaacaactgatgggactacaggttaataacagatgtatgataagtcttaaaacataatttctctttctctagtcctcatttttgttaaaaataatctatgataggactgagttgtttgcaaaacagacttcagtcctatacttggcctaattatttgcataaagtacagcaagaataatcatccttacataagcctcttagattggctttgatggaaccttgttccatgaggaattttagataggactttttaaagccaagcccagccataggtttgtacttttaaatacctgtgagttggataaatttttttccttcttgaggttccagaagcatggggttcctaggcctgttagaaagtgacattctttactcactgcaggtcaggaaccctgtatggagactgtgtagacagatatgaggccagttttccccaggggcttttattggctcagcaagttaagcttgattccttaaagggaaatatacccttctagtcaaagccttggtaaaacaaccagtttttccaattgtgttttgttgcaagagaaaatggattcttgctgcactgattcaaacaactatattgttgtaatttaagaatatttataactagtttccaaattctacaggaattaggcagagagacataaacatgctccaaactttgcctatagtagtacactttgcttagttatcaaaggctgtagctagcttaagacaagtttttttgactctaaaaaataaaataaggattagccgtgttctaagaataagtgaagaatattgctttagttttctattagttcagttcattccattaacttttgttttgatatttataaacattttagccttttatgagtcccatacattttttggtcatgacaaacctgcattggagagaacttgttaaagtcccatggcttgattatgaaccatcttttgaagagaattaaaacaaaacaacaattgtctgtaaatgacaaaatgtccagtttggatacagtcagaaatacaattgacaaagaaatttggttatttttgtgtttttcaaaaacccagcataacaaccttaattgtaatagcacatattcagacactagaaccatagacatcccatacagttttggaacacatgttaatattattccctaaagtataacctgaagagtattagacatcattttggcaattttatgtacctcaacatgttaaataatactgtttacctctcttctagatgcttcaggggtcctctgcagcacccaaaagccaggggttaggaaagacagacttgagactaaagtttgactttgggaagcctgttaagtatatttaaaatttaaaacacttgatattatgaaatagaattttagattaccaaaagtttttgtttttgccaaaatgttgagccagaaatttgaaaaagcaaaaaccattcattagccttttctattccatgaaaatcccgtgttaagagagaaagttaaattttacccttgcattagtttgctattaatgttaaacttaattttaaatgaaacattatagacaatcctatttaattttaaccagtttgaccatgaagtgagattttcacatacctgttataacccttgacaagttttgctaaagagtagattagcattttaagaaaaccttgctgtgcttttatttcagtgattaatttacagaaaaaaaccatataatgcccttttgcatttagttaatatgtttacacgcagtgtttttttttgcaagatttttacagtttttttttacaatttgcttaaaccttctactttaagacaattctttatttctaagcaaaatatacatttccatgccctcttataatctttaaataaaaacatcttttactgtttttacacactttccatgtaattccatgttcagtagtttcaatcacatgttataatggtaacttttagtaatttttaactttaatgtaaaacctgttaggttgttttaattatgtgctggatgcagataatgtttgactcctttcagcatagttaggggcttggttgcttccgtatgttcccaggtgctaccaattgtgaagcaggcacgttgatagtttttaaaggctaaataaagaagtagttttatggccagtcgcaatggctcctgcctgtaatcccagcactttgggaggccaaggcgggcggatcacgaggtcaggagatcgagaccatcctggccaacatggtgaaaccccgtctctactaaaaatgcaaaaattagatggatgtggtggcgcgtgcctgtaatcccagctactcaggaggctgagacaggagaatcacttgaaccagggagtcagaggttgcagtgggccaagatcgcactactgcactccagtctggcgacagagcaagactccatctcaaaaaaaaaaaagcagtttacaaccttaaaacatttagcaaactagtatttgacctgcataatttagaccacatttttataccttgaagacatttgtattttaccaataattcctaagactctttttatttttaaagattaaagtcacatgaactgaaaggtaccacagcttttacttttcccttaaaaatgtttgatttaagcgcttatttttcttaggccaattaattagagctcctttttttaataggcattacacaagtaacacatatataaccacacaaacagaagaagatccagcagttataagattttgcatttgccaatgtcccaattggattattggcctctgagtgaggttctttcagaacagagctaggaatacagcttccagggcctaataagcaagcatagccagaagacaaagacgattttgagaggtatttattcacctttaattccaggggctccgaggaaaacagatttttcctaaaatgggatttgtggtgcattttctgtttccccaaggagtcccaggccaccggaagccattctaggtgcaccaagagtggcaagacacagtaaaaaaaaaaagcaattcagtcaactgagaaaaaaaagtttccagatttatgaagatttatttaagaagatttatgaagagaaaaacataaaggccttttaaatatacccattgattggatatccacttttaattaagctgaatgctctttaagaaaatcctttttcattaattaaaactttacaaagaatgcaaacagtaattcttattatttcttttacccagtttgctccacttacctgttcacaatcatgtttaggttctccagttttctctgggagaaagtggctgggctcaggcaagggcaggttttcagctggactgcagatccctttagcagcaaagcttggtatttgaggaggcaattgtttgtcagccagagactttccttagaggacaacagtcctgttacattgtgtggggttaaacagttatttcccatggttaacccagtggcctctgacaccagcaaagcctccactgtaactgcttggaggcaggctgaccatcctttggccaccaagttttaagttccttgcttaagtaactcactggctgttgagctggacctcaagccttagttaaaacttccagggccatttccttcctttttgttacatagagactgaatgctttccccatggaaagactgagggctggtatgttatgttatattatgttatgttatattatgttatgttatgttatgttatgttatgttatgttatgttatgttatgttatttttgagacggagtctcactctgtcgcccaggctggagtgcagtggcatgatctcagctcactgcaagctctgccttccgagttcacgccattctcttgcctcagcctcccgagtagctgggactacaggtgcctgccaccatgcccagctaattttttttgcatttttagtagagacggggtttcaccgtgttagccaggaaggcttggtttagctggttaaaggctttttgagccttaggttcccaaaagagagaggggtgagttttaactgtttgagtttcttttatgaggtggtataaagggtgagccatttccctgtgcccaggtactcacagtttacaaaatccagtaatgcccaagaatttccctaactatcaaaggaaatgggcctaatcctttcctcacctggtgctctggtcccttctgataagaccagaactaggtactttactgaagtctgacagagctgagctttggattttgagactctatactccctttcagctaagaaattaaggagagtcttagcatcttcctgagccttccttgattggggcatagaggaaagtgttatctacatactgcaagaccctgacctgaggacgggaaaacttagaggggtcctttgacagtgcttgtccaaatgagtgagggctgttttgaaatccctgaggcagcaccatccatgttaactgtgtggtctggccggagggatccttacaggcaaacaggtattgagagtcaggatgtaacggtatgcagaaaaaggcatcctttaaatctaggactataaaccatttagttccttcaggtatttgagtcagcaaggactcaaacggatgaattgggactatggcccattaatgaggcagatgtcctgaactagtctccattccccattgggtttttatgctcctagtatcggggtgttgcaaggactgttacagggtctgaggaggccctgcatttttaggttattaataatagcttctagccctttcctggcctctggctttagaggatattgtctctggttaggaaaagaagtgggatttttaaggcggatctgaactggcctagcagttttagcttgacctattcttccttgagttgtccacacttctggattaatgttggctttcactaagggaagacaaagagtttgtcctggggccatgaggatgctggcccccatgtgggctaaaatatctctacctagtaaaggagtggggggactttcaggcatatttaagaaggcatgtgtaaataataagttccccccaactacagtgagagaaatattgggttagagtctttcctgagacacccaccatggttgtgctatgggaagaggggaggccttgattggacaggagaacagagagactggctccagtatccaggaggaagcccaccctccttccttcaatttccagaatcacccggggctcctgaacagtgatggcagtctgagccactggagccaggggtctgagccctaggacctgtcagtcctgccggaccatctgtgagactagttctggacctagtgacctccatatccaggggcagtttaatatccagtggtcttcaccacacgctggacagggtcaaggtggctttttcttgttgcctgggcaattcttcttaaagtgccctggcttgccacaccagtagcaattagtggatgcttcctgaggatcctggactctgcaagcctgcaaagcatctccttgagccttagtcactttctctttttctcctggggctcctcccagtccctatggtaaaagaccaaggtggccaccttcaggagatcttccaaggtactatctggtcctatagcctgtttttgtggtttccttctaatatcaggagctgcctgctttttggctgcagtgagggtttgacttagaagcaacataacagctctccatgtgaagtcaaacacttgagttagattttggaaggtctctgtctacctattagggacatcagaaaatcggcgcaagtctccctttatttttctacagtcctgtaatgagaagggaacatgtaccctaggggtgccccttccatctggcatttcttgtaggggtagaagtgaagctggggcagtggggagctttggagatggtgaagctggagaagctgatggtgcagttggagggggccccagattaggaaaactagaaggactggggcacttagaagctgcccccaatggctcctgcaaaacttgctcttctaacttaggggaattactctccacagacccgcctgatatgattgctaagagagctgagtcaattgtgcagtgcttgctaacgtctgggttgtctcgcggggcaaagaaagcctgtgcataggggaccttggaccatttgctctcctgtctacagaaaagatctaattgatggataagattaaaatcaaggttcccttcagctggccatgtctgttcatccctgagacagtaagaaggccatgcccttctgcaaaagaaaatgagctgctttttcttcaaagttttagggtcaaaggactcccagtgcttcagaatgcactccagaggagtgccggctgaagatggcttgttacccatctgcaaaagagacaagaatagaggtttcctcggtctcctggttcttttcaatgtgactcagggaggaggggacacagtaggagagtcctcctggctgttctccctccttggtccccgggtcccagcaccatagttgcagccccatggttgcaggtgtgacccccaagcgtaataccagaggacctaatcaatgggctagtcatgtttacccatatgacctcagtcctctgcctaataattgggtaattactctctgacctcctagacctgtgtgacctgtgtggcttcttgataaatggatctccggagagataatgtaacacttgcatttaagcaaggccccttaatagagggagtgtactggaatgagctttatactctgctattatggactggactagaggatttattcttaggtggtggttccggttaacttccagacataaaatcccctttctatttagatgccattctagttgtaggcagaatgggtgtcttcagagaacgtaagggtcaaatggtggccttcctgctaacagagagagtactgagactaaaatttggttttggaggacatgttcctccttgctgctgaaagcagagttctcccacttgcagagggggcataaggtttggtctctattagagggatgtaaaagggaggagaactgaaaagccagagacttttagcaaagggcagacaagattcctcatggagaggattcccattttactaggtggtgctagtggaataccaggcagtaactttgcctccatatgctctttaaacaaaggatggagagagaagtctgacctgtggcatgctgtccccacagcatacctcctaacaggagaaagttagtttgcctcatagaggggctatccggtccgactggacagtgctggttcctcacatgggaaaagaaacagcctaagtggacagaggggcatttactggggggaaaataacctcccacccaaccccaggaagtattatcattaggagttaaatagtctttgagatctggatcatggaattcccctgtctgtaaaaagtcagaaaaacagcaatcccttaacctgcattcctggttactacggtggttgctaaacctgcctaattgaattatttcctgggctataaaaattcctgcagcattgcatacagagaggagatgggagacatggtgactgcagaaaggaaaggaggaaaataagatttgcaataggaaaacttggagatcctatggctgacacccagtcaggcaatcagaggctggggtcagtccaggagccttttgaataacaccagggtgtggccctggccagaaattctcagttgctccaggacctattccagccccatacaacaaccaggctttctgtgaaaagaaactagtttggacacagccaacattcccggcaccctgagggcaggtcctccccagcaagcctcacatctgagtcttcaagactggtggccagcccttgtggctccttaatcagctgtcagatgcccggtgtttttgatagttatttgagagaataaaaacggaggacaagaagcctcggaagtgaaagtagagtccgctcctttactcaccattctgatgaagtcaccttcaaatcccagacgagccctcaaaatgaagcagccttgttgtctggggtgaatactgaggttcttggtcacacgaccagatattgaggtcaaggacatgcacacacacatcgagtgagtttggagcaggagtttaataggcaaaagaacagaacagctcacagtcacagagaggggtcccgagcaggttgctaagcagtagtaaaaatgtcagggtttttataaatggtctagggaggaggggcctcatgaggaggggatgtcttatcctcttagggcctgatggtttagctgcgaccaagtgtgctatctatatagagcagaattttttttatcagcttttatcccattccctgaccacataggctgactcttagtctgtgtttctttgtcttgcttatctgggagggagagtttctgtgtctgttcccatacatcttcttgcagctgcaggcatccgccccatgagtctgcttttagtttctctatcttagtgcacctaaagggaaaggaatgtgcttattaagacccactgttttactggggcccattgtataagtgtgaagtttggcaattacccaggagacttccaccccttcttctgtgcttgagctgtcttatctgtattttacagcctgaactttcaggttacttgttgttagaagagaagtgattttttttaactgtgtgtggttagaaagggagctatttttgagctgctttttgttaaaaggaaagttttctgctggggactcactttaccctaaatgtctacctaaataatttctttttgcctcctataacactggtagtgtcttccagcatgctaccctccagttagctccttgggggccaacaccttcatgctgggtaggtacagtgattctatgtgcaccacaaactacctggcctagcctctgcccccaagaccttgtctcagtagacttttggccagagaagtatcccctggttcttagctgctatttagaatctccttgagatttgggtaaaaacacttgaccatgagaccatctttctatccaaaaagaattcattttactcagcctcaatgttgctaacagtaacaacaaccgtagcaataatagaaaatgtttattaagctctactatgtgtcagacatagagatagatgctttccatgggttatctgttttaatcctgacagaagcttgtcttactgttgagaaggtaaagtatagtgagtgaggctggctgacttgcccacggtctcagaactattaagtggtatattcaggattctagataattcctagaacactttcctttcatctttgcatgatcagctgcctcaagtctgattccagagctggagttcaagccactgttctatgctgctgcccatctctgaagagaacattgtcctgaatctatgtatcttcttcttttccctttttcataaaaagagaaaggcataggacccaccttttttttcagtttatcctaattctttggttacaaggacaccataattcaaaatgtagcccatgttacattcagaattatcagcataaagggtgaggagacatttggcacaaccaaccccttttcagtgcctgttatgtgtgggccaatgcaaggcagactgttggagaagacaaggattataatccctagttcttgtgttcaaatagtctatgaatactagcacagctaaggcatgcacaaaaataactatgattaattcataatataacagtgacaggaggggcacaaataagatcccactggggttcaaagagaagagatcacatttcacttgggggcatcgggcaaagcttcttggaggatgtagatgttaaaatggaccttgggagatgattgagtttctgtaaacagaattaagggacaaggtgtttcaggtgaatggaatggcatgtgcggaggtctaggggagtcatggtaaatccacagaaaagtgtcttgcagcagtgaagtggcctcgtctggggtgacacccatggtttgttgtctcacggccacagatatcaaggacgtagacacacaaagagtgaggttaagagtggaagtttaatagggaaaagaaagagactagctctctgctacagagagggattccagaaaaatgggttaccaattcacggtgaaatgcagaggggtttatagatgagctgtggcaggcactgggggttggggggctgatgtctgatctacatagggcaccaaaaaccagttagaaacaggtgtgctatctgcatagggcatgaatctctgacagtccctaccccagtcttttattatgcaggtgggttttcagcctgagctgtactgtattggtcatttctttcttactgtacacatgctaacaaaaaagggaaggtggagtttccatggtggacatgcctggcccccaggtagcccttttctgttggtacagcggccagcattcccttgtgcaagctttcagtttccttatctacgtttgtagcttgatttttcaggctgctctttgttagaaaaaaaaatgattttgggggctgctttttgttacaagggaagttctgccaaggactcttttgccctcactatctgttttttgttttttttttcttttttgagatggggcctcgctctgtcactcaggctgtggcatgcactggcatgatcttggctcactgcaacctccacctcccgggttcaagtgattctcatgcctcagcctcctgagtagctggaattacaggcccccaccaccatacctggctaacttttatattttaatagagacaaggttttaccatgttggccaggctggtcttgaactcctgacctcaagtgatccacccaccccagcctcccaaagtgctaggattacaggcatgagctaccacacccgacctgccctcactatctgcttaaacaatttctttctatctcctgtatcagcaggaggtacttgcaaagcagaagtaggctggttgggagctttctgagaaagcaggtaccagaaggaggttttaggggtgctactgagaaagcacccataagaatcacagacatgcgggaatgacccacaggcactggctgggaaacaacatatgacagaatcatgatgctaaatggagggggttaagaggacatataaaccaatagactggtaatgaagggggtcaggagcctggagtgcagcacagttgggtaaagcacaatatttcaagagctgagtccatgaatttggctgcctagtgtccttttatgtggctatttacaatagtgaatgggatactgtagagagtctcaaatgtcaggctgcagtgcctaaagtaaatccagcagatgatggggagccattgtgtatttctgagcaggggagagacattgtgagagtttttctttttacaaaaatgaatctggcaagactctgggaagaccaaccaggagttaagaatactagttagcagacatctgcacttgtctaagaagaaaccctgaaatcttgaattggaatggttgtgataggaaataaaaagagtgaaagaatgcaaaagaggctgtaaagcaacattttgcatgaccgtggacttgaatgaagaggaaaggagagggtaaaaaaatcaaagctattgggctgggtgcagtggctcacgcctgtaatcccagcactttgggaggcctaggtgggcagagcacaaggtcaaaagatcgagaccattctggccaacaaggtgaaaccccgtctctactaaaaacacaaaaattagctgggcgtggtggcgtgcacctgtagtcccagctactggggaggctgaggcaggagaatcgcttgaacccgggaggcagaggttgcagtgagccgagatggcaccactgcactacagactggccacagagcaagactctgtctcaaaaaaaaaaaaaaaaattgaatctattttgaggatttcagcttggcttgactggggggaagagtgatccctttcacagaaacagggaatgaacaaaaggtaatgaaccctctctgccccttccacaccccctcctagctgagagtgccaagggagaaattgattgttatatggattgtcctctcctttttaaaaataggaacacggctgggcatgatggctcatgcctgtaatctcagcactttgggaggctgaggcaggtggatcgcctgaggtcaggagttcaagaccagcctggtcaacatggtgaaacccatctctagtaaaaaatacaaaaaaaaattagccaggcatggtggcaggcacctgtaatcccagctactagggaggctgaggcaggagaattgcttgaacctgggagggagagggagtgagctggactgcactccagcccgggtgacagagcgaaactccatctcaaaaaaagaaaaaaaaaaaaggaacagaaagtaggtccccaaggtatgtaaacttaaagttctatagcttcctctccacacctcacatctttttgcatctctaaccttgccaaggataactaaagtttggctgtattttttcatttctccctgaaatattttcaatagaatcatttctgaaacccattccaaccccccatacagcacaaacaacgaggaaacagaagattcaccaaacatttatgaacagccagctgttataaagacaagggaccaatctgaaaaatcagaataaagtctccttgttaaagctgctgcaagaaacaggcaagcaaaacttagaacatttttaatttgtaatttttgcttaaagttttggtaagatgttgtatcatggtaatttgtcagcagttctaaaagggaaccatttgtgttcaggaaagatagcttagaagtgcaaaacatagttccagattttaaaacacagtgaatgcagtaacagccaacttaaactctgcaaaatgccaaattggtgaattaacagacaagtttgaattgtttcaaaactcagaggagatgataaaaagataaaaacaaaaaaaaaggcaagaatatggaagagagagagaggagattcaaaagacatgaaaagaattctagaggagatggctgggcgtggtgtctcacacatgtaaccccagcactttgggaggccgaggagggcagatcatttgaggtcaggagctcaagaccagcctggtcaacatagtgaaaccctgtctctactaaaaacacaaaaattcgctgggggtggtggcacagccctgtaatcccagctactcaggaggctgaggcaggagaatcgcttgaacccaggaggcggaggttgcagtgagctgagatcgcgccattgcactccagcctgggtgacagagtgagactttctctcaaaaaaaaaaaaaaaaaaaaaatattctagaggagagaaaaaattactccagccaacatttattaaatgtttagtaagtgctaggcatttaattatattaacacttgcagcagcctatcgagggaaatcactgtcatcattcacatttgcagataaggaaactaatgtttagaaagttaaccattttcttcagtagtaaacagctaattaaaggagaggctaagtcccgaacctagcatctgtttcccaaaaagtagacaaaccctctgaataagggcctcttttcttagaaagccctctgcatgtgtttgggtaactccaatgtccacagaggaacctgctttctcattcctctctcaaatcacacttacctgctgtctcccttcttcccccaggcaccgatgaagacgccattattagcgtccttgcctaccgcaacaccgcccagcgccaggagatcaggacagcctacaagagcaccatcggcagggtaggccacagtctttcctgctctgtctggctgacttcgcagcaacaggaagcagggcctcttcctgatctaggttcccgaagtgaccttgtgttttaaaagatcgatcctttgtcttgtttaaagatgttcttgaggccaggtgtggtgggtcacacctgtaatcccagcactttgggagaccgaggtgggtggatcacttgaggccaggagtttgagaccaacctggccaacatggtgaaaccccatctctccttaaaaaatacaaaaattagccgggcatggtgctgagcacctgtaatcctagctactttgtaggttgaggcaggagaattgcttgaaccaggaggtggaggttgcagtgagccaagatcatgccacttcactccagcctgggcaacagagacagactccatctcaaaaaaaaaaaaaaaaaaaaaaaaaagaatagcgattcagctccttcttcgtcaattgatcttaaacaagttcttaaactctctgacccattccaggaggaaatgtgaataaacatctttagaatttggtccattttccaaataattatatttggaaactatatctcaggaattgagccttaagaaatagtcatgaatgatcacaaagatacaactaaatgccttatgtatataacagtagaaaaatagaaacaggtgactagttaaagaaattaggctgggtgtggtggctcacacctgtaatcctagcactttgggaggccgaggcgagtggatcacttgaggtcaggagttcgagaccagcctgaccaacatggtgaaaccccgtctctactaaaaatacaaaaaaattagctgggcatggtggtgggcacctgtaatcccagctacttgggagactgaggcaggagaatcgcttgaatccaggaggcggagtctgcagtgagtcaagatcgtgccactgcgctccagcctaggcaacagagcaagactccatctaaaaaaaaaaaaaaaagaaattatgttgcacctatctatagaaatctccacagctgctaaaaaggttatcagtgaatattgacttggaagtatattcaagacatattgttaagtaggcaaatacatttacatcggtgtctacaaacatattcacctcaaagttcctttacctcttaaattttttaggacttttggttttgtgggttatatcttttgatatttgccctattagaaactaaaactgagggcatttaaaaatagatatttgttaacttagtaaaaataataagtatattgtatgttactgtaaataacattttaatgaaaaatagctatatatcccaaaacgaaaaaacatttagtgagaagattggcattgttttacattttgcagatctctttaatgtctggcttaatggaagacagatggcttctcatatctatttctacttcaatttgttatgatatgtggttttggttggggtatatgaagaaaatctggcttgtacagatatgtacttgaaaatggggggagtatttgaacagacagttgttgatgcacagacaatgtcaaatagccttaggaaaaccccactgtatgcttgtggaagaatgacagtgaaaaggcaaataacatctgagtgttattctgaggatagttttgacttgcaggccccttgaaagggtcttggagaccccagacatccctggaccacacctggagagtagctggtctaatttgctatagcagttaagcggagctactttcttgcattgcaggacttgatagacgacctgaagtcagaactgagtggcaacttcgagcaggtgattgtggggatgatgacgcccacggtgctgtatgacgtgcaagagctgcgaagggccatgaaggtctgtgctcttcctctcgtgctcttggtgctgttggtgcaaacgctgatgtgctttcttaagaaactgtcacccaataagaaagacatggaagcaacctaaacgcccatcaatggtagactggataaagaaaatgtggtacatgtacaccatggaatagctgtaaaaaggaacaagatcatgtcctctggaggaacatggatggagctggaggtcattgtccttagcaaactaaggcaggaacagaaaatcaaataccatatgttttcacttacaagtgggagctaaatgatgaaaacacatggacacatagaggggaacaacacacactggggcctgttggaggatggagggtgggaggagggagaggatcaggaaaaataactaatgggtactaggcttaatacctgggtaatgaaataatctgtacaacaaacccccatgacacaagtttatctatataacaaacctgcacatgtacccctgcacttaaagtaaaagttaaatttttttaaaaaagaaagaaactatgaccaaggccttctgagagtagcaggtgtaaagtataggagattttccttcatttacgacaacttgaaaacatcattactttacattataccaattataatttaaaagttcttttccaaaaagttagggaatcatttgctccttcctgtggctcaatggggagtgattataattgtcgcttttagtacagctctagagacttttagctatctctagacagctaactacttttgagatatgtaactttatgactgacactttaggggcctccaggtctactataggcttacttctggcaaaagagttcctggcttccctagatgacgtacccactgtgccctagcctggtctgccaaattttaatgaccaagtatgtaatgcaaatataaatggtccccaccttaggatggttctacttaaaaattttcagtgtattgtactcctcatcataagtcgaggagtacaattatcctcctcaaccatgtcaataaatactcagacttgtggaaggttctgggccaggctctgggaaagcaaagaggtgacaaagtctttgccagaaaattctgcccttcagaggaagagagcagaagaggtcaaggaaaaattaagtccccagagggcagaaaccatacctacccgggcacagtaacgaacacataataaacagcctagaaatgtttgttattactcataattgttacggcaaacactttgggtttcgggtgggacaataaaagtgaacaaaccctgttgttagaacgcagtggattgtctttattctctgcagattcatgacagatgtattccttctgtgtctgggcctcagctttgtaaactggctcatatagccctgtcctctggtttcttgtttagggagccggcactgatgagggctgcctaattgagatcctggcctcccggacccctgaggagatccggcgcataagccaaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcaggtgaagatgacactctattttgcctacccagtgcagtattttattaccctaaaagttggaaagttgttccttattatcagacaaagaatctaaggtacttgttcaaaagtggtggcaccagcagatcttagcattccaaggaatggtctggaggggccgtctggcccaaattcttcccttcagactggactgtacgtcctccagccaaatcagaatgacagccattcactcccccttagagacctccagagggtgatacgtatgaagtgcctttaaaaaatgcctgactttttgccctaagaatataactaaaaatgcacagaggttcagatctcacagtgtttattcagcattgtctacattagctaaaaatgcccaagagtagcagattgtctaaacaaaatattatacacttacacaatgaactattatgtagtcattaaaacttatattaaagagtatttttttcttttatttagcctttttttttgagacagggtctcactctgttgcccaggctggaatgcaatggccccatcatagctcactgcaacctcgacctcctgggcttcagcaacccacccactgcagccttctgagtagctgggaccacaggtgtgcgccaccacacccagctaatttttgtattttttgtagagatggggtttcgccatgctgcccaggctggtctcaaactcctgggcccaagcaatctgcccacctccgcctcccgaagtgctgggattacagatgtgagccactacacctggccaagaatactattaaaatatttattaaatggtttggtatatgtaagtgaaaaagacaagccataaaatagtatgctatgatcccatttttaaaaaattaacacagttaataacacagtattttttaaataaatgaaaataatttgtgcatgtgggggaaaatgaggaaggatatttacagaaatgttgtcaatgattcttatttctgggtgattagactgcagtggagttcctcgccttgccccttctttttacttatttgttttttcctaagccttctgtggtcaacatgtgttacctttatagaaagaaaacaaccacaataagagctttgtgggaagtgttcagagcaggagattctaaaccttaggagtctggatttagcaacccaatccccacatctgcccaatgagggttttcttccctgagggctgtgaagggctggagcttctcttttcgtttttgctttttaaaaattaattatgaagaagtgatttttaatttcttgctgaagctccccctgcctattttttttgacacaggatctcgctctgtggcccaggctggagtgcagtggcatggtcatggctcactgcagccttgacctccccaggctgagatgatcctcccacctcagcctcccctgtagctggtactacaagcatgcgccaacatacccagctaatttttgtattttttgtagagatgggggttcaccatgttgcccaggctggtctcgaactcctggattcaagcagtctgccctcctcagcctcccaaagtgttaggattacaggcatgagccactgcgctcggccgtggagcttctcatggataacctgtcagaacctcccaagtgagagacgtggcagagaggcatatgctaggatttgcatttgacagcgctccaaccccagccccacctcaaagctgggttcagaagctcctatctggttgctttccatcagtgaagcagcagaggctgctccacagctgtggttccctctgtgtcactgagaaccacgttcagatcggacccctgggtggcaggaagcacagagggaggatttcagacccagctttttcaaccccacattttaagaaacaggaatatcttggctgggtgcggtggctcacgcctacaatcccagaactttgggaggccaaggcaggcggatcacctgaggtcaggagttcacgaccagcctggccaaaatgacagaaccctgtctgtactaaaaatacaaaaattagctgggcatagtggggcacacctgtaatcccagctacttgggaggctgaggcaggagaattgcatgaacccaggaggcagaggttgcagtgagctgagatggtgccactgcactccagactccatccagcctgggcaacagaatgagactccatctcaaaagaaacaaaacaaaaacaggaatatcgtgtgacaggataagctgatcttgaccattttaccagagtttagtttttgaaaaactgtgtgtggggtgaaaaaacctcatgataagctgcttccataagcaggctggtcttgaggggacagattgctctggagtgtgacagggcattgggcaagactcttaattctgaagtagctaatttcactctcttgctagaatatggacggagccttgaagatgacattcgctctgacacatcgttcatgttccagcgagtgctggtgtctctgtcagctgtgagtgactgcttctgatggggggcgggttttatcgaaatgtccactctatcccctttgccagcctttctcatcctttcagcccctgacatgtggatattccccaggtagtgttctcagacccctctgttcctttatcttatttctccttcagagactctggctaatcctgcctgcccattttttctactttaatttgatatttacaagtacctaacacctgccaggtccccctgtcactcagtgcattgagagttatgaagatgattcagaggcagttcctgggccttaagagtatatattgtcataagggaatacatcaggtacacagttgctagaaggcatgaaaagattacatgccaaaggagaggcgcataggaaaaagaagattcaaggagaaaatttggttgtagaaacaaagaaaagccttcatgacagagatgctggttcagagaggacttggaggattactagaatttcaagaggcagagacgtgggtgggtgtattgcagacaggaagaacagcaagaataaggcagggaacatggggttcagggaacaactgggtgaacagttgggctggtgattctggaaacagggtgggaggataaactggaattctatgttgggagcagtttacacttatttatttgggagcagtagatgacgtgatgatgacaacgatgatgggagtgatgtgactggagctgcactttcagaagagtaatgtaatagtgacgtgtaggatgaacagtggagaggaactggaggctggacgaccaggtaggaagctacctggaaaattccagctggaaaataaagcaggactgagctaggtggggcagggttgcctgaaaagggaagctggagacttcagacatttcacatcacttcccaattgcatctttatccccggcctccttcctgagcttgagactctcatttcacattgctttttagatgtttcattacagatattctactatacccttaatgaactgaaccagaactcattttcccttcaaaccagctcttcttccggacttgcctgtttctgttaatattgctgttgttcctcctacacctaaagaagcagaaccctggaaatcatctccaatttccactttgctcttgtctccaatatttacttagtaacgcctgcctgtgtctcatatttctttcccactttctcttttcctcccatatttaccactctgatgagccatgcctagaccatggaacatcgagacagtataacaataaaaatagcctaaaaactagaggaaagtagcccattttatcatttgttagcattcttcagaggcttccaccctgccttcttgtgagctggtgttggtgaggggtagggggacatttttatgggatcctcaagtcccaccataggtctcatattctctcgactctcctctgttcccaacctccccaccttttttttttttttttttaagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatgcaacgttaggggccacactgaggctcagccctctaggcacacatcagagccattgtaataatgcgagcgcatttagaggacgtctgtcctccctccctgggtctgaagctccaattcttgtggtattttgtctcattactctagacctgctatcttaatggtgtccccagatcttcatgtatactctcgaattattttttatttgtttttctcatcctcagggtgggagggatgaaggaaattatctggacgatgctctcgtgagacaggatgcccaggttggtagaactgcagcttctttcttccagctttcttctctttcgccaatgagacaggccttagtgggtggatagcaacttatattacagtgtatattagccaggcttggatatgttctttaaaaatattcccacagatagcctttaataacaggtttcttgcagaggtacctggggctggacatcattatataagcactcctgggttccaagtttctcaacattaggaccattgtgtggcaatcccagagaaccactgtcttccgaatcccgtggaggtgaaagggactgttcactgtgcacttttacttcatcaaagaggacatttgataggacctatataaaatagcttgacacagtgtataccctgctgggtaaaattaatagcaaaccccaagaggcatttgcctctctgtttcccagcccagtgatggttgtcctggaaccaacccatggtctaatcagctgtggccagataacactaacgataatagctaataaaaagtgggtcattaccaggtaccaaacactgttctaaaattttttttttttttttgagatggagtttcactcttgttgcccaggctggagtgcaatggcatgatcttggctcactgcaacctccgcctcctgggttcaagtgattctgctgcctcagcctcccaaatagctgggattacaggtgcctgccaccatacccggctaatttttttctatttttagtagagacgggttttcaccatgttggccaggctggtcttaaactcctgacctctggtgatccgcctgccttggcctcccaaagtgctgggattacaggcatgagccatcgcgcgtggcccactgttctaaattctatattaagtatgtcattgaatctttgcaataacttcataaggtaagtattgctatccccattttacaaacaaggaaactgaggctcagagaggtcaagtaccttgctcaagctcagaaagataataaagggcagagctaggatttgaaccaattggcatctagacccagtattctctctctctctctctctctttttttttttttttttttgagacagggtctcactgtcgtccagactggagtgtggtggtgtgatctcagctcaccgcaacctccccctcccaggttcaagcaattctcccacctcagcctcctgagtatctgggattacaggatgcaccaccaccacccggctagtttttgtatttttaatagagatagggtttcaacatgttggccaggctggtcttgaactcctgacctcaaatgatccacctgccatggcctcccaaagtgccgggattacaggcatgagccaccgcgcctgaccatagacccagtattcttaaccaatacataaccataatgagggattggttccattcagtttgtgaggtatgaacaactttgttttatgcaaaaaaaaagaacctgttgctttcattagaggggatagaggtatgtgtgtggcttgggcttcttggagcacggcagctgggtttcaagaaggagcacccagaaagcaagcattccaatagaaacaatggcagttgcatgattgtttatgatctagcctcagagatcagtgtcacttccactaacctgtattttattctttttttttttttttttttttgagatagggtcttgctctgtctcccaggctgttgtgcagtggcatgatctcggcccactgcaaccttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtgtgagagaaagagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatgaagagctgatgttccagttcaagtccaaaggcaggaaaaaaactgatgtcctagctcaaggcagtcaggcaggaggagtccctctcactcttgggaaggtcagccctcttcttgaaaacaaaagctttcagctgattgtatgagggcccctcctccatattggatcatccaaaaaccctcacagaaacacccagaataatgtttgagcaaaaatctgggtaacccatggctcagtcaagttgacataaaataaattgtcacaagcctgttgagattcaagtttcagaagtgctgaataagatgaactcttttgaattaggtgaattagatgaacgctttcagctttaaatttttatgattatgtgaattgactctaaagcagtgagggaatcagagaaagaagtgaaaaaatgggggagtatatggaggtaagcccaatgagccacaatatgtgtgagttaagatctttttgagaaatgtaacaggcaagctgcttattaaaaatgaacagtaattctgattgagcaataatgtagttaaattgagcagaatgagtttcctatattcctacctggttggaatgtaagcaattggcaatgggtccctggttctactgtgagacctgtagcctcaggaaaatcacagatcattctagagcagggctatccaatagaactccccgcagtgatgagaacattccacatctgcactgtcctgtatgggtgactaccggctacctgtagccgctgggtacttgaaatgaggccaatgtgattgaagagctgaattttaaattgtatttaatttcaattaacatttaaacagccacatgtggttagtggcaactgtaggggacagcccaaatctagggcatttcttttagctcttaagatagaaccatgtagtctccagctagggaactgctagtgtttgccctgactcccaggggggtatgacagggtcccaacagccttatgcctgaggaaggatcctgagtcatttccactcaccactaccatttccaaccccatcaccaacaaaataaaactaagccagctcagctctttgagcttctggaaatatttgcctgtgtcctggcacatcgtttttggaattttagacctgtgctttgtttggcttcaggacctgtatgaggctggagagaagaaatgggggacagatgaggtgaaatttctaactgttctctgttcccggaaccgaaatcacctgttgcatggtaaggcacttacttcatttcccaaagaaaaggagtgaaagatagcaaaaactatattgcccataagtagttgataaccttcctccttcagttggtacaaagaactgattgtacccaagtgtcttagattctcaccctggaaatgtattagtccaatgatgtatatgaaagctaatttctgaaagattaattatgaataattagaaaaagtgcatgtagtcatagaagtttggcattcttgtttctaggaaactgaccttcacagtcagtcctttttctaaagtagccccagtattttcattctaatgtagttacatatgaaagtaatctgtagtagatcaggtagcaataaaatagcaatgttggttgatatttattcctgtgtaatatccaagctgtaaagctaatacaagtgatttctttaggggttatgttgtataagatgaatagtggataatttcaaatttgatatgtttctaatttgtttctgataaatataaactttgtaatgtgattttaacttatttgggggaaagatactagacaattttagaatatttgctgtcaggttcatattcttttaaacaagcaagtaaggatataataagatatttcatcttttatacgagttctttagatctttaagtacattataattttataaacccacccaccatacccttttaatcacacacactgatttgcaaagcttgtgggaaatttgagaatgagtttgctaaattgaaaacataaagcaattgagaagtacaacacattctgaagttgtaattatttcaggtttttcacagtgacaaaaaaacaggtgattactcctgttaatcaatatcccgggctaccatcaggtacacaaacttctgactcagcttctttcttcacttccttcccttgcctggttacaaataacaggaatctccccctggtggtgttttccaagaactgcaggtcctcagaagccgatttagtgcataaatgcatttgcaagaattttcacttctgggtacaagtcaatagttaggcagttatgaaatatctgtttgtaagccactgggagaaaatattttaagcactgtttggactaggaaaacttcataattgtcttaccaaccaacaataatggtgagatttcataataactaccgttttgttaataatgttctattttctaggtgcagtgttaagcattttataagcattgtttcttgcaacactcaatggagcagtaattattttccccattttacagtggagaaaactgaggcttagaaaatgtgtcaattaagttctttgattccaagccacacacactgacttcaatttaagtaagaaaagatgaaataatatagaatggcacaggagggaaaatggaaaatactggtagctcacagatttgaacagacagctgaacaccttcaggaagaacagaaatcaaggcagttctgggggtctcagtagaagggaataatggattttatttctaaagcagagtttctgaagttcgttttctattaaaaatgctaaatattgaccccctacttcagactggctgaattagaatctctgagtgtgacacccaggaagtttaataggtttctctgagggtaaagatgatgcagtgcttttggccatccccgtgagctgctcaattaaaaagttcccaggagagagtctaacgggtcctgactgggtcaactgctcacgtgtttgacagaggttgtggtgtatgttgttgggtatggtgtcccttgattgacagccctgttaaaatcacattgatggaagtgaggcagcaccccaaagaaggcgatggtgagaagataaaatagatacctgctctaagaagtttccagaaggagacagcaagagaggggaacatattcaccacattcaaaaatacttggcaaaaaacaacaacaaatgtaattatgtttaagtattttaaaagatgcaaccagctgttattaactgtgactcagttctgaagcagttgaattgttctagttttgatgagccaaaagggagatgacagggaggtgattgccaaggacaaaaacacaaaaagacacattctgcttattaaggaaacaatgagaaaggaaagcaaagctccccagaggccatctccattttatgtgtgagggtcccagataagggaaaggacttgactgatgtcctccaaacatcacagcatttcttcctccttatctggggcccattccactctgcacatccctcctggctgcttgcccacattactaattagtttcctcctgaaatatgccaaagaataaatagtgtaggctagttaaaaatgctcattctctccataaattttagtttcctctgttttttcttcccaataatactattttgttattgtctgcagtgtttgatgaatacaaaaggatatcacagaaggatattgaacagagtattaaatctgaaacatctggtagctttgaagatgctctgctggctataggtaagctggtagggggagtagagaaacaaatgtttatagattttccttctcattatcagtttgcaatatggggatatagaattatttttagagataaaagttgtttatcatgaatcactcatgttacattccagatttttaaacaagaaatattatatacaacctgattgctattgtgccatgtggtttatatattttatatcttctgtgcctttgtatgtcctatgtgaaaggtaataatgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatagagcatcgcctatgttcatgaaacattgcttggctaaaatttccctggcaaagcaaatattgataccttgtagaaacagaggaaacaactgtcacttttcttttttcatgggtcttatctgtaatcttttcatttcttctttttttttctttgacagtaaagtgcatgaggaacaaatctgcatattttgctgaaaagctctataaatcgatgaaggtaaatggccttattttcagcatctaaatgaatttgagttatcttgtgtccaccttcttaagcttacttatatcccctatccaaactttgctctgaaagatccaattcaattcatcaaatacttcagtgagtgcctgctaataataatactaggtgatatttactgagtacttaggatgtatggatcactgtttttaatagattaattatatccccacaacagctctatcaggctggtactattactaacctccaatttacagatgaggaaactgaggcatagaaaggatatgcagtttgcccaagattctcagtgaggaagtatggagcaagaatgccaggtgtttacctggcattctagctccagagcccgtattcctaaccctccatcgtactctgcaggctgagaatcacaggaggtgcagggaaggtcaaaatgtagtctttggccaggtgcggtggctcacgcctgtaatcccagcactttgggaggctgaggcgggtggattacttgaggtcaggagttcaagaccagcctggccgtcatggtgaaatccccgtctctacaaaaatgcaaaaattagtcaggtatggtggctcatgcctataatcccatctgcttgggaggctgaggcaggagaatcactggaacccaggaggcagaggttgcagtgagctgaaattgcactactgcactccagcctaggcaacacagtgagactctgtctcaaaaaagaaaaaaaaaaaaagcaaaacaaaacaacaacaacaaaaatgtagaccttgctctcaaagaatgtctagcctaggcaagtatgtgcaaaacaccaattataacaagacagaatgtaagacagtagttgaggatccaaacattgtagaaacacagaggaaagggtttttttttttttcaatatttgttttttgaggtggagaatctgcaaagaatatataaacagttggtatatttgagcaggaccttccaaatgtagaagttttacatcagaggatttcatgtggtgaagggaaggggtgataaggctggggagggaaggataatactccatgagaaggaatcgtaggtgagccaggtggcagggtatgtctggacagcacaggttatggctctagaaaagcagggaacggcatcctgtggtcagaacatagagcattggaaaagtgagttgtggagagccttgaataccatgataaagagtgaggatattcctcaggcctgccaagtagtggagcaaaggacatcgtcagcacagtcatctctagtcttgctttgatagactaaagaagacactgaaaaacagctaggtttttgtatatgtttggatttcgttttcttccttagggcttgggcaccgatgataacaccctcatcagagtgatggtttctcgagcagaaattgacatgttggatatccgggcacacttcaagagactctatggaaagtctctgtactcgttcatcaaggtaggtcacagcagcctaagtccagagtaaaggatccagaaaaggacccctctgaccttggcatttagcacttgttgtccccctcttcttggcatatatcatttcccttaaagattatgctcccgatatttccagtctctcctctttcacacagatatttaaacctttgccaggatacaagctggaaatttgccttctaaatacagtaattattttatgttgacctcagacaaagattacattttaatgaatacttttaagcacacaatttcctcgtctacctaattatgagagaagataaacaactgaatccagagtcctaggcaggggccagctgaggtctgctgggaatatgggaaagcattttagctatcctgaattactgttctttaccaggcaccagacttctaggagtcctaagagggcatggtagtggtgagaaatggttcacctccctcaaagccaggcattcctgggattttgtttcttgaggatgctggaagagtctcatggacatgaaagtgagacagatttccctaggagctaaggttgcctgcactgcaagcttcaaatcagcgttcgatctgtgaactaaatattctgaatcctactcaaagcttggagaggtgtgacaattaggtgattttaactgcagatttttttttttagatggagtctcactctgtcgcccaggctggagtgtagtggcgcaatctccactcactgcaacctccacctcctaggttcaagtgatcctcctgcctcagcctcctgagtagctgggactacaggcatgagctttgtattttttgtagaaatggcgtttcaccatgttggccaggctagtcttgaactcctgacctcaagtgatccacccgtctcggcctcccaaagtgctgggattacaggtgtgagccaccatgccccaccaagctgtggattttgttactacgtctacaaggcatgcaggaacttgtttctatttctgactaggctatgaggtaacttgattttgcagagctgaactatataactagtttaagattcaaggatgacggtaagtgaagttatgggaaaatatactacaaacaagaaaaaaacaaaataaccccaggaaatgacaaatgatttatggaggatatggagagactagaactcttgtgcactgttggtaggaatataaagcggtgcagccactgtgaaaaacagtctgttacgaaactttaagcaccaaacttcttcaaaaagtttaatatagaccaggcatcgtggctcatgcctgtaatcccagcactttgggaggccgagacaggtggatcacttgagcccgggagttcgagaccagcctagccaacatagtgagaccctgtctctacaaaatcaacaaaaattagccgggtgtggtggtgcacgcctgtagtcccagctactcaggaggctgaggtgggatgatcacctgaggctggggaggtcgaggctgcagtgagccatgactgtaccacttcaagactccagcctgagtaaagacccatcccaaaaaagaaaaagaaaaaattttaacatagaatgaccatatgagccagcaattccactctcagttatatacttaaatgaaaacaggaacccaaacagctagttgtacatcaacataaacattattaacaataggcacaaggtggaaacaacctaaatatccatcaacagatgactggataaacaaaatgtatatacatacataaaaagcaatgatattcaatggtacgctgtcatgaaaaaaaggaatgacatttttgatacgtgaatgaaccttgaaaatatactacgtgcaataaatcagacacaaacggacaaatattgtatgattctgctttatgaaatatgtagaataggtagattcatagggacagaaagtagattagaggttaccagcaatttggagggagaggaaagaatgggagttattggttagtgggtacagagtttctgtttggggtgatgaaagggttttagaaatagacagtgatgatggttacataacattgtaaaagtaactagtgccacttgaaaatggttaaaatgacaaattatatatatatatttttttaccacaagaaaaagtctctgaatttgaataaaattgtttaatgaaatgtgaaaagaatagatgaagtataatacttcatcatagcattatttatattatttacatggctttatgttatttatatttatatcaataatatggtattatagtatataatttattatatattgttattactattaatcaatagggaataacaaattatggaaaatccatacaatataatactataccaacactaaaatgattgagtacaaatatattgattggcttgggaagaaaacactataatctagtgtatatatgtctgtatatataaatatgtaaatatatgtgtgtatacacacacacaccactagaaaagattaaaaataaagaatacattactcattcaataatagttgtcaaaagaaatgaaaaaagcagaatagaagcataaaatatgtaaataatagaaaaaaatgacaaaagataaaaataaaagttataaaaataaataaactctcaggttaggtaaaaatataaaatccaacttcatgctgtttataagaaacaactaaaatacagtgacatgtaaaaagcttaaagaaaaacaccagggaaagaaagaaagcggacatacaagaaagaaagcggagattatgctattaataaaaagaagaatttagggagaaaaagtattaaataggagaaagtggatcacgttatactgacaaaggcaacaattcacagcaaagattaaactgttatgaaactttcagtaccaaattatattgcattcaaatgtataaataagaaacttgaggctccagaagaaaacatataatggaattagtatgctagcgagagactttaatacatcctatgctttggcacatcaatgaggcaaagtataaacaaggatatattaagattgagcttaacagatacttattaaactttgaaccctatatacagagattccatcttttctagtccccacgaatgactaataaaaattaatctaggccaggtgcagtggctcacacctgtaatcccagcattctgggaagctgaggtgggaggatcacttgagcccaggagttcgaagctgcagtgagctatgaccacaccactgttctccagcctgggtgatagagcaagaccctgtctctaaaaatataataaaaataaataaataaaattaaagattaaaaaattaatcaattattagaccacaaaaatttatatgcagaaattatagaacctttccggaagactgttttgtaacccatatcaaaatgtttaagaaaacaggctgggtgcggtggctcacacctgtaatcctagtactttgggaggccaaggtgagtggatcacttgaggtcaggacttcaagaccagcctggccaacatggtgaaaccctgtctctactaaaaaaataaaaattagccaggcgtggtggtgtgtacctgtagtgccagctacgcaggcagctgaggcaggagaatcacttgaacctgggaggcggaggtcgcagtgagccaggattgcaccattgcactctagcctgggccacagaacgagactccgtctcagaaaaaaaaaaaaaaaaaggtttaagaaaatgcatttagtccagtaattcccattttatgaaaatttatccagaataaatcattaagaaaatatacaaaaatgtaactacaatatgcttattgaagcagtgtttataatagtgaaaaattgaaacaacgtaaatatccaacaatagggagagggaggatgtgatcaaataaattattttacctgcatacaatgggatattctgtaaccattaaataatgttgtagaataatatttaacaaaatagggccctagcacggttgctcacgcctgtaatcccagcactttttgggaggccaaggctggcagatcatgagatcaggagatcaagaccatcctggctaacatggtgaaaccccatttctactaaaaatacaaaaacaaaattagccgggcatggtggcaggcgcctgtagtcccagctactcaggaggctgacgcagaagaatggcgtgaacccgggaggcagagcttgcagtgagtcaagatggcgccactgcactccagcctgggtgacagaacaagactctgtctcaaaaaaaaaaaaaaaaaaaaaaaaccacaaacaaaaatgaacaaaatagggaaataggctatattgttaagtgaaaaagcagaacacagaatactactgttctatcacattgggtatctagatacatagaaaaaagactggaaggacattcacacatcaaaacggtaagaatagtagtctctagatgatggaataatggttgatttttgtgttcttttttgtctttattttctacactgaataagtattaccttcgtaataaaaaataacaaaaaaaatttaaagctaagaaaaatccagccaagcttgaaaaagttggcttagatgactttgaactgtgtgtttcattttaaaatctatttatctaactttgcttccctatcgaacagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaacgtgg

SEQ ID NO: 35829 - DNA, 96602 bp, Homo sapiens
gagattccctattaaaaaaaaatagaattgatgcaaacagcctgttccttccggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcggtaaggagagtggggagtccacctttgttgttttcctacacaccagtcctctgctgccccagaaccattaaaatgcagaagttcctctggcagcttctcctttggaagactcatgcatccccgatcccacccttcttcttcccttttttccctttgttgcatcgatttcatttttttttttttccacatagagttcagctttgtttgcttcgtgacgttggggggcacatttctgctttgaaggaaaacgaaagctaccaagttttgggagatgggagatggtgctatacggtctttagggttacgtgaagtcaagtaaaatcgcacactggtgagtttcaagagtgagacatttgatgaatacgccctaagtactgagacaaggaggagtgcacttctgtaaaggatgggggtacacatgctgtaactggtggggattgagtggaggcctaccgaggcattgtaattattctgggtgagtgagaccctggtaatagagttattttgagagtgtgtagaagaaagtggttaacttgagcttgaaggcctgttagaactagacaaattgggaggggaagttggtaacaatgacgtaaatttttttttaacttaatatgacacgagattcagttttccccccatattgtcccttattttgactgtttctattctttcaaaatattttacttttaaatttctctcactgcttcaagtatattgagaactggatagggagctcagtggcttcttgtgtagtggcagcctgagttgctgctgcttcaaatgataggactttctctttcatggattcacttactcttaatttagaataacaaattttcagcagctgtcgggagaatatgataaactggggtgcaagatgagtgtatatccatgataaatgaaagtgcttctgctttttacaactcaagagaaaggcagacagtggcaagaacagatgtgtgggttcagattgtagggtataggaaccccttccctcttcttgagctttagagcagcagctaatccaggttgttgtgtgtttttattttttggcttgtttatttacacctgagaggatgtggaatggaagtggaggttatgttaaatcacaagaaccttgatatttgaactttgtcttctctggccaccatgtgtggatatgtttatgcaattttggaatatcagaaaatttaatcttacattttttgaataagtttaggttaaaaaaaagaacaccttttatatttcctttggacctaattttatgagcctcttgctttattattttccatacatgttgtctaatatttcaaagtaaaatttgagttgctcagagtctcaactcaatccaataattgtaaagtccaacttaatgcctttagttaaacccctaatgagactgaacagatcaggcagttagttttgctttgggagtcatacagtttcaatactgttatttattctttgctttctccttcctctaccccttctttaaaagtagattcaacaagaaactgctttcagaatttctattcaagtaagaataactgcacctctctttgttaagtcttaagtttccaagagccttagaaatggctgctgtcttctattatttcctttattggactcctttttttttttatttagatttcaacttttattttagattcagagggtacatgtgcagatttgatgcatgggtatactgtgcaaggtttggggtaccattgaacctctcaccctggtagtgggcgtagtacccaataggtaattttacaacctttgccttcctccctccctcctctgtagtcttcagtgtctattcttcccatctttgttggactttattgttgaagaccatgcaaatggcagatgtttatggtatttgtattttatttcaattttttgtcatgagtagttagaaatttattagaaatttatctactgtagtaattatagttcaatgaacctgttatcaaaattctacttcataatgccaaaataaatccttgctttattatactattacaacacttttaaataataccaaaacagtgtaaagtgagtacttctttgtaacatgaatggagtggtgattatttacttcagaaaggcacttttcagtttgctgtactaaagttttcctttaagattgatgccctgtttgttttaatacataagttagaaagttttgagcaaatatcctgatggagtcctacaattgcacatagtgagatacttcaataagtgactaagtttagttgtctgaagaacagttaaaagcttctttgctttggattggtggtagctgactgtttcttaatcttcctactggttgtcattaaaaaaaaaaacaacagatgttatactggttatactgggcagagtgggggatctggatctgtgataattggcaagacaatgttaacttattatggtggcgggcgcctgcagtcccagccactcgggaggctgaggcaggagaatggcgtgaacccaagaggcggagcttgcggtgagcagagatcgcaccactgcaatccagcctgggcaacagagcgagactttctctcaaaaacaaaacaaaacaaaaaaagtggcctaatagtgaagagtagcacttgcttcttgaaagtttagaaatgaaaacaagtatgttggtctttgcaatggatttcattttttatttttattgatatatcataattgtgcatatttatgggggacatatgatcttttgatacatgcacacaatgtgtgatgatcaaattagggtaattaggatatccgttaccgcaaacatttatcatttatttgtggtgggaacattccaaacattctagctgttttttctagctatacagtaaattatattggtaactatagccaccctattgtgcaattgaacagtggatcttattccttctatctaactgtatttgtgtactcattaaccaacctctcttaatccttctttccccctacccttctcagcctctggtaaccaccatccattctacccaatatcttcatgggatcgacttttttagctcccacatgggtgagaacgtgtggtatgtcttttgtctttctgtgttatgtcttagttcacttaaaataatgtcctccaggctcatccatgttgtcacaaataacagaatatcatttttatggctgaataatattttattttgtgtgtgtatatatatgtgtgtatatataagtgtgtgtatatatatgtgtgtgtgtgtgtgtgtatatatatatatatatatatatatatcacatttcctttattcattcaccgttgatggacacttagccacatatcatagttattttgaatagttctttaataaacatgggagtgcagatatttctttgatatactgatatcctttcttttggatatatacccaaaagtgagattgctaaatcatgtgatagttctatttttgttttttgaggaacctctatgctgttttccatggcagctctagatcatgtggtagttctatttttgtttttttgagaaatctctgtgctgttttccatagcagctgtactaatttacattcccagcaaaagtgtactagtattccgctttctcagtgcccttaccagcatttgttatctttttggtaatagccattttaattggagtgagatgttatctcattatagttttgatttgcattttcctgatggttagtgatgcggaacattttttcttatacctgtttgcgatttgtatgtcttcttttgtgaaatgtttattgaaatcatttgccatttaaaaaaattggattatttgtttttttgtgggtttcttttttgctactgacttccttatatattccacatattaatctcttgtcagatggatagttggaaaatatttcctcccatttttaggtttctccttactctattgattgtttcctttgctgtgcagaagctttttagcttaatatagttccatttgtctatttttactttcattgcctgtttttgaggttttacccaaaaaatctttgcccagaccaatgtaatggacttcttgatggtaaccataataatgatagtcagtagaagcccctaagtatgtcagatactatctcatttttaaaaataatcctttgaattaagcactatgattatctctgtttttcagagaaggaaatacagtatacaggttcaaagagtaaataactttctcaaggttacacagttggtaagccatagagcttgaatccaagcaagatgtttgaatccaaagaatatgtacttaaccaccaagaaatgcatcctcccagtgatttatggcaactagtaggcatgaggaaataaatttgaacacgagtaagaggtaggggaggaagtaagtcctgtaagtggaagaagagttgcctgggcatgtgcatataggggaatagagaaatgggcagctagtgtgtaggagggatattgtgtctaaaagggaatgtctgtaagtagggtaagtgactgttcacccaaggccaagaagatagagaagacctacacagttggaaagcctaaactggtctggtataggtcaaggtataaaattcaggccttaatactgtttagtttgatgggaaccatttaacaagaatgcagcttccaagtagtctgtctatatgaagtgatttctgcctgttcagaattgtttatacatgtcttaactcactgtgacacaggtatatgccacgttttgtttcttgagattgtaatgccttgtaaatttacatttaatggaaaatgaatagtaatctcagagcctatataagttaataaattgcaataacttcttaacaaaaatcaacattggcctaggatgagaattgctagagagatgatagcttggagaattttaactggtttgggagttttttccctatacatatttccccaagacccataatgatctccatttcatggcatctatgcattctatttgtgccttggtgtagaaattttaagattgtgggaaatagatgatttcttagggttttaattgtgaagtaacttttaaaaattgatgtattttatataactgataaaacagaagctagttgtagcttggattgttcacaaatatacataatttttctctatggttgtactctgcacaatttataacaacagataaaacaatgttctggattgtgtaattagtcactagtcacagtattttcttcatctggataatatagaagagcaagacacagttcttcattatgtggttctcaaataattgtactttaggcgcagaatgttttgctgctctgtctgtatttatacattaaacattgattttgtgtatgcaaggatttttgtcatatcttccaaagtttgtttgaatgttgtttaaaggtgttcatagaagatgttcacttagaagactaaaattagaaactgttcaccaaatgactgggacatactttttggaggtccctaacagtggaaaatggcagctttcacatggcaaatgtggagactcaagatcagtgctttcaaattgatgcttagtatttgatggctgatttcctaaatttcacagaaacattggaagaatttggcccaaaaagaggctgatcagtgatcagtgatggtgattcttgggcatttaaaaagatgcttaaatgttacatggttgtagggaagaatatattgtgaaagtttagtaaaagattaattatctgggccgggcacggtggctcacatctgtaatcccagcactttgggaggccgagctaggcggatcacgaggtcaggagttcaagaccagcctggctaacacggtgagaccccgtctctactaaaaatacaaaaacaaaaaaatagccgggcgtggtggcgggcacctgtagtcccagctacttgggaggctgaggcaggagaatggcctgaacccggaaggcagaggttgcagtgagccgagatcgtgccactgcactccaatctgggtgacagagcgagacaccgtctcaaaaaaaaaaatcattatttggtagaagagaaagataaaatggacttatttctagcacaaagactagttactttgttgaggaagggttttgatcaataaaccctccaccagggttagcctagggaaaaaataaataaacctcaaatgtcaatcagattgaatgttctctgtagctaatctttaaaatcttttatgaaatatatattgtgcaattaaccaagtatcatttacaaaaacatttcctgctttaatggaattatcaaggttgaattttgtatttcatttcttactgatacaagtaaacagattaagagagaagctgctggttaactatctgaccatctgtttgctttcagatctactttgcggcccactaggaggccttttaaacccagtctttaattactttcttcaatccagaccaaggttaaacaaaagtacatttagagagacgaggcggttcatttatgatgactgttttcattaatatgagagacaaacctgaccttttacacttgggcagcagagaagaattttaagcaaggagatttttttctagcccaggtcttgcctgttggttttattaggtttgcttgaaatcttgcagattgccagaacatcaggcaaaaaattcaaatataagtttaaaaatatcataacaaattcaaagactgtatatttaagtgttcaatgatgctaggttttttgttgttgtattgccctttcgttagcataactaagtttttttttttttttttttttttaagacggagtctcactctgtcacccaggctgtggtgtgatggcatgatcttggctcactgcaatctctgcctcccaggctcaagcgatcttcctgcttcaacctctcaagtagctgggaccacagacatgcaccaccaggcccagataacttttgtatttttggtagagacaggttttcaccacgttgcccaggctggtcacaaactcttcagctaaagtgatccgccctcctcgaccttccaaagtgctgggattacacgcgtgagccaccatgctcagctgctaagatttgactttagtaatagtaaagacaacacttatttatgcattgtatatgtcaggcaaggtgcccagggctttacctacattattttacttaatttatctttacaataatattttaacatagtaataactactattagattcattttacctaattggagggggtatctctaagatccagaaacataggtacattggtcaagactgaagagctagaaatgacagggctgtgatcagaactctggttgttcggacttcagaacccactcctaaacactgtgttatttacacatcctctgtttataggtattgaatagaaattgtcaatactacataaaaatcctgttatatgattttgaaatacaattgccattcaagaggggatgatgtctaagtaggcaaatgtgttctcattcataacccgtactcgagagtgagatgagagttggcactggtgggcaggctgggtgtagggaggatagtagcaccatgttcttttaaaatgtggttctttttttaaaatcaaatgaattcatcgagggcacacttaaaaataatatttgtctgtactttcttatgctggcctgtgttacatactgaatttttatgactgattctcttgcatgttatgtggctatagaccaacataattaaaaggtggtttctatgattctgtaaatctaaattaaccaggaaggcagtactgctataacttgtaaactctggttttagactctagtccttgatttctgtccctttggcttagtcctttttggaaatgagaccctatcctagagttagggtctagccaagcctttctgcttgggggatttccaaaaatgagtcaagacaaataaaatttcacctttcaaacaccagagaatattcatcttaggtaacatttactacatgagaaaattttctgtttcaccatcacctttcagccagttgtttcattataagtgcagcatgtttttctgttaaaattatctgtaaatatatatttaatagtagttgtatgatattggagaccgttctcttcagtatgttatatcaaatttgatttagaaggaagacaagcatatataattacttaatttattaaacatatgatcaatcatcttactttaatttctcatgcaaattgtcagctttagtgggtaataatattaagagctataattcattgagtcaggcacaccggtaagaactttacatgtattgtttcatttttctgacaattcaatgaagctagtactcttattatctctgtttttaagaagagaggctcagagaactagccaggtcacagagctagtaaagtaccccccaggtttgtctgattccagggcccatgatctgaagccctatgctattcttcccacttgatgatattcactaattacccactctgaatgcagctctgaaactgatttacaagtcgttgtaatacttcttttctgatgaacttgaaaaaccatgaaaaatacttcttaattaactggtctatagcaatacgtggtctatagaaatactaaggataattctggtggtctgttacatcaagtggagaacttgagtttatcagaggagacaatcaaagttataagagctcagcctatactattagttagaatgcagaacatgtacctttatctcaatttaagaaaatcattttattgcaatctaatgaaaagtagataagatgaattgttttttgaagggattttaaagcttttttagctgtaagggtgagatatgttttattggctattgcctgtgtgatttgagtaggtcataaaactttctttgcctctcatcattctcacaagctgaatatgagtaacttaaaatgaagagtatcatgaaagaaagcttctagaagtgtgtgatggttaatactgagtgtcaacttgattggattgagggatacaaagtattaatcctgggtactgtctgtgtgggtgttgccaaaagagattaacatttgaggccgggcgcggtggctcacgcctgtaatctcagcactttgtgggggccgaggcgggcggatcacgaggtcaggagatcaagaccatcctggctaacagggtgaaaccccgtctctactgaaaatacaaaaaaaattagccgggcgtggtggcgggcgcctgtagtcccagctactcgggaggctgaggcaggagaatggtgtgaacccgggaggcggagcttgcagtgatccgagatcgtgccactgcactccagcctgggctacagagcgagactccgtctcaaaaaaaaaaaaagtcagtgagttggggaaggcagatccaccctaaatctgctgggcacaatctaatcagcttccagcaaatataaagcaggtagaaaaacgtgaaaaagagagacaggcctagcctcccactttacatgtttctcccgtgctggacgcttcctgcctttgaacgtcggacttcaagttcttcagttttgggacttggactggctctccttgatcctcagcttgcagaaagcctattgtggaaccttgtgatcatgtaagttaatacttaataaactccatatatatatatgtatatacacacatatatcctactacttctgcccctctaagagaaccctaatacaaagtgttgttggaaatttattactaaaaataatgaaatctgatctcagactttcagaaaaaacataattggtcttgtgattcaggtaaataattttaacttctcaaaggattcagtagttggggtgaaatattttcagtgaatttctacttgaaacaagagtaaaggtagacctggcacaatggctcatgtctgtaatcctagtaacttgggaggcccagcgggggacgatcatttgaggctaggcgtttgagaccagcttggggaacaaagtgagaccctgtctctacaaaaaataaaaaataaaaaaaaaagaataaagatgttaaatttaaactttctaaacaatgttgaggggacaatcagggttgttggtggtgatgagacaatttgccaggtaacaagacaaacacctggtgggttttaaagtgagcaaaatggaagtgtgacaagatccaaagtaaggacaattttatactcgactttgaattcatgctttgaattcattctttttttttgaaaaagaggatgttgaaaggcaagtaaaaaatattgtgaaaaaaatgtgactaaacatttacaaattgcccatcagatcagattaggattttttattagatctttaagttaaagttgaagaatgagttttgtttagtgtgtgtttatatccaattagaaattgtgtggctatgattaggtgctgtatggggagcttaatagaggagtgcatatctcacttgggatttaatctgactcaacccatgagttgaactcgagaagtaaagtacacatcccaggggatccttatgctgcccaaatgccagggactgcttgggacaggtcccaccagacacacagcatgtgtgcactttccaaagtcagtcactctaggtttcatgaaaactcaaagcatctaatacgatcttgtcaaaattatgtctacatgtccaagtggatttactgtaaatcaatgtctaattactttttgaaaattattcacttacagagattgaattgactttttttcatttcataatgtggttgagtaggaaagtcttagaattgtactttttcgttgaagtataaaactagcgatagagtgcataaacattatattgcttaaaatatatggagaatggctcaaaaggagctattagcacaaaaaatgagattctgtcttgtgcaacagctcatgtaagagaagagattttggggaagaaaatgaaatttgaaaccttggattgtcagaacatggatttctccaaaagcagttataagaaaaaaatagttgactatctcccagtgattgaggtaatcatgaccgaattctacacccacacctccacaaagtaccaccacttgatgtcatacactttcttcaaatatttgaagttggaatggtaggcattaatttgtgtatgttttagtaaaaatatatagcaatttttatttcatatgattaatggtgagtcattatgctaggtaaaagcatatgataaaaagatagatggcatgttgcacataatagcgttatgcatttttcctaaatatttccttaagctttagcaattgcctcttagcaactgtttcaagttatataaggcagatttctgttcctaatgaacagattttgaggcaaggggtatattgttacagttttttttttaactttcctcctcatttattaatggacccgtcaaaagttaaaaatactttgtagaactctactgtagaatagtactatttcaaaattcaacaaagtgatgagtagcaacttatcatctacctctttcacttcttattacacagaatataattataaactggtaagtttttaaataaatattttttcacatatgagtggatggcctgttgaaattcaagtgcaaaacaggccacccaagtggagatttgcagctgctagatggaaacgtgtgactagagtttgggaaagatggtggacggagagtagatatgggagtcatttatgtataggtgctacttcaaactatggaaaagaatgaactcactaggaaaaaggaattatggcatgagatgagaagagagctgaaaacaaagacaggactttgctgaatgttcacatttcggaggaggtgaaagaaacaggaacagcaggaaacacgtggattcattaggaaagatcagagtagcatcttgtaatagaaaccatggtagggaagaattttcaaggacaatgaacattgttagttccatacaggaattttgaaaactgataaaaggtcattgaattcaaaataaggaaatgattagtgaccttggagaaaagcggtttcagtagattggtgaaaacaacagcctgattgggaaaggttaagaaatggagcaaataatgaggaagagatgagtatatagactaatatttgactagtttggtgagaggaaaggaaaaagaagattcctgaaaatagttaaaataaaatgatattattccagcgttattaaaaaagaagaaaattaagcgaactggaatttttcctagaaaaatcctgtttgtctgttttcccagcctagatttatcagatcattgttgattctttaatttcaccatagaatcaactttaaactacctcagtgtctagtggctgaaatattcaacaattaatatttggaaattgtgacagagacagaacatgaatatttgtgataggaaaggatgaaagcaaataaatatttttatattgttctacttgagaatgcccaatgaataattttatcagacaaatgcatattatttcaaaaagcattttattaccctcgtaaaaaataagcaggaaagtcaaagttctcataaaaagtatgaagaacagctggacaatttttattaccaccatttatttgctgaaatttagtaaagatcagtttgattctttagaacatattgctttttaaactttgacttctggctatgggatggattattttagtcataagaaagtataactgatctaatactttacacttattttcccttctcgctaatgccaacctagcttctaggaggctggaaagagtatacggttagaaaattggtaggcagatcacttcctttaagatttctgggctgacttaagatctggtgaatactattcaagaaagaagataaagaaaggaaaatggaattaaatcagaagtttgggattccatatcaatgacattattcaattctagtggagagagtttatggagctccggttccataaactctctcccctagaatttcatacttctacattcaatacttttacattgaactaacttgatcgtatgtgcacatacatgtaccatataaacacttggcagagatgttcaagtgcagagccttgcacagggtggacaatttgaatagattatgtagataggtcctgccgattctgaatctatgatttgtgcttaggaattatcttgctttcaccctcaaattcactcattcattgagaatatacttgttgccagccactggactaaactctggacccaggctccgaaggacgagaaaaggccaggaataaagattttctcagcctcctccctgagccagaatgaaggagaaagtatggggatgtcaatttgagggactaagttacatggtctgcaaataagaaaggagtcaaggcagaggtactttagggactctctgcctgcctgttgataagctgcctcatagaaattagcattctcctgtcccccaaccagtgtgcaaatatattctgcctaccctttccagtccccctgacaatgatcttcttattgaatgacagttctgaaaagtgataagttattagttcagttgaactgttacccaattttcttgccatttcactagacagaagtgtggaaagtagatcctaagcacaatttgcacttcctttttataccggaacattccacaaagacattactattatacagttctgattaaagccaaatgttgcagtcataataaattaaagatttgtggcttcattgtctgtttctaacatttagcctgggattatggaacaaagcccactaaattccctttttcattatctaaaaaatgccttttagacttttctataattccctcaccttgagatcatcctagctttgatcttttgtgtaaacaattatgtcttataaaaatctgaattgtattcattcctttatttataatctcaaccactttctgtttgtcactcttcctgctctccttgttttttttccctctcttttccaagggttataggattcctgacagtttggtttgaagtttagttcagtattctatatatcaatatgcattatttactttgtttttgctttaattttcaatttttaatttttgtgcgtacagagtaggtacacatatttatgaggcacatgagacactctgatacaggcacataatgcacaataatcacatcaggataaatagggaatccatgaacccaagcatctatcttttccttgtgttacaaatgatccagttatactctttcagtttttaaaatgtataataaattattgttgaccatagtcaccctggttgcactgtcaaatagtagaccttattcattgactctatctatatttttgtacccattaaccatccccatcctccctaccctacccattatccttcccagtctcttataatcatggttctactctatctccatgagttcaattgttttaatttttagctcccactagtaagtgagaacatgcaaagtttgtccttctgtgcctggctcatttcacttaaaataatgtcatccagttatatttaagttgtcgcaaatgaaaggatctcattctttttataactgagtaatactccattgtgtatatgtgccaccttttctttatccattcatctgtcaacggacacataagttgcttccaaatcttggctattgtgaatagtgctgcaataaacacaggagtgcagctatctctttgatatatccattttcttttggatatgtacccagcagtagggtggctggatcacatatatgtaagctctatttttagtttctttgaggaacctcccaactgttctttttagtggttgtactaatttaccataccaccaagagtgtatgagggttcccgtttctccacatcctcgccagcatgttattgcctgtctttggataaaagccattttatttatatatatttatttgtatcttctctcttattttcttaatctcactaatggtcaattaattttgtttatattttcaaaaaaccagctttttgtttcatttatctttaattttttgtttcaatttcatttagttctgctctgatctttgattttttttttcttctgctgggtttgggtttggattttgtttctctagttccattaggtgtgagcttagatggtctatttgtgctttcagactttttgatgtaggcctttaatgttaggaactttccttttagcactgcttttgctgtttgatagtttgtatcactattatcatccagtttaaagaattttctaaatttccatcttgattttcactgttgactcaaagatcattcaggagaagactatttaattttcatgtatttgtatagttttgagggttccttttagagtgaattttcaatcttattccactgtggtctgagagagaacttgatagaattttcattttcttaaatttattgagacttgttttgtggcctatcatatgatctatcttggagaatgttctatgtgctgataaaaaatgtatattctgcagttgttgggtagaatgttctgtaaatatctgtttagttcatttgttctagggtacactttaagtcagttgtttttttgttgactttctgtcttgatgacctgtctcgtgctgtcagtgaagtattgaatttccccactgttattgttttgctgtgtgtctcatttcttaggtctagtgtaattgttttataaatttgggagctcctgtgttaagtgcatatatatttaggattgtgatattttcatgttggactgatatatttatcattatataatgcccctctttgtcttttttcacttttgttgctttaaagtctgttttgtctgatataagaataactactcctgcttgcttttggttttcatttgcatggaatatctttttccacccctttaccttaagttcatatgagtccttatgtgttaggtgagtctcttgaagacagcaaatagttggtggttggatttttgtccatcctgccattctgtattttttaagtggaacatttaggctacttacattcagtgttagtgttgagagatttttttcatcatgctaattgttgtgtgagtactttttttaaaattgtgttattgttttataggtcctctgaggtttatgctttaagaaggttctattttggtgtatttcaaagttatgttttaagatttagaactccttttagcatttcttacagtgctggcttggtagtggggaattgtctccacatttgtttgtctcaaaaagactttatctgtccttcatttatgaagcttagtttcactggatacaaaattcttagcttatttttttttgtttttgtttactgaggttaaagatagtaccccaatctcttctggcttgtagggtctctgctgagaagtctgctgttaatctgacaggttttatacatctatatctatatctatatatctgtatgtatatatatatatatacagatatatatgtgtatatatacacacatacagatatgtatatatatctgtatatatacacatacagatatatagatatagatatatatacacatatatatctgtatgtatatatagatatagatatagatatagatatagatatatcccaatttgaaatgaagaagtcaatgtatccatctttgcagatgttatgatgttacatttggaaaaacctaaggacttcaccaaaaaatcccattagacctaataaacaaattatgtacagttgcaggatacgaaatcaacacacaaaaatcagtagcatttctaaatgccaacagtgaacaatcagagaaagaaatcgaaaacttatttgagggaataattgaggaaaacttccctggccttgctagagatctagacatccaactacaagaggctcaaagaacagccaggaaatttgtcacaaaaagatcatcacctaggcacatggtcatcaggttacataaaatcaagacaaaggaaagaatcttaagagctgtgaggcaaaagcatcaggtaactatatatatatatttacatatatatgtagatttatatatgtacattttttcagtcttcttgagtttctttcatcaatatttcatagttttcattgtagagagctttcacttgtttaagttaatccctgtgtagtttattatgtttgtgactactgtgaatgggattactttcttgatttctttctcagattgttcactattggcatttagaaatgctactgatttctgtgtgttgattttgtatcctgcaactgtacataatttatttattaggtctaatgggattttttggtgaagtctttaggtttttccaaatgtaacatcatatcatctgcaaagatggataaattgacttctttatttcaaattgggatgccctttatgtctttctcttgtctgattgctctagctagggcttttagtagtatgttgaataacagtggtaaaagtggacatctttgtcgtgtaccagatttagaggaaagcctttcagtttttttcccattaagtgttatattagctgtgattctctcatatatggcttttattatgctgaggtatgtttcaatccccagtattttgacacttgctgtcatgaaggtatgttgaattttatcaaatgcttttttagcatcatctgaaattatcatatggtttttgtccttcattccattgatatgatgtattacattgatcgatttgcatctgttgaaccatctttgcatccctgggataaattccacttggtcatgatgaatgatctttttaatgtgttcatgaattcatttttttagtattttgttgagtagttttgcatcaatgttcatcagggatattggcctatagttttctttttttggtgtgtctttgtccagttttggtaccagtgtactattggccttgtataatcagtttggaagtatttcctccttcttttctgcttcagaatactttgacataggatttgtattagttcttctttaaatgtttgataaaattgagcagtgaagcccatcaggtcctggcatttctttgctggaagactctgttgcagctttgttctcattacttgttttttgtctgctcaggttttggatttctccatggttcaatatttgtaagttgtatctgtctaggaatttatcaatttcttctgggttttccaattaattggcatatagttgctcatagtagcctctaatgatcttttcaatttttgtggtattggttgtaatatcacctttttaatcactgattttatttaattgggccttctctctgttttcttattctgagcttaagtttgtccattctttacatcttttcaaaaaacccactttttgtttcattgatcttttttagtgtttttttttcatttcaatttaatttatttttgatctgcccttatttatttattttcttctaagtttgggtatgatttgatcttgcttttctagttctttgagatgcacctttaagttgtttatttgaagtttttctaaaaaccttttaagtcacccttatagctataaacttttattttttactatatatttcactgtatcttataggttttggtatatcatatttctgtttttattggtttaagagatttttcaattttcttaatttcttcgttgacccactgttcactcaggagcatattgtcttattttcatgtgtttggatagcttccaaaattcttcttgttattggtttccagttctattccattatgttcagaaaatatatttgttataatttcatttttgaggaatttttaaagacttgttctgtgtcctaacatatggtctattcttgagaatgatctatgtgctgaggagaagaatgtgtattctgcaggcattgaatgatatgttctgtaaatatctattagatctatttgttctacagggcaactgaattctaatatttctttgttgattgtctgtttgtataatctgtccaatgctgaatgacaggtcttgaagtctccagcaattattgtgttaggctctatttatttctttagctctaataatttttgccttatatatctgggtgctccagcggttgttgcatatatcttcttcacccccttcttaacttttggagttaattcatgtcgctgctacaattaaacttgataagaatcacctattgtgccagaattttcaatgctgtggctgctcaatggttgcctttggccaactgtatggcaaaaagtctaagtgctaaagtaattatttctccttaggtttccgtcagattactatataagtaaagataatttttgctccacctttcccctttatctttttccccagtatatttgtaacaatccctactgcaaacatttgaactctggcaaaatgggtgtcttactcccaggagttaataagcataagaatccatttgggccctgttgctctagtggataaattttgtcctagcatcaaggttgttctttttaaaatagcattatggctttccacattttataatggtgctttaggtgaactaaaacaatgatatctaggtagaaaggtcatgcagtaaaacattactcttttttgttattaatgtcaattgttattaagaaagcttgagcataacactgaaagttccttctccattgtatagaaattgacttttagtctgttccacctttatcaccatcaaacatattgcaaataaaatattagaagcatatgtatagaagggatcatgggaaatcatctagtccatccatgtaaggactgtttgtgaattgtcccagaaatattattatcaattttctcttagtaaattctccaaggaaagaaatatacaacctcctttggtaatatgctgcagtaatactttattccttgttgtcctagactctgcgtctaagattacagaaatctggctgaccattgaaggatttctttcttttttatttatttaattttttattatactttaagttttagggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcatagttcaattcccatctatgagtgagaacatgcggtgtttggctttttgtccttgcgatagtttgctgagaatgatggtttccagtttcatccatgtccctacaaaggacatgaacttatccttttttatgactgcatagtattccatggtgtatatgtgccacattttcttaatccagtctatcattgttagacatttgggttggttccaagtctttgctattgtgaatagtgccgcaataaatatacatgtgcatgtgtctttatagcagcatattttatagtcttttgggtatatgcccagtaatgggatggctgggtcaaatggtatttctagttccaaatgcctgaggaatcgccacactgacttccacaatggttgaactattttacagtcccaccaacagtgtaaaagtgttcctatttctccacatcctgtccagcacttgttgtttcctgactttttaatgattgtcattccaactggtgtgagatggtatctcattgtggttttgatttgcatttctctgattgccagtgatgatgagcattttttcatgtgtcttttggctgcataaatgtcttcttttgagaagtgtctgttcatatccttcacccactttttgatggggttgtttgttttttttcttgtaaatttgtttgagttcattgcagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttgttgttttagtcatgaagtccttgcccatgcctatgtcctgaatggtattgcctaggttttcttctagggtttttatggttttaggtctaacattttctttttacctcttttttttgtggtgaagtgggagatcagattcttgaaactgtggaagcaggggaaatcaagcaccatacaatacatggagagccagtagttatcaatttaatatatatttcctaagtacccactgataaaatactcaactctgtagagaacaaggccttaattctgaaagagctaattttgttttgaaaagcttaaaataagtctgatgattttttttttcttttctacctctcttctctttttaggaagctttctgtgtattgcttctgcctgtggatcagtacagtgtaagatcatgtgataaggggaatattcctatatgaaactcaagacatactgaattaaaaccaattttaaaattagtgttttaaacttttttttttctttgcgatagggtcacgctctgtgttccaggctagattgcagtgatgcagtcacagctcactacagcctccaacttctgggctcaagcaatcttcccatctcagtaccctccctagtaccaggtctgactgattaaaaaaaacttttttttgtagaaatgggatcttgctatgttgcccaggctggtcttgaattcctggcctcaagtgaccctccagtcttggcctcccaatgtgttgggattacaggtgtgaatcactgcacctggccaaattctttagtcagtaattccctaaagctcaagtattgggagttgttcattcatgatagttgatagtgttataaatgaagaaaattacatgacatggctaatgtaatacccaatgcaatgctttaaaaggttcaatttccagaaaaattttatcataaaactttgaattatactgcttgttgttgtagaagaaatatcactgttttagaactctatacttaatgctgtgactttttaatgtagtttactgctaacttgttagaaatctttgtcatcgtcagtatgctaatcaaccaggaaaccctgtgttggggcgtaaagggccttagggaaatgggttaacctttgtttcatcccattccccaaccccagtcaccacgtaagaaagaaatgaccttaactctacttcctaggaatgctagttagatttttaaaatgtgattaatagcaagagctttgaatttctttgaaagaaaggatttttttttcattagcagcccaaaataatttgttaaaactctaatgtgacttctttaaaacacaatttataatgtcaggaagacaagctgaggcacaagttacgtgcttaacccaaaaccatataattggaggcaatactaagagtaaatcaagaatagatactagaaggcattatttcaggtcacaattaccctgtgagattaagatggtttgtatttactaacttcattgtatacaaaaagtttattttgagcctcacttatgattccactgcatttttcttaaactacatttttggatatggtataataaatggattatgaatcatcctttgttcaatcttttttgttgttgttgtttttgtcaatagtcttttctccttctttttcctcaactctggagttgggaacacttttttttttccccctaagtcactagagaaaccacgaaggaggcgctatttcttcttggagtttgctgattaaaagctaactcaacctcagtcttttctaaaaaaaaggtgatggttcagataattgcttgatgaatgatatgtgaaacaaagatggctttctcataaaaactccggacaaatagagactatatttcactcaatactcaggccttctttcaagcctttcaagtctgaggtaagctctgacatctccagtaccaattttatttttttttaaccagctctttagccatggaaaagcattaattttttctttcaacaaaaataaaatttgataagatcttcagtattaggggaataactgttttagcatagagcaggagattatttatatattttctttttaatttttataatttagggggtacaaatgcagttttcttacatcgctatattacatcgtgcactcatcatctaaatagtgtactttgtacccaatagataaattttcatctctcaccccccttccaccctctcacctttaatagtctccattgcctattatttaactctgcatgactatgtgtattctttgtttagctctcatgtataagtgggaacatgcagtatttgactttcgtttctgtgttaattcacttaggataatgggaaattgcatccatgttactgcagaggacatgatttcattcttttttgtggctaagtagtattccatggtgtatatttttatcacagtttctttatccaatcatccactgatggacacgggttgattctgtgacttggctattgtgaataacacaatagctagatccaattaattttatataattaagactaaggaaacacaatgatcctagttgaaatgttaaccaatattatgggtcactactaattatattgtaaataaatcccagtcctctgaaagaagaatgataccttgacctaagtgttggcagtacattatttcttcttctgaagaatgatttctttttacctcacatagctttcatttctgtggtaagaacattaaacatctactctcatcattttttattagtacaatatatcatcattaactgtaatcaccatgctatgtacaatagatctcttaaagttattcttcctatctaacggtagttttatgtcctttgaccaacaactccccaaccacctcccattggcacctctaataattattcagataggttgttccattgttagacaactctagttagtacaaaggatttaaatttaatttaaaattaaaccaaaatgtggttctttctaacatctacccagtggtttggatttttgtattctgaagtaaatcttctccttgctattagagcacttcacctaaggtaagatccctggcatgtctccttgcagttttctgaaaacagcttttgattatctgtctaaagattgaacgttcctagttctttcaaacattctatatggtgcatatattttatgccctttacaatcttggctgccagcttctaatttgagcctccctaatatttttaaagtgtttaatccaaaagtcttaagtgtaagtcttcagtgtagtcttggatatatttatatatatatatatatctatatatatatatctatatctctctctctatatatatatatataatttttgttatattttgtttatattttatctatttattttatgtatttatattttatttatatttatattttattaatatttatatttaaggtgggccctaaatgtaataacaacggtctttttagtagaaaggcagagggaaaatttttgacataaagggaaataggaggtatgatgatgtaaacaagaggttggagtgatgtgaggaaagagtcatgagccaagaaatgtagatgggctctgaaaactagaaaagacaaggaaaatagaatctctcctagagccctcagaaggaaagagttttaccaccaccttggttttagccctgtaagactaatttcaagctctgacctttagaaccgtgttgtttcaagccactaaatttgtggtgatttgttagaatgacaataggaaacttaatagagttgttggctatgccattgttaagtcatttatccttgtgcagttcacttaactctgtcactgcttttgttccttttaagtaaggttgagcttaacattgcccatattacagatctttcaagattgtcataagaattgtgaagttgtatctgaaataaatacattggacttttctaaagaatgatattcttatgaaaaaatggagcatcaaaaatcagttactgagtcattgtttgttagacctgacaccagttagaaacatggtggaaagttttcaatcactttatggatttgaaatggccacattttattttgatctacagaagatttccagatccattgctaaagcgatcagttagtttcctatttaacagttgcatttttgtatttttcttaaaaacaaacaaaatgttctgttctgcacagtttctaacccctatgcccttactttgctgggtctatttgagaacagggggcctgtctcatcacttggaaaaccttagagttcaagtctgtgcgaagaatgtgcaaaaattcttgtactgttgggactgttgactgcttcctagcctaaaggaaatcagttgcctaaaggaaatcagttgtcttatgtttttacatttgctttagaaatgatttcttttttgcttgctatcttgataaatctctaaaagacataatgattccatttgctttttaagttttaaataataataacatttacttgcaaatactgttaaaataatataattttatctatttttatttgttattttataattcttgtaagccgaatgtgctgttacatagcctaaaccaagaatgggataagtacattggtgaactaatgcctgaagtattaacccatatgataacatacttcatttctttcttggatttctgcactgtctggtgaatttacacaagttattacaaaataaactgtgaccacgatgcttcttgttctctcatatattgcagtttgtatgcagttttagacaccagggcttaaaaaaattatagtgatttcatgtaagtatgtatagtccttttctagtggtggttcatatgaatgggtttaaatagaaaaatgttccatgtaaggagccatagtattgtcaactaaaaatatcaaactctaatatttatgaagaggtttattctgaaccatatctaagtgaccaatggcccatgacacaaccttcaggagatcatgaaaacatgtgcccatgttggtggttggactccagcttggttttatatattttaggtagacataagacaccagttaatacatgtaagatgtacattggttcggtccagaaaggcagaacaactggaagcaggtgctgggagcggggacagcttccaggtcataggcagattcaaagattttctgattggcaattgattgaaagagttactatctacagatctggaatcaatagaaaggaatgtctgggttaagataaggggttgtagagaccaaagttttctcatgcagatgaagccactaggtagcatgcttcagagagaatagcttgtaaatgtttcttatcaaatttaaagagcctgttctattggtaattttaaaagggaggaaggtataatgaggcatgaccagttctcccttcccatcatggcctgaactagattttcaggttaactttggaatgcccctagccaagaggaggggtccatttagatggctggggggctttgaattttatttttggtctacagtatatagttaattcacattactttgttcatatgttttggtctacagtatatagttaattcacattactttgttcatatgtaacattactttgttacatataatgtaaattcatttctcaacacagtgacattaagagctctttgccacaaatgacttatagctgtgacatatgagctatagcttgtgagttacacacagcatctagagggttcaaaattcgatattactgaagtttggaaatcttgagtgtcctgagtagaatgacagtcctcttttacaaagaacctagaaaattggatagctcctttttaaggaagtctgtgatccattaatgtctctgctccctagaatttgtgtccagaggctgtggagcaagtgtccatgattaaacaacatggagttattagtaattaaggagattctgaaatgggagaagttccgtatactccttacaggatgtgccatgggggtgtggctcactttttcggtggcccgccactcaaacctctggggggagcatgcatatgggcaggctgtgggactctgaccccacaacagtgtcttggggtgaatgtttacagctgaagccccagtgggcgtgtgttacagtatgctctttcagtttagccatctgtaggtgccttgtgttagtcagctcaattagaccccaccctgccttatcacaaggacagagtgctttctgtatcctggggtttcttgccttggtgtaccagaagaatcggatcacatgtgagcttggagaatgattgcaaggttttattgaggggaagtagctctcagcagatggttggggagccagaagggagatggagtgggaaggtggttttcccctggattcaggctgctcagtggccgggctgtcctctgactgccctggccaaactccatgtcgttctgctggttggtggcttgccagtgactgttggtgtgctcttacactagtgtgttcctttcaacatccagctgcttgtgtgttcttccacctttgtgttcctcttgatgtccaggcgcttgtatgcgtgcccagtagggtctcagggtttttatgggcacaggatgggggcatgatgggccaaggtggtcttgggaaatgcagcatttgggcaggaaaacagaaatacttgtcctcacctaggtctgtgggcacaggcccagggatagagccctagccagggaccacaacctttccttcccagcgcttccatgctcctcttctgtatcaattctaggcatatgtcgtagtggaagggacattgaacttgcagtatgaagttcagaggttgagtgtgaattccaccattcatagctgtgttgcaggtcccttcatttctgtgaacctcagtgacctcaactcaaaaatgactatacattataatactactcccctacctattccataaagttgtcatagtgaaagagattatatattcattattcagttattcatcaacaagtatattttgagcatcttctatgtgcttgactttgtgctaggcactgaggattcagtgttgaacaggatagacatagacatagcccctactttcattaatgttacattctactggaaaatacagacgttaaagaagtaaatgcataaataagtatgtaattatgacttctgataagtgccaggaagtaagaggacagagtttagagtgagagtgtaacagtagacttactttagataatgtgatcagggaagatgccactctggaggtgatgtttaaactgagttccaaaggaaataagaaggaaacaggtatgtgatgtgcaaagaaaataacatttcaggctgagggctagcaactgaaaagacctagaagaggaaattatcttggcatatttgaggaacacaggtaatccctggtgtggccagaacaggctgaataatatgcaataaaattggagttgaagtcagaggagagatcaaataaagccagtggtaaactttataaactctaaaatcctatacaagtttaaagtggtggtggtatgactggcactattttcgtccatataacattcccgagttctttcatccttgtaatgtgtggccccaactgactgttgacgcatgaagataagtctgtggattcctgtttttatgctttgactctgagctaaattgggtgaaagctggattcccctaactttctttaagataaaaaaaaatcttagatttcttctgtagttatttgcccccaaatgagatttttcatatcttgtggttcctaattgggtcactgaatcagtgctcgttagaacaatatgttgatatgtaaaagtaaggcaaatatgttcacaagttggtggtctgtggctcttgaaggagagaagtcagaaaagccaggttggattgaccttggaaaatgttcatgtagaaatagatttaaatattattttagcagcagcctgtcagtaaaagctttgttcattcttaatctcttaggaaaacaaaagcttccgccaataagaatggcacatttcatcagacgcatgtctaaaaagatggacttacagatgaagttctatttgtaaatttggagtcaagggaatacttatcactcctaactcagtttatcacttaaaagagttgtgaaatgtggtgtcattaggcttcttttttaaataaagagagttgaattttattttatttattttctctataatgttagcctttgagggtgtcattattcatattcatcacttttagaagagagaagttagaatatcattttggatactttcttttttaaatcaattccgtctgaacctagtgatctaaagaatgtagtaaactgtgttataggattttgtcctttgctggaaagcagtttgttgctgtatgtagctgattagaaggagggttcctaactcttactaaccaatagctattatcaatttaactgaattgctgttttggttttgtggtctttatcagctttcataggttatagtggcaataattctaaggagaaccttttggagctcagtcagcttactcagatagactcatggcaagccattagcaaacactagttgtaaaagtggcagctttgggtccaagactgctgtagcaatattttctgggtgctatcaaatgaaattaataaaatcatttgcatggtacttagcatcattactagcacgtagtagatgctgaatatatatgcatgttcacatatatttatatgcatgtttttatgtgtttctctctatatatatacacacacacgtatatgtatatgtttgtacaggtgtgtgtgtctacacagacacccacacacacacacctcaaagcctcagtaaaattggggataataatacttacctggctgttataaagtttaaatgagataatatgcttagcacagtgcttaaaacagtaactgttctatagctatattttatatatgttttattattattacaggtataccttattaaactcatattgtccctaaaatattttactatgcatagcatctaatgcaagttatttaattctctctgaaatttagatcataaataggggtaatagtattacatacacatcacagaatagttgtgatgactaaacaagatgaagttctcaatgtagatcttgggatacagtaacggttcaataaataaataaatagtagtgaattagtgatgatgatgatgatgatgatgatgatgatgatgataaggaagatgatatcacctgtcctctggaaaagaaatgtaggctaactactagtttttctgaatagcaagattttactacttagttgatgctctcccagaattgtttttgttactaaattcaaacttttaacatgcctatcctgctctcctttctcatgccttctctctcactctctctctctcactcttgcatgccaaatcaagctgtttctttgtgaaagcaccaatgacataggttagcttactatttttgaggtccagctgtacattttaataaacacttttcgtattgtggaataatgacctagtctttccttcttaaaacatgcagggtgaaatcctcactatttttatgaaacagcatctgatcttgaacttttatgactcacctcagtcacttcacctgtattttggccctgtcagatcatgtctttatttaaacttttgatattttattctttatatgtttttgcattagtttttatttttaaaactttttctaagtatttttatcttgactactgtggttttggtgccttcttaaattttatgctagagatgactactgcctcattcttctcactggaggatatcatacaactatatgatatacaactatatgatacatatacaacttgcaattgtgggattcaccttttctgagtatgaaagtggaaatcttctataatagtagttgaatttttacaattgattgggagaacaaataataacaagaagctgtcatgaatttggtaacactttgaaatgaatttgtattttagtttaaacaacagcatctacacatattgaaaaaaatagttgtgtgtttaagtgcaagacttatttattcagtctatagatagtgctttgcatacgtagagctttgtagaccctttacaataactcttgtttctccctccatattcttcatcccgacagagatctctggaccacagattagaaaccactgctgtaagaattcagatataaggaaaatcagtgtgcctaaaatatgtttagagaatataggactttgatatccatgagcatttgaataccttgcccaaggttatatagccaataacttagcagagccaggatccatatccaggattttacactgacatgactttggcatgaatttgaaaaataagtaggagaaaaggagtaaataaatgtgggaagacattctgtttattgagtgccttttgggtgccaagcttggagccaggcactttgcattcctcttttatgtagtctatgaagtaggtgttattatgcccattttacatttaagaaaactgagcctcagagcatttgaataccttgcccaaggtcttatagtcaataattttagagccaggatccgtatccaggattttatagtttcattgttcgactaagacaggaagaagtcagctactgttaatgctggtaaacaaaaagtttgaatttaaactggtaagtcagaagtgcacagaaattacagttgtttgcttttatactttcctcatttggcaggcccatcttaactgcctagatatttttaaatgtcctgttgaggaagtttgtgtttttttctaggtcatcattcaacagattattttgtctttcattaatttactattaatatttacctctactctctaggctctttacatagtctagaatagtctgtttttcacaggctatctcgagcaagttgcaaaaacatacatagtctctttattggccctttctaaattcttcaaattggattttaaaaagtagattccaattacaaataggttgcatcaatatagaaataccttgacttgctcattttctcaaagtaataaggcaaatgttaaaaaaaatcatttctgcattatgcattaataaaatacagatgatgaaatggttttcctcattttctttttagttgtctttcatgatttttacaaagtaaatttatgaacagttcagtgcagcttttcgtttttaaggtattaatgcttcttccaatgttttgattattttgcattcaaatatggccaggagatgtgattgttaattacatttctttatgatttgtgttacagcaaaatgttctccattgaattttttggtgtaacatggaaaacttttcttctgttgtgaaagtatgtgtactattgaacagcaagataacttatggaaattttaaagttcttagatgaggcttaactgtggaaatattcttcttttttcaattctgtctcccactaaaatcattaaggctctctgggtcttgagacatatgaattcttcaccttgattgtaggtacccgttaacagaagtttactaggcatgttttaatatctgaaagggttgtaattctgggttttgagttatgtccctttcctttgccttttagatttttgtgattgtgtcttagactaatgccagtagttattgtggagatttatgagctagcaagtacttatgagacatctgggtttccatacactgtaaagctgaacaatttaaagcacaaattttggattcaggatacatgtttttaaatctcatgtaatggaacaagctatcatttaatggtggttgtcttgagtagattacttaccttttccctcatctcagagagtccctttctttatctgtcaaatgaagacagtaataccaacatcacagatttattttgaggatttagagataatgttatatgctccacactgtgcttagtacatagtaggcactcaataaaggtaaagctaacaaaattttgataaatattattttaatgttagcaaagaaaacatgcttatgagcttgaggatttaggatatagtatgcctggcagagaccactaccaaactgtcccaaaaagtagttgcttttttcttttaggaagtctccaggtcttacaacccagagtttggaagggctggggagagagaaaaagggtcagagaatttgtatttttaatgcttggggttgctaggtagttgagtatcggaaaagtgaatatggaaacttgcctcagttgacaaaagtagaacgtaagaaagggaaagagaaatagtgcctcaagcaaacaattaagagcaatagtttactgttttcagatatgatatatagactacccacctctacccagagtagtgtttttaatgcagactcctaggcccaggtcttgactttctgaagtatattttcagtcatactgaggtttgaaaatctcctggtataacaaaataaggttgaaattagttcaaatttttatttttccacttattaactgtacccatggctcttgtccttcttatgttccactccaactctgcttttaccactctagccttttttctccttgttattacataactcaatcaactaactgtacctattcaactagatagttgtgtaacatgccatcatttggtcttaaaccattggagtgctatcactggctcctcgtactgaacttgtacagttttctagctgacagctacttttaatttcctgacctctcatccacaatgtctggtcctgacatgactgccaattcttctccctagtttctatgtggtctgaattactaccctgaccaatctgatgcccaggtttgtttgttttttatgagtttacccaatttagagcctggatagcaaacttaactcaagggtatggactcagatgcaaaacttcagtgtgtatagcctacagactctataatcaccgaatacttctttgtaccccagtgcagatcgtgtccatatctaatttaataggcaagagcacacatgctaggtgtggaaaaatggacaaggattctgcattttaagcagaatctcaaaaaataagcaataataattaaccagaattacaaccctttcagatattaaaacatgcctagtaaacttctattaacgggtacctacaatcaaggtgaagacaaaggacattcctgtgagaggtaacagtaagagcaaatacatgacttaggactagtaaacgactcagtgttaggttttctataaacattccattgtttctcacgatgcagtatgagtaacacctgcttcaaaaatttcagagggtgactgtttaaaattttattcatgggtgctctagacttattaaatttggatccatgggaatgcgactcaacagtctgcattttcaacaacagatgcaccatcaaaaaacatcaagtagctatatataactaaggatatgtagttgaagacttgagaagactgagccatgtatttctaaaagggctgaaaactatgtagtttagagaatgctcactttctataaaaaagtggcagtgtttggaattagccacacactgtggaaccaattaccatttaagttataatacacaggattctagaagaaaagaaaatgatcttatctgaagtccagtaagttttgttgtgtgtgtgtgagggaaggacggagggagagagagaggctgagggagagagagagagagagagagagagagagacagaataggatgacagtgcaaggaggccctggtgtggcttctaagtggcaaggaaccttcagtaagaaagcaggcacagtctaaagacttgaaaccatggaaattagatagattccagtgaaggctatggtagtgagagaaaagtcaagtaatgttattgaattaaattcttacttggatttcctagggaagagatggatcaagatggtgaaatagaagactccaccaatcatccccttcacacgaacaccaatttaacaactatctacatgcacacacacaaaagcttcatcaatttaacaactatctacatgcacacacacaaaacctttgtaagaactcaaaatcaggtaagtactcatagtacctggttttaacatcatattggtgaaagaggcactgaaaaggtagaaaaaacagtcttgaatcaccagtgtcgcccataactccctccccgaccagcagcagttgcatggtgcagagagcttctctggttgctgggggagggagaactcagcaattgtgagacattcaactcagttctgtcctgttagagcagaaaggaaaaccagaccaaactcagctgatgtctggacacagggagcatttaaagtagccccagccagaagggaattgttgatactagcagtcagaacttgagttcttgcaaaccttgccacagagggttacattgccctgggtctttaagtaaacttgaaaggcaggctaggctacaagggctgcaacactaaggcaaatcctagagctgaactgagtccagatacagtagactgtggggcacatgagctactaagacaatagctgggttggctaagggaatgctgtcatcacccctcctttaaccttaggttgcacagctcacagctccaaaagaagcgccttccttctgcttgaggagaggagaaggaagagtggggaggactttgtcttgtatcttggatactagctcagccacagcaggacagggcactggtcatagttgtgaggcccctgtttcaggccctagctcccggatgacatttctagacataccctgggccagaagggaacccactgccttgaagggaaggacccaatcttggcagcatccatcatttgctaactaaagaggcctcaggccctgaataaccaacagtgattcccaggtactacatcaaaggccttggttgggtctctgattgtaagcttaaggtacccgcttggctggccacaggagggtagagcatcaggcaagctcttggagtccctgactccaggacttgactcttggatggtatttctggacctgccctgggcctgaagggagcccactgccctgaagggtgagtctcaggccaggcaacattaactacaagccgacttacgggcccttgggccttaagggaacattgacagcagtctggcagtactccccatggcctgtggtggcagtggccacggggtgaggcacctctgcctttggaaagtggagtgaacagtagaaaggactacatcttgtggcttaagtgccagtgcagccacagtataatagaacaccaggtggactgctaaggtttttgattctattatcggcctcctgcacaacacctttgaatccacctgggatctgggggaactcaccacactgaggagaagaacacaggccaggctggttttgtcacctgctaattgtaaagccccagggttttgagcgaacaggcagtagccagggggtgattacagcagggctcgggtgagacacagtgctatgtttgcttcaggtctgacccagtgcagtcatagtggtggtggccacaggggtacttgtgtcactctgttcctacctttgggtagtgcagaacagagagagagagagagagagagagagagagagagggagagagagactccattgcttgggagaaggtaagggaagagaacaagagtctctgcctggtaattcagagaattctcctggaactagcccagcaccatcaaggtgatacctctatgagtatgcaacagccaaagaattaatggacttggcatgccttctgaagcagctgcagcttggatcacaaacccaatttattttgaatatctggagagcttttctaagaaagagaggtacaaacaagcccaaacattgaagattacaagaaatacctaactctttaatgcccagatgacaaagaacatctactagcatcaacatcatccaggaaaacatgacctcattaattactaaataagacaccagggacaaatcctggagaaaaagagatatgtgaactctcagactgataattcaaaatagctgtgatgaggaaactcaaaagaaatcaagataacacagagaaggaattcagaattctatcatataaatttaggaaagagattaaagtaattaaaaagaaacaaacagaaattctggagcagaaaatgcaatgaggatactgagaaatgcatcagagttttttaatagtggaattgatcagacaagaaagaagtagtggtcttaataactggctatttgaaaatgcacagtcataggagacaaaagaaaaaagaatatgtagcacgcatacagaatctaaaaaatggtggaaaagggcaaatctaaaagttatgggccttagagaggaggtagagaaagagataggggtagaaagttcattcaaaggaaaaatgacagagaaacttccaaaacagaaagataccaagaaacaagtacaagaaggttgtagaacaccgagcagatttaacccaaagaaaactgcctcaaggcatttaataatcaaacttccaaagatcaaggataaagaaagaatcctaaaagcagcaagagaaaataaataacatacaatggagctccaatgcatctggcagcagactattcagtggaaaccttacagaccgggagagagtgggacgatatatttaaagtactgaaggagaacaactttaacccaagaatagtacatctagcaaaaatattcttcaaacttgaaggagaaatattttccccgacaaacaaaagctgagggttttcattaacaccagacttgtcctacaagaaatgctaagggtagtatttcaatgagaaagaaaataatgataatgagcaaaaagtaatctcttgaaagtacaaaattcactggtaagaggaaatacacagaaaaaacacagattattatatcactgtaactgtggtgtgtaacactcttatcctgagtagaagaactaaacgataaaccaatcaaaaacaataactacaacatcttttggagacatagacaatacaataatatgtaaacagaaacagcagaaagttaaaaagcaggtggatggtgttaaggtgtaaagtttttattagttttattttgcatgtttgtttcttcatgcaaacagtgttattatttagttgaaaataatgggtcataagatagtatttgcaagtatgtggcatgccaacagtgaacaatctgaaaaagaaataaaaaattaatcccatttacaatagccagaaataaaattaaatagcggggcgttaaccaaagaagtaaatgatctaatgaaaaccataaaaccttgatgacaggaactgaagagggctccaaaaaatggaaatacatctcattttcatggattggaagaatcaatattgtttaaatgttcatcctacccaaagcaatctccagattcagtgcagtccatatcaacatagcaatggcattcttcacaaacatagaaacaacaatctgtacagttatagggaaccacagaagacacagaatagttaaagctatcttaaacaaaaaagaacaaaactggaggaatcacattacctgacttcaaattgatggtggtggtggtgtgtctggagcagcctctgtggggatgccagctacagtgggggagatgcagcttgggctacacactccgcagagccagtgggggctggtaacaagtgggagccccatcccctactgagttggcagggtgggagccccatgctcctgtgtgcagctgaaaatgcccagccaaggttgtgaacccaggcatccttgccctctcaggggcctggaaatccatccctgcttctgcaggctcagaagtgccttttccctctctctggcctcttcccgctcctggtgcctgctcttgggtggagcaaagttgtggccttgtctgggtgttgtagcaacccaactgggtgtgtgcatgattggggcggtgctgacacagcagaccctgctgcctcagcttcctctagactttgtgcactgaggagcatgagagggatactgaggaggctgagggttgcttggcacgggcctgcatgcaccccttggcacaaacagcctgggtgccatggatggcagaaggcagacagtctccggggtggaaaggggtaggtttcaggtgaaaccccaccttcaagacagataaagtctgaaatctgggggccaggctgccagttccaagtggagtccatggcccagagtgatagcttatggtactttttcttggcccacccatggctccccatggaccaatcaataatcatttcctccctgtgagcccataaaaaccccagactcagccagactctggcagacattgggattatcagctgcaggaaggagctacccacttttggtctcctgagtgttctgtcactcaatgaagctcatctcctggctgaaacatgcacccctgttcactgtgttgtgggcaacaaggagagaagagttgcagccctttggggaccccagacttagggggtccccgagccagagatgtgacatcctctttggggctctgcagttcctggcatctgcaacttccaagcatcaccacgttcctctcgtccagacacaggttgcttgcagtggaaggcacgtgcagtacatctggtccagccacagccttgcatggagctggtacctgtgccagtgcctggagctgcctgcccgacagcagaagccagcatgcctggctgggcgcagtgtctggtccccacacttgctcacccacacacccctcacttctctgccctggcttgcccttggcaggtatgggatccaggccagtagcatgagccaagtgcagcatgctgaaccgagtgggcggaataagaacttgtaagtaatactgaagcagaaggtgctgccagctacagagttttctagcttgcaaaatgacaccccaagaatcccatgacaaaattatactacagagctataataaccaaaatagcatggtattggcataaagacagaagcatagaccaatagaacagactagagaaccctgaaacaaatccacacatttacagtgaactcatttttgacaaaactgccatgaacatacactggggaaaagagagtcacttcgattaatggtgctggaaaactggacatccatatgcagaagaatgaaagtagacccctatctcttgccatatacaaaaatcatatttaaatggattaaagacttaaatatgagatgtcaaaagtactacaagacactactacaagaaaacattgggggaaactctttaggatattggtctgggcaaaaattgcttgagtaacactgcacaggcaccagcaactaaagcaaaaatgaacaactgcgatcacatcatgttataaagcttctgcacagcaagggaacaatcaacaaagtgaagagacagcccacagagtagtagacaatatttgcaaactatccatctgacaaggtattaataaccagaatacttaaggagcccaaacagctctagaggaaaaaaaaacttataatccaatcaaaaaatgggcatacagaggacaatcagacatggaaaagtgctcaacatcactgatcaccagagaaatgtaaatcaaaactgcaatgatatatcatctcaccccagttaaaatggcttatctagaaagacaggcaatagaaaattctggtgaggatgtggaggaaagggaacccccatacactgttggtgggaatgtacattagtactaccagtatggagaaatgtttgtaggttcctctaaaaactgaaaatagagataacacatgattcagcaattctactgctggatatataccccaaagaaaggaaatcagtatatcaaagaggtattctgcactgccatgtttgttgtagcattcacaataggtaagatttggaagcaatctaagtgtccatcgacagatgaatgaaatgtaaagaaaatgtggtacatatgcacagtggaggactattcagtcataaaaatgagatcctgtcatttgcaacagcatggatagaactggagatcattatattaagtgaaataaatcaggcgcaataaggcaaatgccatgtgttctcatttatttgtggaatctaaaattcaaaacaattaaactcatggccatagaaagtagaaatatggttaccagagattggaaagggtagcgagggggtcgggaggagattggaatggttattgggtacaaaaaagttggaaagaatgaataagacctactatttgatagcacaacagggtgactgttgtcaataataacttaattgttaaattttaaaataactgagtataattgtattgtttatagcacaaaagtataaatgcttgtggggatagatacccgattctctatgatatggggatggatacctaattctgtacgatgtgcttattaacattgcatgtctgtttcaaaacatctcatgtcccccataaatatatataccaactatgtgctcacaaaaattaaaaaaaaataagtaaattcttacttgattatatttatacaagtcttttacatatattctaatatatttacattaataatcataataatttatgagggtaagaactcatgtccctcttttggacatcaggaaactgaggccttgaggatttaagtggtttgtttactaccttatgtctaataggtcaaatagtcaaatggtgaacgaaatttgactcagagtccagtattattgttaatacaccacactgtctccctcacctattgaaatgataacagtaataatgacaactgacattaattgaaagcttaccacatgtcagatgtttttacagcactttattaatttatttagtcatctttattgagttattttttttctaccaaagttggctttctttcttgactgctaaaatccttgtatctaacatatgtctcttccatgcaaatcttcacaactctttaggaaacacagaccaaaaaatgtagggaaaaaatccaagaaaaaggagtgctggggggacacatgaattacaagactggacagattatgttcatttgggactatgttcatgcagttgtctctgtcaatcagttatagggctgtaattaagtaacaaaacatcacctaaactaacatttaaaatgttagctgacagggtacatttctatgaaaaattttagctgagcctcttattttatgaactttaggttattatgccaacatgcagcatgtaatgtcatgcttgttgccctaaggtgtatttatcatcttcgaattgtttgctttctcaaactagacaggcagagaacaaaaaccagttgtatgtattaatatatagtcagctttaaacttaaaccaattctaaatagatttctaatggctcatgaatcaagtatctgattaacagctttaagaaagattctttttttaatttaattttcttattatacttttaagttctcagacacatgtgcagaatgtgcaggatttgttacatacgtatacatgtgccatggtggtttgctgcacccatcaacccgtcatctacattaggtatttctcctaatgctatccctccctccaccccgctacaggccccggtgtggtgtgtgatgttcccctccctgtgttcaggtaaaagaaagattctttcctgtccagaaacagaggtcattttagaacttggggttaggcagaggaagaaaaacctagaaggtgtcagatgctagcagagcatttttgcctacttcatttctttgcatccctcttttctggtttagttcttgggcctgaaagtcaatatactctgcttttcttcagtgaatgtcttctgatttagaattaggccaaaacaggcttggattgaaagatgaaaatactgctagtaactgattttacagtgattaaagcatcaatagaatagatcttgtcagtattcttgtgagagtactatccaaatgatgcattgtggtttaaataaggctttctgctctgaataggcctgtacttaaaagtatttattgagtacccacaatgtataaggcactctgttctgtattctgaggcacacaaacataaatcagatgtgagacctgcccttgaggagactctgttacctagtagcaacaagacttttatgtgaaagtgtattttttcacatttcacatcatattccacaaaaatatataggtatgtatatattttttccagatttcttcctttgcacacaatggtttggcgagcttgcttttatgtaataagagatcttaaaatgcagaagcagttatatgagcaggtaactgtgcgagtagaaaagagaagtacattgcattaatttactgattgttcatgcctcactgtatgaataaccattatatttatattacaaattaaaacatcttaacttgtagagatagaaattacagaatatatcttgttttgctgtaccatgttagttttctttttgttcagatagttctgtctgttaccattttatggtgtccagtccatcattgatgggcacctaggttaattcaatgtctttgctgttgtgaatagtactgtgatgactatgcaagtaagtgtgtctttttggtcgaatgattttcttttggatatatacccagcaattagattgctaggtcaaatgttagttttgttttaagtttgagaaatcttcaaactgctttccacagtagctgaaataaattatgttcgcatcaacagcatataagcattcccttttctccacagcctcgccagctttttgacttgttaatagtagccattctgactggtgtgaaatggtatctcattgtggttttgattaacatttctccgatgattagtaatgtggagcattgttttatatgtgtattggccgtttgtatatcttcctttgagtagtgtccgttcatgtcttttgcccatttgtaatggggttattttgtttttgcttgttaatttgtttaagttccttatagattctggatattaaaccttggtcagatgtgtagtttgtgaatattgtctcaccttctataggtggcctgtttactctggcagtagtttcttttgctgtgcagaagttctttaattacgtcacacttgttaattttttgctttttgcagttgcttttgattacttagtcataaattctttctcaaggaagatgtccagtatggtttcctaggatttcttctaggatctttatagtttgaggtcttacatctaaatatttaattcaccttgagttaaattttgtacttcatgaaaggaaggggcccagattcaatcttctgcatatgggtagccagttatcccagaaacatttattgaataggaagttctttccaattgtttatttttctcaactttgtcaaagatcagatgactgtaggtgtgcagctttatttctgggttctctattttttttttatcttagtcagtgagtctgttttagtaccagtaccatgctggtttgattattgtagccttatagtgcagtttgaagtcagataatgcgacgcttctggctttgttgtttttgcttaggatttctagggctatttgggcaatattttagtttcgtatgaattttagcatagtttttttctagttctgcgaagaatgttatttgtagtttgatagcaataacattgaatctgtagatttctttaggcagtgcggtcattttaacaatacttttcttccaaatcattagcatataaagtttttccatttgtttgtgttgtctttgatttcttttggaactgttttgtagtttttgttatagagatctttcacattttggtttgaacacatcaaacctaagcattttattcttttgtgcctattgtaatggaattgcattatttacttggctctcagcttggatgttattgttgtatagaaatggtactgatttgtgtatgctgattttgtattagaaatttgtactgaaatagtttatcatttccaagaggcttctggaagagtgtttagggttttctaggtgtagaatcttattgtctgtgatgagagataatttgacttcttttcctatttggatgcttttatactttctcttgcctgattgctctggccaggacttccagtactatgttgaaaaggagtgatgacagtgggcatccttgtcttattgcagttttcaagagaaatgcttcgggtttttgcccattcagtatgatgttggctgttggtttgatatagatgactctttttattttgaggtatggttctttgacgcctagtttcttgagggtttttatcatgaaaagatactggattttattgaaagctttttctgcatctattgagatgattatatggcttttgtttttcattctgtttttgttgtgaatcacatttattgatttatatttcttaaatcaaccttgcatcccaggaatgaagtcctgcttgattgtggtgcattaactttctgtcgtgcttttggactcagtttgctagtattttgttgaggatttttgtgtctaggtttatcagggatattgtcctgcagttttctttttttagtgtaactttgccaggttttagtattagggtaatgctggttttttagaatgagtaagggagatgtccttcctccttgttttgggaatactttcagaggaatgggtacaagttcttctttggtagaatttggctgtgaatccatctggtccagggctttttttttggttggaagtttttttttttaaattactgcttcaattttggaactcagtattggcctgtttagggtttcaaatccttcctgattcaatcctaggaggttgtgtgtttccaggaatatatttatatcttctagattttttagtttctgtgcatagaagtgttcataatggttcctgagaatcttttgtatttctgtggggtcatttgtaatgtcacctttgtcctttctgattatgcttatttgaatcttatgtctttttgtctttgttaatctagatagtgtatgtctttcagcaggttttatattgtaccatgcaggtaaacctacaagcccgtagatggcacttacaggtaagagctggctgcactcaatacagctaggtatatactcgatttttgtttactgagagactctttgtagaggaccctgctgtgccacgatttcagcggaccaggctggggcacccagcaatggcccacacagactagttccaggtcaacaagctggccctggtggcaagtctcattgtccagaagagacagctgctgtagcagctctcttccctacccaggcttgtgacagggcagagcacaattccagttcctactgctgaggcacttttcacagttttggctgtggagaccccctacctaactccagaacagaatttccaatctctggcaagggactaaaatgcctgcgtggttgtgccaccaggttgccaaaacatgactggcttttatgcacccaaattaaaaatggcatcctgctcttagccttgggtatgggaaaatatccgcagcttttcctggtgtctttccctcagagtgtcttcaagcctcttcccatgttagctccaggggttgggagaaagaaagcgctgtccattggcctgggttgcttggatccccagtggaaagatgaatcatagggagaggctctctgcctctctcatgtactttaatcacttttattttttctcacctttatcagctgtatgccatcacaggggctttgctgacattcttctcccaaggatctgggatgtccctcacaattctggtggattcccattttccttcttgaattaaagctcacagagtttatctatatgcactatgttgttatttccaagtgcctgaggcatgctcaaatacgctgtcttgggaaaacaaaacaaaacaaaacaaaaaaaacaaaaaatcttaactatctttattgctcttcctctgacacctagaacaagtgtcaagaaaagtctcagctcaataaatagttgttaaatgagtgcttgattgaataattcttaattcttaatctttcccaaccaatggaccagtaaatctcattagttattttaataatgtctcttagagagtaaatttcctctgcatttttacaacttataacttccacttgacccttgttctttcagacctagattaaacaataatttcttaactacagtctattttcaacctatcttgcatacttctattatactaattttcctcactgttttccttgtcccattttattgcttataacatacacattttactaggggactcatgaaccctgttaaccatcccttttataatgtgaaccttgcaattaagcattccattacagaatatcttttatgtctgcaaagttttacatgcctatggtttccctttttatgtagtatttttgtcttctcttgtagtccccagaacactgctgggcccagaatgagtacttaataaatacttgctgtcctgacatacagacggttatccgtttgtgtttttgtgaaaaagctaaactcttattcaacaaaatggtcgaaagaaaccagaaagtaactatgcaagtagttaggaagaatatcggtgaatggaaattttaatcttaaaaactagtgctataaaggggtagtacaaaggaattttggggggagtaattaaactgttctgtatggtagttacatgatgctatgcatttgttaaaattcatagaaatgcacaacaaaaaggtgaatttcacagtgtataatttaaaataaatttaaaaaatatttttaatataatgaaggttttaacttttttttttttaatgcagtatactaagcagcatcttgtctccatgttctggagttatggacttgctttttctttcttaaaaatagtttcaactggccaggttcagtggctcacacctgtagccccagcactttgggaggccgaggtgggtggatcacgaggtcaggagatcaagaccatcctggctaacatggtgaaaccccgtttctactaaaaatacaaaaaattagccgggcctggtggcacatgcctgtagtcccagctactcgggaggctgaggcaggagaatcgcttgaacccgggaggcagaggttgcagtgagccaagatccgagatctcgccactgcattccagcctgggcgacacagcgagactccgtctcaaaaaaaaaaaaaaataaaataaaaatagaaagaaaaaaatagtcttagctataatgataggtgattatttcccttcctggtctcacgcataatactttggtataacccaagtttggtgttgtactccatcctcttctttttccttctccacatttaaaagaaattattaagtatagttgatgaaattatgccttcattgatatacagtagcctgatttatataaagtttaccaacttcaactattttttttctcctcggaacaaactttcaaggccaaattcttgttcttcataaagcacccataggtgcaataaaaatgcagaatttagaccttagtttaagtttttctttttctcagcaaatactattcacagtcatgagccacgttttccttcaattgtactggtagataataggcactaggcagtcattgaatgtatccaaatatacctggtccccgtgttggatggaaaagctagagagcttcattttgtgacctgatatgaaatatattcataaatacaccatcaggtagagagttaaaaaaatactgctttaagttataccatagcttctaatcttaaatttgtgatatttgtaaaaaatcctgctgatttttaatgaagactgcataattaaagaaacctcctaagacttttcacaagtcaaaggacacccagctctctaatcattatcataaactaaattgggcaatctgagacgttttatgaaaattactcgtattttaatggattttatgcaatatcatttaaaatatattttggatttcagttctagacttgaatgctggaaaatgtattagacaaaaatatttattagaataactgcttaaaatatgtttttaactgttaaaggaattttatattttaatactatagttttctgtttattagtttaaagccactctttttttttcattggcttgactagctcgcttccgcttttcaatttttaggatgaaaaatttcctaattgtttaacaaattactgttttttttttatttatgacttaattctttaatttcctcttgtataatatggtggtaaagatcatgggttctaaaattgtgctgtttagtttgaatctctgttctaccattttctagctgtgttctcttgggcaagaaagttaaactgctctgagaactgttttctcattaattacaatgagacacagtgcttagtgtcatgtctggcatatgatataagtatttaaaatgtataattctcacatatatttcactgaagtacagcaaattgaattttaatgtcccactaaactttaaacattctaaaacagaaacaatattttctacttttttgctccctgaaaactgaggctgtggaaccagaactaacctacaggatattgggggtagcttccactgctaggatatttcatagaaacatgaactgaagaatatggaaaaagcattaatcatttttaaaattgctacatagcagtaatcttttcaaattatttcttaacacttccacttgtttttataccaagaaaaatggaattatttatatggaattctacatgttctggatggctgggaatatttagtgctttttttctgttcccctaaaaagatagttacttaggtgttggtctgtttcaaatctattgtgaaaaagttgcagtattctatgatgaagaatcattaacaagtatttatcatgtagatattttaaaatatccataaatgtttacagaaactgcatctataccaataaacaaagaaacattcctgagatatacctgaaacatacctgagatgtactgaagcgcagagatgattagtaacctctttaaattttagagagtttataatgggcagaatccaatacccgtttgctgtcagttatacctgtttgccagttagtcagatgctcaggtaaattagatatatttcaataaattatctattgttggatcactaagtgatactttagaataaatcatctaagatactttagaataaatcattccagttgtgcatatgaatgcatcattttaatggagaaaatgtatcttactgtctcaccatggaaactggcttataactgaacttcgctttttagtaaaggggtattcagtcttttggcgtccctgggccgcattggaaaaaaagttgtcttgggtcacacataaaatacagtaaccctaatgatatctgatgagctaaaaaaaaattccaaaaaaatctcatagtgtttttaaaaagtttatgaatttgtgttggaccacattcaaagccgtcctgggccacatgtggcccttgggtccccggttggactagcttgttttagtatatggcttcccactggatcttaaacaggttttagccacatttttggtaagcagttcagcatttttaaaaatcagtgggtaaaatgagtatttgaatttctacaattttatttcctgtaatttatacttactactaatattgataaaattaaaacaaacaagagaaaaaagcagttctgcttacacaacatttgagtaataacacaagacattagagttcttttttcatacactttactttcaataaggattctatgttattttcttttttcaacttgaatactattagatttatgtcaataagtgattctctgaatcaggatcaaaatgcttatggcaaaaacatgttcatagagtgaataaatgctttgcagcttgtctatactttaaaatgaggccatggtttacttttcgtcttttggtaaatatatggagatttgcttttagagtgaaaataggtaaagatgtaatgtggatcacaataattgatttcacacataaataacccacttaacaagagagtgatgaaggaattgtattatcatccctggagatggaagagttcagtctggcttgatggattatttttgtttttttctgtttgtttgtttgtttttttatttttctgagatagtcttgctctgttacctgggttgttacccagtggcatggtcatggatcactgcagcctcaatttcctggcctcaagcaaacctctcaccttggcctctcaaagtgctggaattacaagcgtgagccactttgccaggcacttgatggattcttcaagcatccatgactcctatttttaattgaattgttatacaacttaacacccacaattttctgttcaaccaggtggtgaaattacaggttttaatcactcaacacaacatttgatgttcagatgaccttccctttcaaaaatctgtaagacaagagctggacactttataatagtcaaaataacttgtaaatggtagatgttggcatacgattttttattgatttcttgcttttttgcacatcttgtgagcagtggcactgactgcttttgttctgtattatcttttcaaagatgcaaatatccttgaaagatatagtgtctcccttcagagcaaagggtagatttgcttactgtccagtataaaggattcagattatgtatcctttccctctgtatcatcatgtagaaattgaggatcaggaagcaggtaaaagaaaatgctgatactctgattactgctgtatctgtggcccaggggtctcgtgttatctgccagcatccttaaaactgtgttaggcttacaagttagtttgcaagtagggtaaaatctcagactccaccattcttgacagtagttcttatttctggacatactgttgttcttgatagtcatagttcaaataactatgctaacaattaattgcacagaaattcagtaatgagcccatagaattatatgacccaagccccttttattttagcaccttttgtttgctagttggttaacttcttggatcatttgattctggtcttatttaaccaattaggtaatatatggcagttgttctcagctgggcagtttggaccatgtttttttggcttgtgtctgagagtacattcttagtgctttctggtatgttcatctggggcacaccgctgtggcttcagactagttcttcttcctatggcaaataaatttgttttggtgggtaaacaattatctaagttgctaggctcccttgaaaggaaagtgtttaatttcttttgtaatgaaatcttatcactttaccaactatagaggaaaaagcccagtgctacagctaacatagtctgaaaaggtagtatttgcttttgttgtgtgtgttttctttagtcatggggagcccttcaggtatgatgattaccatgtggacccaccatcagtgacagatgtttaacagttattttcccagaccagcctagagagggtgaccagggaaatgcagtatttttgtgtgtgaaagtaacttgatcaagacttatttaccaactgagtgtgcagccttgaagaggcattgatgtaaacagattttagattgttaagcaacatttattaatatacattgctttgtggagattcttacaacttctttcttaagttttttttttttttttttgatatggagtctcgctctgttgccaggctggagtgcagtggcacgatctcggctcactgcaacccttgcctctgggttcaagcgattctcctgcctcagcctccccagtagctgggactacagacgtgcgccaccacacctggctaatttttgtatttttagtaaagacggggttttatcatgttggccaggaggttctcaatctcctgacctcatggtccgcccccctcagcctcccaaagtgctgggattacaggcgtgagccaccacacccagccacaaattcttttaaaaagcaaaattgcaatcatcctatgtttgtggaaggccatttacactcttttaccctgaatagactgtaactgaaggttagttttgaaatgggtggctatgtttaatttttcagtgtgtgaaaaataaaggcatgcctatttgtctcattatatgaagttaataaagcatgctatttagttagacaagggtttcattgttttgaaagctgatcctgtgatctaaaattctgagagaattttctgtggaaattacccagttatataatgtgtacaaagatttgctatcttctgctgttaaacatttaatagaataataattattaaggatatataaaatgaatttatataagttgaattggggcattgtgtgccatttcagtgaatttgaacaatctgccaaaggattatgattctttcctgcatttgagggcttgcttcacagtgagtgttagattgcgattctgtcagagtgatgccattagcaataggtcagacccctgaataattttctgttttgctccccttctttcactttatttatagttcagttatttatggttgccactgtaataacacttttgagtttaaaaaagccattgccttaaaatatttttgttgtattgagagaaaatttggttctaacaaagagacgttttactgggatgaaaatacagaaaggcctatggagaaatagctttttttcccattggaaaaataaagggaagtggagaagtacatttatttcaacctagaatcattaggagttgcatttctgagaattttcatgtgtgtttctatgggtattattagtcttcttcatagaatgatttgggggactttcggagattatgtcaataacttccttactcctcattatttcacaatgtttttggttttccccctttttcagaaacaaatgttggtggattttcacagtgaacactagctaagtacatgagtaggttttgagtatagggattgaggttcagatttatttaacttcagaacgttttctactgcttcagatttatctattcattgagagagagaatgcttttgcatttgaaacaatttaataggtgccaatctaagaaaaagagcaattttacaatttggcaggatgttctttgatgggaattgacttagcgctccagaaatatattgctccacagtatttaactgccagtcaactttcttattagattctcttactttagaagctcctttttatggatcattatcaagatataatttcttactttggtcagccctttttctgagcagaacacttttggagttttgctgtaattcaataaattgttatgtcttcttaagtttctcagggagaaatttacagtttcccagtgatccttcaaacatttactgggcatacaaagtagcctatcttgtttctcagagccccatgatgtgagtgaggaaagttattaggcttcattaatgcttaggcatcagcccagcgtattgtaaactacttggctgatcgtgctacctagcaactatattgctttctttaaacactttatcatccctatttgttgtttctattgatattgacagcagcttaagaaacattttattgaattgtgcagatacagttttcttatgtttgatcccaaagtccagttcttcatttacataccttcactattatactgccctaggaagactttcctatattatggttgatgcattattctgtcattcattagttttaatagcttgaggggagggattttctctcaactctatatatctctagtttcttatgtatatttaaaatactagctaccaatccttgagtacttattatcatttattaatttgtttattctctacatatttatagaatacccgctatgggtcacagatatgatagcaggcactagataacatgatcagccatgagagagcttataattaacaatctagcttattttttgacaggcagtgcaataggcacattgcatctgttatatataattttctgtgcaacgattctgagaggtaggtattatgactctcaactaatagatgaggaatttgagactcagagaagttaatcaagttgctcagtcacacagataaatggaggatttgagattcaaatgcaagtcagtcaggttctgtattagttttctatgctgtgtaacaaatactaagtatttagtggcttgaaacaacacacacttattacatcacagtgcctatgggtcaggagtcctggcacagcttagctgagttctcctctaaaagactacaatcaaggtgtcagcaaggactgacttctcaatctgatggctccactatggcagaatcaattttcaagctcatatgaatgttggcaaaattcatttctttgaggctgtagtgctcatggcattttgcttcttcatagccagaaaaagaaagaccctagtgtgagtcttctagaaaaagtattttataacataacatcatcattagagtgacatcctatcacctttgccaaattctattggttggaagcaaatagcagatcctacccacactcaaggggagggaagcatacaagggagtgaacaccaggaggtggggaacatggtggggccacattagagtgggtcacaggttccacaatctgtaattgttccactgtaccatgctgcatctagtaagagctcaacatctatgaattgattttttaaaattctgtaaagctatataacactattagaaaagtttaggggtaaaatccccataatctcatgatcccaacacagttcaatgagtctcctgagcaaggtgctaggtactcatgcctgctgtctcaaagccatcataatgatggtgtttgacttcctgttagtctttaaaaaatatacacagttctcctttttactgctgaaatcagagcaaatatattattctccagaattcctttctcaattttgatatcattaacattttttcctgttgctgaagaattgtatagctgtcagtttcagagtgctcacaacattctttcaactgtccatgccaccaaacatttattttatcagatccaaatgattggatatgcaggcaactttcaatcttccactgctgaaaacaagtaaatgaacaacaacaacagaacacagttacataactacttcagactcagaattctgccgtcttttggattatttacttaaactaggaatccagaagtgaaattactggatcaaataacatgaacatttccatggctctgggtgcatgctatcaaaatatttctgattttatttgactgacttaattaacagccttcaaaatttccaaggcatatgatagtgctattaggaactctgtgatcactggaaagacaatatcttaacctgtcctaaatcaaggtgttttggttgagagaagtggggagaattatcttctcttcatggccatgggccatttctaagggtcttagtctaccctggagttcaagtggaagacatggataccctcaggatactgccttacccttcatatcaaatgatgtcatgtctatggatatttttcctggtcacagtgtaggacagtgcctttcctacaatagatcagaggctattctcacaggacatttgggaaatctgtatttccttgtgtacagggacagattggactaatttatctatttagatgcagtactctgctattgtatgtatccactttagcagcacattttacagtagggttttctgcaatagaaaagtaaaaagaaaaaaagctaatgttatacacagtagactggctcatagttttcatccagttaacactaacaagaacagattaattgattattacttttcttgtgattcaagaactgatagtttggagtttgtagttacagtctgtttttaaaagtatctgttgtgagctggagaatttagctaccaaatttggtttgcatatgcctgccctgtgacctcacatcagcctgtttgaaggtttgtgtatttttgcttatccttatatgggaaggctgcctggaggatctgtctgaccaaaattagaagcactgtagcatttgtaggaagtgtggttttaggatgtggattgtctttgttgcatagagaaggtggtgagttggagaacatcttacagactataaaataatcatcatttcatagctcttaatggtccttataactagtcagattcccttgattctctagattcttgaacttgtcccttgacaaagttcccctagagagaattgaaatctatgcagaaactcactgtaccgaattggtaatggtagtgataagggcagggaagtggaagctggaatgaactggtttgtttgctttcaaaatcttagtgtaactctagtcagaaatttttgaaatggaaggtcaacatatgctaggctagcacttgtcacaaatttagttttggtacttgattgtgacagtgtgatttgtttcaaggaaggcttttgctttaaggcacctactcccaaagccctcagaacaacctaaaatacttgttcctctatttcccttttattactcattttctgtagccacctatggtcagaagccactgacactgttatggaagcactgttgtggaatgttcttaacttcacactttatttgactaaatacatgaaaacagtttcaaatggagataggactttattttggtaaagtcattgtaattcatatgaatcattgcttcttcacagaaactttttcttacgaaatcttaaagatccaggaggcttttattgctgctggcatgtttctttgtttcattatcacataatctcagactgggaaaggacaaaatgattacctaaaaaaacctatggtgtataaaaccttcaaaatactcaaaataaccaacaggtattcttgttttttcttaggccaaactttagaattaagcataatgcaaaagtattatgagtcatatctgcactcaaggaggcttcattaagttggcagacagtgtaattagcatgagacaacatacattgtagtgcgtgattttgttattcgtaggcttagtgtttaaatggtgctttttggtctgacagagcatgggtaactgtgtaacttggagcatgttccttaatccatctgagcatttgtctctttatctatgaatttggaatgaaaataataacagctgtctcataaggttattgttagaattaaataaaataagcatgtaaagagcttagcacagtgcctggcccataggaagcacttaatacataataattattgtattatactttacaatacaattatatctgcaatacagagagagacttaatacatatagaattccataacccattgctagcacactctaaagtggggtctgtgtctcactgtttcttcttatgagcccagccctaatatacccacttacttgtagcagaaagaggccaaactttgattaagggctcgttagattccatcattaaattatctactagtatggaatttgtgaccttataattataattaaagttccttcagaccataactactatctttattttagttttacttacatcagggtaagaacagtggccattaggctcaatgtgtactcagggactatcatcttgattgaactatagctcctaacattattaggcaggagtcgaacactgatccttccctagaagcagaagatcttagagctgaaattgggtattatactgattttgtttataatgatgtagaaattgattaaattgtgtacatactcatttggataaaaaaaggaagcaaaatcacagactggtaagtagaagttaaatttaaattatttagcaagaacacatcaaaagtgatattagttgtaaaagattgtcgaccttctataaaaatctcttaagaaaaaagccatataaaatatcatgaggctagacagtgaaaagtagtggaacaaacttaagatttagagttagggatatctaagtttgaattccagccttgacacccagttgctttgtgactgtggataaatttacttaacctttttgaatctcagtattctagtctgtaaaatggagataataatatctaccttgctgggctactataactattcaatgaaataatatatgcaaagtgcctgctatagctattatcacttaattgacctacaaatggtagctcttattgatatgaattataagaagacagtatctgtcttccagtattttcagaacacagcctcaaattgaaatcctcctgaatttggaaataattacagagcaccttctgatagcctaaagtgtctctctgtgatggaggagcccataacatatgtgcggtcagagctctaaatcttgtaaaaattttgtgctccaatctttttgtgttttggtaaagcagatgctatctctttaccataggatatgctagaaggatactttgtagggccctgggcatttttgaggactctttcttctgatcagctttcatctaggatttggagaataaggaagtactttgctagttgggaatggataagaatctgtgtgcaaacggtaactatgaacaatgcctccctgtattcaaatcctaggtaaaaagaatgcatgtaggcatattgtacattccacaggcgttagtacttaaagggtgggaggaatatctggcatcaaaaaagtgactaaaaacataagtaaacaccactaataaatggagttttctccaatcaattttggagaacccatcaatttaatttggtacatgagatgtttaatccaggagatttattttgaataaatatttccaaataagagtcaaaccatgaaaaatcctgcccagtcagcctcaaagactgatgtatattactttttaataaactatcataggttgctgattacagccaccttacttttctcaaacttcccagaaactctagaaagtatggtcagagtcccactatgcagtaggagcttttataaaagcaccttgactacttgagtgtgggctggatttattgactttattctaaatatacagtgatgaaaagggataaaaggtgcagaactctggcagacactactataaccagttattcaaggttaatatcaccatcaataagtccgttgctataatatgccctatgacatgatgtgatgagaaaggcatttcttctttgtggtatttgtcccaaatatccataaccccagtataattatcagaaaagcataacacaaacttgacctgagggacattctacgaaatacttaaccagggcccctgaaaactgtcagggtcacaggaaataagaaaagtctgagaaactcttacagcccagaggagactaaggagacatggcaaataagtgtactgacacaccctggaaaggaacagaaagagaacattattagaaaagctgatgaaatccaaataggctggagtttagttagtagtatcataccaatgttggcttcttagttgtgacagatgtaccactatgaggtaagatgttaacaacagcagaaactgggtgagtgatatatggagactttttactatattcgcaaattttctgtaaatgtaaattgcattccagaattaaagtttattataattaaaatctaaaaacattttggtggtgctgagtttaaaataaaattgtgagatcaatcagttttagtatctactttgtgtccagccctgtggtgagcactatatggggagacaaaagcaaaaggcatagtccctacctccagatagcctatcaactaactgaagagatgtgactttgacatgtgaaatgattggcaaacattggtactctttgattaagctccaaactgggtggtaaaaactgcaggaggtcagatggagtggccacagagaacttcacagagtagacctggaagaatagattagaatggcatcagtggagagaggggagacttgcagatgaagggaacaaagagagaaaaagcactggagtgttgggcatgacatgttcagaggagaataaaggcagcctgatctgatctgggagagaggaggctgcatacttttacagaggcagatgaagctgggcctcattatgcagggcattgaaagttaaacagtcagagagggtaggggttggaaccggccacagggaacctcagtagcagttgggtaactgtatgtgtttcaattctttgaatttcagcctttggccaaatttatgtctgtcatatattaatcagctaacaactgtcttggcatgtacgtttgataagacaagactatgtggggacgatttcacctgaagaggtgaaagtacagccatgcccactttctggattaaaaaggctctttcttaactaaatgaaatatcacttctgaataatctcatgtatccagacctttcttgtctggaacttttctctgtccatgctgttttccatagtcagaaggaactttagtccctttattgttactgactcaaagcttgtttctgctttcaaaagaaatacattgtaattagatcgttttgctctttaaaaagttcgttgggcattttttttttaaagtgatgggtgcagtgtgtaataagaaaaataaaaagaacagaaagggtctgatgcctttgcactttcttgtctgttttttttgtaaatttgaagtacagaaattatatcttccacactaactttgcccactcaaaactattaggtaactgaactcttgacaaagcggaggcatgtgctgtattgttctcggtgtggtccagaaaccagaggcctcgtggtgttctactcagttctcctgtgtgcatactgcctgtgttcatgcaagcccacataatagggggttaggacttcgttgaagtcagttaaggctggtcaagagaaaggagattataataactaggaattcatgttcactcataagggatatttaggacagaatataagatgtctcaacctttggtgtcttacttagttacatagtttagaaggaactcgctcatatgtcagtctccagctgaatttggagtatgtctagtatatcccccccatgaaagtagtgtactgtaagtaatgaaaaacaaaacaaaacaaaaacaaggctttgtagtcagctaaatttagacatgtaatttgatttaaagaccattaatagctctgtcttactgagcaggtttcttaacatctctgagcccctgtttcctttgccgtgaaatggatagccaccccaaaaagggtttgatattcagaaaacacttaacaagcactcaacaaatgttagtcttctgtccgtaaacgattttatcctgtgcatatctcgctgctaacatatagtaaggcttggaaatttccttttggggttatcttgggaggcttttcctattcctttattatgtgaccctctgttagaatatatataggggcaactctaggcaaaattctgagacaaagaaacttcactgtcttcattacctgattcactctaggtggtccctccctctacttcaaatatgctcactgtctgccctttctgtgaagactaaagtagggaatcagtaatggtagagtttcaggcaccgagagtagaattggctttagggtaggatgttactctcagtgctccttatttcacagcctcatgaagccatctctgaagaaatgggaaaatgactaaataatgttctttctgactccagaaaaaagtatagacagatagtaattccagataaaaaagaagtggataaagttattcagaactgatttcatagtcaagaagaaaaacccttttaacccagaaactgggaatgactgtattttttttttttttttttactgttaacacctgaagacatagcagtttttgagaaacatcctttaaggagctgcttacttttcacactagactctatttttgaaattatgtaagccttaacgtgtttttagaaaaggtactgcaggcatgattgtggtagaagtgcaactaaaaaagaaaacagagtagagttttttttttttcttttttttaatgatactttaagttctgggttacatgtgcagaacgtgcagtgttgttacagttaggtatacacgtgccatggtgatttgctgcacccatcaaccggtcacctacattaggtatttctcccaatgttatccctcccctagtcccacacccgccacaggccccggtgtgtgatgtttccctccctgtgtccaagtgttctcattgttcaactcccgcttatgagtgagaacatgcggtgtttggttttctgatcttgtgatagtttgctgagaatgatggattccagcttcatccatgtccctgcagaggacatgaactcatccttttttatggctgcacagtattccatggcatatatgtgccacattttcttaatccagtctatcattgatggacatttggttggttccaagtctttgctaatgtgaatagtgctgcaataaacatacatgtgcatgtgtctttattgtagaatgatttataattctttgggtatatgcccagtaatgggatggctgggtcaaatggtatttctagttctagatccttaaggaatcaccacactgttttccacaatggttgaactaatttacactcccaccaacagagtaaaagcattcctatttttccacaacctctccagcatctgtcgtttcctgactttttaatgatcgccattctaactggcgatctcgtggttttgatttgcatttctataatgaccagtgatgatgaacattttttcatgtgtttgttggctgcataaatgtcttcttttgagatgtgtctgttcatatcctttgcccatttttttgatgcagttgtttgcttttttcttgtaaatttgtttaagttatttgaagattctgggtattagtcctttatcagatggacagattgcaaaaattttctcccgttctgtaggttgcctgttcactctgatgatagtttcttttgctgtgcagaagctcttcagtttaattagatcccatttatcaattctggcttttgttgccattgcttttggtgttttagacatgaagtctttgcccatgcctatgtcctgaatggtattgcccaggttttcttctaggatttttatggtcctaggtcttacatttaagtctttgatccatcttgagttgatttttgtatacagtgtaaggaaggggtacagtttcagatttttgcatatggctagcaaaaatagtgttttcccaacactatttattcaatagggaatcttttcctcattgcttgcgtgtgtcagatttatcgaagatcagatggttgtagatgtgtggtgttatttctgaggactctgttctgttccattggtctatatatttgtcttggtaccagtaccattctgttttggttactgtagccttgtagtaaagtttgaagtcagatagtgtgatgccttcagatttgttcttcttgcccaggactgtcttggctatgcgggctgttttttggtttcatatgaagtttaaagtagtttttcccaattctttgaagaaagtcagtggtagcttgatggggatagcattgaatctataaattgcttttggcagtgaggccattttaacgatattgattcttcctatccatgagcatggaatgtttttcgatttgtttgtgtcctctcttatttccttgagcagtggtttgtatatttacttgaagaggtccttcacatcccttgtaagttggattcctaggtattttattctattagtagcaattgtgaatgggagttcactcatggtttggctctctgtttgtctgttattggtgtataggaatgcttgtgatttttgcacattgactttgcatcctgagattttgctgaagttgcttatcagcttaaggagattttgggctgagacgatggggttttctaaatatacaatcatgtcatctgcaaacagagacaatttgacttcctcttttcctaattgaataccctttatttctttctcttgcctgattgccctggccagaacttccaatactatgttgaataggagtggtgagaaaaggcatccctgtcttgtgccagttttcaaagggaatgcttccagttattgcccattcagtatgacatcggctgtgggtttgtcctaaatagctcctattatgttgagatacgtttcactgatacctagtttattgagagtttttagcatgaaaggctgttgaatcttgtcaaaggccttttctgcatctattgagataatcatgtgcttcttgtcgttggttctgtttatgtgatggattacgtttattgatttctgtgtgttgaaccagccttgcctcccagggatgaagctgacttgattgtggtggataagctttttgatgtgctgctggattcggtttgccagtattttattgaggattttcacgtcgatattcatcagggatattggcctaaaattctcttttttgtgtgtgtctctgccctgctttggtgtcaggatgatgctcgcctcataaaatgagtcaggtaggatttcctctttttctgttgattggaatagtttcagaaggaactacgcatgcaataaagctcctctttgtacctcgagtagaatttgtctgtgaatccgtctggtcctggactttttttgggtgctaggctattaattattgcctcaatttcagatcctgttactggtctattcagagattcaacttctttctggtttagccttgggagggtgtatgggtccaagaatttgtccatttcttttagattttctagtttattttcgtagaggtgtttatagtattctctgatggtagtttgtatttctgtgggattggtggtaaatcctcatcatccttttttattgcatctatttgattcttctctcttttcttctttattagtcttgctaggggtctatctattttgttgattgtttcaaaaaaccagctcctggatccactaatttttttttgaagggttttttttgtgtctctatctccttcagttctgctctgatcttagttatttcttgtcttctgctagcttttgaatttgtttgctctttcttctctagttcttttaattgtgattttacggtttcgattttagacctttcctgttttttcttgtgggcatttaatgctataaatttccctctacacactgctttaaatgtgtcccagagattccggtacattgtatctttgttctccttggtttcaaagaacatctttatttctgccttcattcattatttacccattagtcattcaggagtaggttgttcagtttccatgtagttgtgctgtttagtgagattcttactcctgagttctaatttgactgcactgtggtctgagaggcagtttgttgtgatttttgttcttacacatttgctgaggagtgttttacttctaattatgtggtcaattttagaataagtgcgatgtggtgctgagaagaatgtatattctattgatttggggtagagaggtctgtagatgtctattaggtctgcttggtccagagctgagttcaagtcctggatatccttgttaattttatgtctcattgatctgtctaatattgacagtggggtgttaaagtcttccattattattgtgtgggagtctaagtctctttgtaggtctgtaagaacttgctttatgaatctggctgctcctgtactgagtgaatgtatgtttaggatagttagctcttcttgttgaattgagccctttgccattatgtaatggccttctttgtctcttttgatctttgttggcttaaagtttgttttatcagagaccaggattgcaactcctgctttttttgccttccatttgcttgatagatcttcctctatccctttattttgggcctatgtttgtctctgcatgtgagatgggtctcctgaatacagcacaccgatgggtcttgattctttatccaatttgccagtctgtgtcttttaattggggcatttagcccatttacatttaaggttaatattgttatgtgtgaatttgatcctgtcattatgatgttagctggttatttcgcctgttaattgatgcagtttcttcatagcattgatggtctttataatttggcacgtttttgcagtggttggtaccagttgctcctttccaagtttagtaattccttcaggagctcttttagggcaggcctggtggtgacaaaatctctcagcatttgcttgtctgtaaactattttatttctccttcacttatgaagcttagtttcgctggatatgaaattctggattgaaaattcttttctttaagaatgttgaatattggcccccactctcttctggcttgtagggtttctgctgagagatccactgttagtctgatgggcttccctttgtgggtaacccgacctttctccctggctgcccttaacattttttccttcatttcaaccttggtgaatctgatgattatgtgtcttggagttgctcttcttgaggggtatctttgtggtgttctctgtatttcccgaatttgaatgttggcctgtcttgctagattggggaagttctcctggataatatcctgcagagtgttttccaacttgtttccactctccccatcactttcaggtacaccaatcagacgtagatttggtcttttcacatagtcctatatttcttggaggcttcgttcatttctttttactcttttttctctaatcttgtcttcttactttatttcattaatttgatcttcagtcagtgatatcctttccttctgcttgattgaatgagccattgaagcttgtgtatgcttcacgaagttcttgttctgtggttttcagctccatctggtcatttaagctcttctctacacttgttattctacttagccattcatctaaccttttgtcaaggtttttatcctccttgtgatgggctaaaacatgctcctttagctcggggaagtttgttattacagaccttctgaatcctgtttctgtctcctcgtcaaactcattttccatccagttttgttcccttgctggtgtggagttgtgttcctttgtagaagaggcgttctggtttttgcaattttccacctttctgctctggtttctcaccatctttgtggatttatctacctttggtctttgatgttgctgatctatggatgtggttttggtgtggatgtcctttttgttgatgttgatgttgatgctattcctttctgtttgttaggtttacttctacagacaggcccctcagctgcaggtctgttggcgtttgccggaggtccactctagaccctgtttgcctgcatatcaccagtggaggctgcagaacagcacatattgctgccagatccttactctggaagcttcgtcccacaggggcacccacctgtatgaggtgtctgttggcccctactgggaggtgtctcccagtcaggctacacgggggtcagggacccacttgaggaggcagtctgtctgttattggagctcgaacaccatgtcgggagaactactgctctcttcagagctgccaggcagtgaactttaagtctggagaagctgtcagccgccttttgttcagatataccctgcccccacaggtggagtctagagaggcagtaggccttgctaagctggggtggactccacccagttcaagctgccctgccactttgtttacattgtgagcatggaactgcctactcaatcctcagcaaaggtggacgtccccccccaaccaagctcccgtgtcccaggtcaatctcagactgctgcactagcagtgagcaaggctccgtgggcatgggatctaccaagccaggcatgggaggggatctcctggtcggctggttgcgaagactttaggaaaagtgcagtatttgggcaggagtgtacttctcctccaggtacagtaactcacagctttccttggccaggaaagggaaatcctatgaccccttgcacttccccagtgaggcaacaccccactctgctttggcttgccctctgtgggctgcacccactgtccatccagtccctgtgagatgaaccaggcacctctgttggaaatgcagaaatcacttgtcttctgtgtcaatctcactgcgagttgtagaccagagctgttcctgtttggccatcttggaagtgatcttctttttcttttagcaggaataaaataggaaatcttagattacactttaatgctgccacatcttggaacatctgtcacgagaactctagggagccaggggtgcaggtgaggaatgataagaaaattcttattagacattttaaccaagacttgtttcttgttggtaaagagaaatgaacaaagcctccaagaaatataggactatgtgaaaagaccaaatctacgtctgattggtgtacctgaaagtgatggggagaatggaaacaagttggaaaacactctgcaggatattatccaggagaacttccccaatctagcaagacaggccaacattcaaattcgggaaatacagagaacaccacaaagatactcctcaagaagagcaaccccaagacacataatcatcagattacgttgcattgtgatcaaaccacttttggaaatattgcaaacagacaagctgaaaaaaaaggtgtatcttgctgtggttaaccctgaaattgagcaagaagaagccaatggtggctgggcatggtggctcatgcctgtaatcccagcactttgggaggctgaagtgggcggatcatgaggtcaggagattgagaccatcctggctaacatggtgaaaccctgtctctactaaaaatacaaaaaaaaattagccaggcatggtggcggatgcctgtagtcccagctactcaggaggctgaggtgggagaatggcatgaacccgggaggcagagcttgcagtgagctgagatcgtgccactgcactccagcctgggtgacagagtgagactgcgtccaaaaaaaaaaaaaaaaaggaagacaatagtttagtaggtcgtggcagtattcatttaagaatagacacagatctgtttggttattgaaagactacacagtggcaatactgcactcgcttattgccaaactgactaactggggtttcagatttgatgttccttttagatgtattttgtaagtaacttagtaaaagactgaattggcagctttaaatgctgtttgttcactcctcatccactccactgttaaatcatttgacacagagtaggcaaagacagggtcattacttttcttttttttcttttcttttttttttttttttgagacagagtctcgttctgccgcccaggctggagtgcagtggcgagatctgggctcactgcaagctccacctcctgggttcaggccattctcctgcatcagcctcctggtagctgggacttcaggtgcctgacaccacgcccggctaattttttgtatttttagtggagacggggtttcaccatgttagtcaggatggtctcgatctcctgacctcgttatccgcccgcctcggcttcccaaagtgctgggattacaggcgtgagccaccgctcctggcccaggctcattacttttctaaaatgaagagtgacccttcctagggtagcatttgaaataaatggagccaaatggagggagactccgtatctgaatttctctttgaggaagttgactgagtcagtcaaaaattataacctgtttggaaaaagacaaatacacatacacaccatgatttatttatagagttcgattatatgtaataattcagtaggagaaattgtgagcatccatttagaaagtttccaagtttattttgtaatactgtaccttcattgttctagttcaatatgctgtcacctttgtgagctcagtttctaccgttggccagttatattaaattttattaagtatgtcatcctttcaccagaactatagattgtatgcaatatagaaggattaaaaatctaacatttgtgctctccttattaagcttagtctaagtggcattgctaatagcaataaatgcttgttctctcttctctcattggcgttgccattctcttggctcctctcacctaacaaccttgtattgttgtcttagcttcttatttaaatacgctattgtaattgaacttttaaatatatctatttctaatctctcccaatagattgtaatgtgaggaagggatcacgcctatttatctttagctagtttagagagtctaacaaagttcattgagagtcacttaagagacactcaagaaatattgttgaattacttctgacaatcattttatattttagcacatcatagtcaagaacttctgtcaatgttaattaactgttagtagagaaagtgtgatagaggttgatcattaaaaaaggcaaaattcccactttggttaaatggttttttttttttttttttggaaggtcgacactttcttttataaaaagggtattttcccatttgaagcatcattggtgaagttttgatctttctttggtatttgcaacattcacactggcaccttctaaagcagaaactttgtcactccccttttttgaaagaaacttgacccttagcatgacagaaagggagcttgctaagacttgtgggaagacaactgtttactccaggaaacaattgtttaatgtacctgctctgtgtctttggagagaagaataccctgaatctcaaaaatctaacatgtggacagaaatgacttggaattctttcggtagaggtgaggggtgtggtttactgtttgaaaaatatttatttaaattcctggacagtgcattgtccacttgcaaatgcatttatttgctgaaaagggtatcaatagccttttaactccaaagtcatttttatcctggaagaaatttaaattttatttctaaatgaacccttgtgacacctattcctcttggttctggcaatatatggttttcagtctcatgcattcactgtgtccccttattttaagtcctattagggaaattaggaaattaccatcaccagatgctcccttataagtgtgtgttatagtgaacatgtgcctataggtgtataagaaagacaataattggctgggtgcagtggctcatgcctgtaatcccagcactttgggaggccaagttggacagatcatgaggtcaggagttcgagaccagcctgaccaacatggtgaaaccccgtctctactaaaaatacaaaaattagccgggtttggtggtgtgcgcctgtaatcccagctactcaggaggctgaggcagaagaaatcacttgaagtgagctgagatcacgccactgcactctagcctgggcgacagagctagactctgtctcagaaaaaaaaaaagcaataattatttatatattagaaatctccacttgagtgcaggagtttgaagctgcagtgatgcaagctcatgatactgcattccagcctgggtgaaacagcaagaccctatcttggaaaaaaaaaattaaaggaatagattccttcttggaaataaacttaatatgtgaaattttggacttgaaaatttgatcaagttaggaaacatttttttttaactttccctgaagattcaaagctgaacaaaagttcatatttgacatggcagaacctattagcaaagtgtgattatggccaattctgttcagctttatggagatgtagaacacactagtaggtatgtgtacttgtcatcaggcaatctcagggcatgggagaaatacttggtcattactctccaactgatggctggagagtaattacttcagtgaaggtacactatcatgcctagtgataccaggcctggcgaccattttaacttagcacagtgagtcatgttctcgacaaagtaagcattcaataaggtaggaaaagcctcaaaaaataatttatcttaaaggtcctctgctcatgcaaatgtgactgatgacattctgccagggtcatgtatgtaaaattcttagcatgtctcttcactcattcaaaaaaaaaaatctgttggaatgcaagttccctcaaagtatggggttttcacacgttgcccaggccagtctcgaattcctgggctcaagcaatcctcctgcttcagcctcccaaaatgctgggattacagatgagagccaccgtgcccagccttgaaagtacagtcttaataggacatctttatatctactcaaatttgtaaatatgctaatgatcgacaaattacttgacacaattgacattgactgaacccacctactgtacctcagaaattgaaaccattgatttaatggaacctttcatcaagtgcattagtccactaggcactcctatttattgagttttacattgatttttctcagttcaaaagagggcatatgttacatttaggaatgaaagtttgattttataagccaattaaaaaacagaattcccattagaaaaattaccttgtagcaagttttgctagattctaactgatctttaaagagggacattcagtaccctaatctaaatagcattgaaaactttccgtttcttttgggagaaattgagaattattttcccgagtttatgtgatgagagagaaaattatttaatcacaatcacgagcaacttagaaagacaaaaacacaacttttatgcatatatgcatgtatgtgggggtagatggaggggtgtaaatccagagagggacttgattgtgagtttcttattttgcatttttattctcattggcagacagatttattttattttattttttgatgacaacactccatgtgtctttattttaatgtgattccatgaagaaacttgcttattgattacggtcctataactcagaaatgttaagttatggttttaaataggggttaattaccattgatgtgtgaatacaggttctaaaagaaatgcatgtcggaagagaaactgaactgaatagtattaattttactgttttcaaagctctcttctagctatgataaggagacagaatacatgtgccatctccacctggttatctagatgaacatattaggttggtgcaaaggtaattgcagtttttgctattgaaggtaatgaccaaaactgcaattacttttgcaccaacctaatacataatacacataaaagataccttagcagcacatgataagggctaatgaatggtacagatatattgcaaactttatagtttgtaggattagctaatatattcttgttcagtttctgttttgaacactgaaaattgagacttgaatgactcttgaagcctgtgcactttgtcaaggaaagattcatttctattgcatatacaattcttgttaagatgggaagcagacgcatcatttggaaaaaactttcttgaaaggctgaaactaagagaggcttgtagagtatcagaaaacataacttttcactgcacataatttggagttaactgcatttttagatattgatatgcatcagttagttttgcatgtacatcattaaataatgaaaattttcaatggaaaaaaaaaagagaaattcaacttgataaaaggaccagtggaccaaaagctcttcaatatacttgtgaggcattattaacaatacaataataaagagtgaaaatcatataacttctgtgaaaccacaatctttgttctgtctgaattcatttctgccagctcacaaacatttgacttttgttgaatttggaaaatacggtttcttgtcctttggtcctagattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggtaagaaaacaatttaaattcttgtttattgtaatagattgccccaaatctatccattattttcacctctgcctccaagcctgcatatatatagtcatatctcttgcatatagtcatttgtcctttccatccactcaaaggctggatgtagacaatggctacattttctaaatatgtttgctattgattatgcatcacagccaaatttaggaaagtttatttgttactttttgagaatgtgttgtggcttataagatgacagtaggaatcccaaccaaatttagtcatgtgaagattctcttgcattccccaggttgaaacctcttagcagtttggttgctcttctggtcatgcatcatggacatctcattgcctttctcaaaacacagcaaagattaactattcttctggccttgggcatgtctagctaatatctagtctattgtaggctctgagaaaatctcaacctaaatgaataatggaacagaaatatggtgaatggaaacaacagtgtctgaccagaaataaacatcttcttactgggaaataggtggctgttttgcatggtggaggaagctgcaggcagagttaaattccatgtgatgtggaataaatcattctgcagtttttgtgacatagaatagcatacttttcaacctatattaaataagatccagaagccttgcctctttattactccttattccttccagaattctagtattatggaagttagtctctctgtccccaaggaggtagatgattctgtcgaccagtcaggtcattctgaataaatctcctttttttcttgagatggagtttccctcctgttgcccaggctggagtgcagtggggtgatcttggctcactgcaacctccgcctcccaggctcaagcgattctcctgccgcaaccttccaagtagcggggattacaggcatgtgcccccacccctggctaatttttgtatttttagtagagacagggtttctccatgttggtcaggctggtctcaaactcccaaccttaggtgatccgcccacctcggcctcccaaagtgttgggattacaggcgtgagccactgctttcggctgaataaatttcctttttttcttttattggttgcatattgctaattcatcttatcttcttttcatcaaggactatgatgccttctttgaagccagagaaaataatgcagtgtatgccttcttaggcttgacagccccacctggttcaaaggtatgataccctttttttcctgttttataggtcattttattgctgctgaacttttttaatcagtaagattttcatttttgttaagtattcaaattaagtcagagacaatcctttatagcaaaaagtgccttctctgcatccacttaattcctattagggcagaaagatgtgcataaccaaatgcataaactatgtgtttagcaggtaggtagagtgacttccccatcaagctgcccatgggagcaaatttctcattgacctatgcacagataagtgcttagcaattttaaagccttcattattccagctgtcctgcatggttctacatcgacagtaagcatcttagttcatggtaatctccttggcagcacttattgtctttgtgtgagagcaaatgatagagtcatccattcaagttaattaagagcatctgcattgcaaaactggtcactaaattgctcgccaaatttgaggcttttttcctgccaacacaaattaattttttaagtagcagcattttcaggagagaccaaataaagaaagcaacaataaagttgcctgtctagtgagatgtccccaaactatcaactttaaacatacctttgccttttatagtagttcttcacacaaactgccttaatcaaaatgcgtgtctcttgctctgtcattttatgttttgctcttagcaactaattgtatgttagacagattctttgaactccaattccctctcctattttaaaaggctgtgttattgtctgttttcactagacaaaaatttactagtactgtgttcatgtcattgtaaaatggttttcttgccgaactttcttttcccatggataaaatcttatattttaggctttgtacaatttgagccataagaaaagtgaggtaaggcacttttctttaaataagatagagtactagattgcagcatctgcaatccagacagagcagcatctggaggcttgcattgtgcattttagccccaaatagactgcaagaacaaaccagcaatcctgagaggacccacagaccctctcaaggaagtggactgctcatgtaggactcaggagacaccccaaatactgtgagtgccccaactgaggaagtggaaaagggagaccctcctctcccgaacagataccctcactggagaaactgaaggtctgtttgcgggagaagtttccaactttacctggagctgagtcaagttagagagcccagcgaaatacaggggtaaaggaagcaacaggaaggccctggtatctcgctgggtccccaggcagctcatttctgcctggcaccatagggatccatcgggagggtggccagaggagcaggggttaaaactccacagaaagaaggaattctctagccaaattttgtaacaattcgaaaggggaagaagcctcctggccagaactcgggggagggtgcaaatctcgcttgcagacttcacaggcaagggaagaaccaaaacccttttctttcgcagctgggaggtggatagccttgggtgaatttttaagcccctcttgccctccacctggaaacagactcagggctgttggacgggggcttggtggaagtgagaccaacccttcggtttacctgggagctgagtgaggcctgtgactgctgattttacaggacttccctgacaatctgcctgactcagcagaggaagccatcctaggtatagaactccagtgacctgggaatctcacccccacccctcacagcagccacagcaagacccacccgaggagagtctgagctcagacatgcccagcccctcccccacctgatggtccttccctttccaccctggtagtggaagacaaagagcatataatcttggaagttctagggccctgcctactgcgggtccctctccgcaatactacagctgatggtttctggaaagcgccacctcctggccaaccagcataaaaatagagcattaaaccaccaaagcttaggaccctcacggagtccattgcaccctccacctcctccaccagaccaggcactggtatgcatggctgagagacccatagatggttcacatcgcaggactctgtgcagacaaccgccagtaccaaccaggatctgggtagactcgctgggtagctagacccagaagagagacaacaatcactgcagtttggctcacagaagccacatccataggaaaagggggagagtactacatcaagggagcaccccatgggacaaaataatctgaacaacagccttcagccttagaccttccctctgacagagcctacccaagtgagaaggaaccagaaaaccaacagtggtaatatgacaaaacagttcccttcaacatctgcaaaaaaatcacactagctcaccagcaatgatccaaatcaagaagaaatccctgatttacctgaaaaagaattcagggggttagttattaagctaatcagggagggaacagagaaaggcaaagcccaatgcaaggaaatccaaaaaatgatacgagaagtaaagggagaaatattcaatgaaatagacagtgtaaggaaaaaaacaataaaaaattcaggaaactttggatgcacttttagaaacacgaaatgctttggaaagtctcagcaatagaattgaacaagtagaagaaagaaattaagagctcaaagacaaggtctttgaattaacccaatccaacaaagacaaagaaaaaagaataagaaaatacgaacaaagcctccaagaagtctgagattatgttaaacgaccaaacctaagaataattggagttcctgaggaagaagagaattctaaaatcttggaaaacatatttgggggaataatcaaggaaaacttccctggcctagctagatatatatacatccaaatacaagaagcacaaagaacacctgggaaatccattccaaaaagatcttcgccttaggcacactgtcatcaggttatccaaagttaagacaaaggaaataagagctgtgagacagaagcactaggtaacctataaaggaaaacctatcagattaactgcagatttctcagcaaaaaccctacaagctagaagggattaaggccctatcttcagcctccttaaacaaaatgattatcagccaacaattttgtatccagtgaaattaagcatcatatatgaaggaaagattcagctcttttcagacaaacaaatgctgagagaattcgccattatcaagccaccactacaggagctctaaatcttgaaaggaatcctggaaacacatcaaaacagaacctctttaaggcataaatcacacaggacctataaaacaaaaatacaagcttgaaagcaaaagcaaaaaacaacaatgaaaaaatctagagtacacaggcaacaaagagcacaatgaatgcaatggtacctcacatttccatgctatcattgaatgtaaatggcttaaatgcttcacttgaaagatacagaactgcagaatggataagaactcgccaaccaactatctgctgccttcaggagactcacctaacacataaggaggcacataaagtaaaggggtggaaaaaggtatttcatgcatatggacaccaaatgagagtggggcaactattcttataacagacaaaacaaactttaaagcaacagtggtaaaagagacaaagagggacattatataatggtgaaagaccttatccaacaggaaaatatcacaatcttaaacatatatgcacctaacactggagctttcaaatttataaaacaattactaatagacccaagaaatgagatagacagcaacacaataatagtgggggaattcaatatcccactgacagcactagacaggtcatcaacacagaaagtcaacaaagaaacaatggatttaaactctaccttggagcaaatgaacttaacagatatatacagaacattttatccaactgcagaatacacattctattcaacagcacatggaactttctccaacatagaccatatgataggccataaaatgagcctcaataaatttaagaaaattgatattatatcaagcactttctgagaccacagtggaataaaactggaaatcaactccaaaaggaaccttcaaaaccatggaaatacatggaaagtaaataacctgctcctgaatgagcattgggttaaaaacaaaatcaagatggaaattaaaaaattctttaaactgaatgacagtaatgacacaacctatcaaaacctctgggatacagcaaaggtggtgctaagaggaaagtttatggccctaaacgcctacatcaaaaagtctgaaagagcacaaacaatctaaggtcacacttcaaagaactaaagaaacaagaacaaaccaaacccaaacccagaagaagaaagaaataaccaagatcagaacataactaaattaaattgaaacaaaaaaatacaaaagataaaatgaaacaaaaagctggttctttgaaaagattaaaatggatagaccattagcaagattaaccaagaaaagaataaaggaaatccaaataacttcactaagaaatgaaacaggaaatattataactgacaccactgaaatacataagatcattcaaggctaatatgaacacctctatgcgcataaactagaaaacctagaagagaatggataaattcctggaaaaatatcactttcctagcttaaatcagaaagaatcagatacatttaaaagaccaataacaggcatcaagattgaaatggtaatttaaaaattaccaaccaaaaagtccaggattagcctgattcacagcagaattctactagactttcaaagaagaattaataccaatctgttggactctattccacaagataatgaaagaaggaaccctctctaactcattctatgaagccagcatcaccctaataccaaaatcaggaaaggacacaaccaaaaaagaaaactacacaccaatatccttgatgaacatagatgctaaaatccttaagagaatactagttaactgaatccaacaaaaaagcaaaaagataatccaccatgatcaaatgggtttcataccagggatgcagggatggtttaacacacacaagtcaataaatgtgatgcaccacataaacagaattaaaaacaaaagttacataatcagctcaatagatgcagaaaaagcattcaacaaaatccagcatcactttatgattaaaactctcagcaaaatcagcatacaagggacataccttaatgtaataaaagccacctatgacaaacccacagccaacataatacagaatggggaaaagttgaaaacattcccactgagaactagagcaagacatggatgcccactgtcaccactactcttcaacatggtactggaagtcttagccattgcaatcagacaagagaaagaaataaagggcatccaaattggtaaaaaggaagtcaattggtcactgtttgctgatgataggatcatttatcttgaaaaccctaaggactcctccagaaagctcccagaacgataaaagaattcagcaaaatttccagatccaagattaatatacacaaatcagtagctcttctatacaccaacagtgaccaagtggagaatcaaatcaagaactcaaccccttttatgttagctgaaaaaaaaaacccacttaggaatatacctaaccaaggagtagaaagacctctacaaggaaaactgcaaaacactgctgaaagaaatcatagataacacaaaaatggaaacacatcccatgctcatggatggatacaatcaatattgtgaaaatgaccaaactgccaaaagcaatctacaaattcaatgcaattcccattaaaataccactatccttcttcatagaaaaaaatcctaaaattcatatgaaatcaaaaagtgattgagagggcctaaaatgggacagcagttttggaaaggaaaagatggatttaggagcctccccccaccaaaaaaaaaaaaagttacaggatttaggaattaatgagttgcttgtgcctgtaaagacctgagcgggattaaagctagccatgggatctctaaccttggtgattgggaaatgaagaaaagatcatggaggaaatagaaaagtcagtgatccagggaagaagttagccttggaaatagcatgtggtgttctgagagtggatgaaattaggagaaaggaataaaaataaagagaaattttaatgtgtgggaaggttagggaaagtcagatttgaaagtataaggcaggaggaaaacttatccgcaaggagtgaggggaaatttgaaacattagatccctgaggagaattgaacagattcagttgaaaattggctagggaataggctaagatcataaataaataaataaataaacagacaaataaataaaaaacagctaagcagggcccagcagtagttagaactgatgggcccataggaagctagacatcttggttaccatgtttcttccatcattgcttaagctcaggagtaggaatagagtaaatgaatagtgaatgttatgaaggatgggcaagaaggacctgatagactgggttaacaagaataggtgtggtattgacaatgaacatgaagagtggattggtgatagggagattttgaattttggtatttaataggtttttccaagactagaagtgatccatttcatgtcagaatgatatttttatacttcagctcaatttctagagttttcccctttaacaggataataagccttcaacaaagaaccagatgaacagaaagtatactaaataagaaagacaactggttaacccacattgaaaaagtgaattgataataaaagttatatgataaaatgagataaaatgtttagctgtaaattcagcaaaactaaaacaaaatgataatagtgctgagaagggtggattgaaacagttgctataatacgttactgatgttggcataaattggtacccctttttgaaaaccaaaatggcaaatacgtgtcaaggatctcaaaaatattggtactccttcacccagtggtttcacattgggtattataatcaagtgaaataatcctatacgtggaaaaagcttcatagataaaaatgtgaatagaagtgttaattataatcttaaaactttgaaaacaagttaaatgcttaacatatttaacaagaggttcaactaaattcatgcattgaatggactttatggataaaatatgaatcaaagtattatactgtgtctaattctgaactttagaaactagttaagtatctaacgatagcgtcaacaaaaatagtttatctactgaatgaacttggactgtcatgaagaaaatgaaaatttgtgaaaacatatatgtaaatgagctacagaattattttgaaagtaaggttaatattctaattacatttaaaatgtatggataggacaaaaaaagaaactgaaaggtagttaatatgcattttctcctattctctacttttaaataattatcaaacatactctttacatttaaaaaataattgaaaccaatgcactggagagcttgatattgaaaagtactctgtgtcaaatatttccataaggcaaagaatccttctgtgtaagacaaataattgttgtattcttttttatattggattgtttaaaacaaggtatgtatttgtctactgtgattcactcaattttgtcaatatgaaatatttcttagtactggcatttcttactttaaagtggagatgatggttttgagatatgaaataagatcactgatatttttaccacaaaataaatatttggtgatgcttgtgcagaaaggaaaacgactctattggcaaaggcatgttcacttatgttgaaagaatagagggtatgggtcagagaaatgtcctcgttagctttagttgaattaaactgctccagggaggagctccggagtccatctctgctgtgagatttgaagcaatcctatttatactgaattcatcctatttttactacatctccaagagagactgcatgttcataaacttagctgtggtattgattttagctactaggcaaaaaaaaaaaaaaaaaaaaaaaaaagagaggggaaaagcaggaaagaaggatggatgcctataatgggccaaacactgagataggcacctcaggtacatctcattttatctttccaccatccctttaggatagatataattagaagcactttagagaggataatttaagtaatttatcaaagggtatataatgatttagtagtgaagctgaaattttagcccaggattatctgatttaaaaccagtgcctttatggaatgatgtttacattgggaatacggaggaagagaacattatatgcttgctcttaaagctctctgtttgattggatgactcattctacaaatactgacaatttgcttgtaggcactaataaggagttcagataaattcacatatttgatatataaaataagattagaaaggtaaataatttactgtaactttgatgtgttctaaagacaaattataaagaattttgagatgaattttgttctggatttctatgccagtgatttctcccattaaaaatgataacttagagctgcagaatttatgacaaattataggaaagattgatagtgtgtcactttagggaaataaacttctttccctatatgtgtaactagtattaatccaaaatactagttacaaatcgaaatgaagaaaacaatacaaaatgaaagaaaacgttggtattttgaaaagttaaacaaaattgacaaacttttagccagactaagaaaaaagtggagaagatttaaataaaaatcatagatgaaaatgagacattacaacttatactgcaggaattcaaaggattattagtggctgctacaagcaattatatgccaataaattggaaattctagaagaaatagacaaatttctagacacgtacaatcaaccaagattgaaccatgaagaaatccaaaacctgaacagaccaattacaagtaaaaagatcaaagccataacaaaatgtttatcagtaaataaaagcctgaaacccaatggcttcactgctgaattttaccaaacatttaaagaaatgctaataccaaacactgcatgttctcattcctaagtgggagttgaacaatgagaacacatagacacagggagggtaacatcacacaccgggacctgtctgtgggtgggggagtaggggagggacaagattaggagaaatacttaatataggtgacgggttgacgggtgcagcagaccaccagggcatgtgtatacctatgtaacaaaactgcatgttctgcacatgcaacccagaacttaaagtataataataaaaaagaaatggcaataccaattttactcaaactattctgataaatagaggaggaacgaatagttccaaaatcattctacaaggccaatattaccctggtgccaaaatcacactagaatacataaaaaagaaaaagaaagaaggaaggaaggaaagaaagaaagaaagaaagaaagagaaagaaagaaactacaggacaatatctctgatgaatactgatacaaaatttttcaaaaatatattagcaaacagaattcaacactatattagaaagatcattcatcctgaccaagtgagaattttttctggaatgcaatgatcattcaatatatgcaaatcaaccaatgtgacacattatatcaacagaatgaaggataacaaccatctgatcatttcaattgatgctgaaaaagcatttgatataattcaacgtcttttaagataaaagccatcaaaaagacttagtatagaaggaacatacttcaacacaataaaagccatatatgactgaaccacagctagtatcatactgaatgaggaaaaactgaatgcctttcctataagatatggagcactacattgatgccactttcaccactgttatttaacatagtactgggagtcttagctagagcaaccagccaagaaaaatacctaaagttatccaaactcaaaatgaagaagtcaaattatccctgtttgcaaatgatataatgttgaattcaaagagttttaaagacttcaccaaaaaaccattaggactgataaacaaactcagtaaagttgcaggatgcaaaatcaacatacaaagtcagtagcatttctatatgtcaacagcaaataatatgaaaaataatataagaagtaattccatttacaatagccacaaataaaattaaatacctaggaattaacttaaccaaagatcttaaagttttctacaatgaaaatgtaaagcattgatgaaagaaattgaagatgacataaaaaattgaaaaaatattccatgatcatggattgaaataatcaatacattaaaatgttcatactgtccaaaacaatctacagattcaattaatataaaaatatcaatgacattcttcacagaaataaaaaaaaatctaaaattcatgggtaaccacaaaagacccagaatagccatagctatcctaagtgtaaagaacaaaactagaggaatcacattacctgacttccaattataatacagagctatactaatcaaaacagcaaggtattggcataaaaacaaacacatacaccaaggtgacagaatagagaacccagaaacaaatcctcacatctacggtgaactcatttttgacaaaggtgccaagaacatacactggggaaaagagagtcacttcaatagatggtgctgggaaaactggacatccatatgcagaagaatgaaacttgacccctatctcttgccatatacaaaaaccatttcacaatgaagacttaaatctaatacctcaaactatgaaatgactacaagaaaacactgtagaaactctccaggacattgatctgggcaaaaatttgttgagaaatatcccaaaagcacaggcaacgaaagtaatcatggacaaatgggatcacatcaagttaaaaagtttcttcacaacaaaggaaacaataaacaaagtgaagagacaacccaaagaatgggagaaaatatttgcaaactacccatctgacaggggatcggtaacgagcatatatgagaggctcaaaccactctataggggccatgcatggtggcttagacctttaatcccagcactttgggagactaagacgggcagatcacttgaggctaggagtttgagacctgcctgaccaacaaggtgaaaccccgtctctactaaaaatacaaaaattagccgggagtagtggcacaaatctgtaagacatgcttctcaggaagctgagacacgaaaatcacttcaacccaaaaggtggaggttgcagtgagccaagattgtaccactgcacttcagcctggttgacagagtgagactgcctcaaacaaacaaaaaacaactctataggaaaaattctaataatccaattaaaacgtaggcaaaagatttgaataatcctttgtcaaaagaagacatatgagttgcaaacagatgtgaaagtgtgctaaacatcactgatcattagagaaatgcaaataaaaactacaatgagatataatctcacctcagttaatatggcttttatccaaaggtcaggcaataatacatgctggtaaggatgaggagaaaagggatcattcatacactgttggtgggaatgtaaattaatacagccactatacagaacagtttggaggttcctcaaaaacctaaaagtagaactaccatatgattcagcaatcctgctgctgggtatatacactaaaaaaagcaaatcagtatatcaaagagatatctgcaatctcatgtttgttgccacactgtacacaatagccaagatttggaagtaacctaagtgtccatgaacagatgagtgggttaagaaaatgtggtatttatacataatagagtagtattcagccatgaaaaagaatgagatccagtcatttgcaacaaaatggagggaactggagattaccattttaagtgatataagccaagaacagagagacgatcaccacgttctcacttatttgtgggatctaaaaatcaagcaattgaactcatggagatagagaatagaaagatggttaccagaggttgagaaaggtagtgggtgattgagaagtgggtttggttaatggcacaaaaaacagaaacaatgagtaagatctagtatttgataccaaaacatgaagactacggtcaaaaataaattaattgtatactttaagataactaataatataataattatgttgtttataatacaaacaatacatattggagttatggataccccgtttacccagatgtgattattatccattgcatgcctgtatcaaaacatgtcatataccccataaatatatatacctactatgtacatacaaaaattcaaaataaaaaaaagaacaaaatactggctatggagcaatgttaggtccttagaggaaaaaggatttcatgttaggtcatttttgcattattatacaactgcttctccaactatgtatgctatgtttttgaggggtcttagtataaattattttttgagttatgtgtagaaattcttgaaagcttgttctataaaatgaagcaagatgcatactgtgactttaacatattcattttgacatctaaacactgttaaagcttcaaaagaacttagggacttttccttttttgactaggcatttgcaaaggtgagtctattagttcattctcacactgctataaacaactacccaagactgggtaatttataaagaaaagaagtttaatttacttacagttccacaggctataaagcagacatggcttgggaggcctcgggaaacttacaatcatggtggaaggcaaaggggaagcaagcacatctacacttgttggcaggaggcgttgagttaggtgctacacacttttagacaagcagaaataaggggatggtgctaaaccattagaaaccaccccccatgatccaatcagctctcaccaggcccctcctccaacaatgagaattacaatttgacatgagatttgggtggggatgcagagctgaaccatatcattatgcctctggcccctcccaaatctcatgtccttttcacattgcaaaatactgtcatctcttctcaacagtcttccaaagtcttaactcctttcagcattaactaaaaagtccaagtccaaagtctcatttgagatgaggcaagtccatttttcctataagcctgtaaaataaaaagaagttagttacttccaagatacagtaggagtacaggcattaggtaagtgctcctattacaaaagggggaaattggccaaaactgacaaaattgctctatgtaagactgaaaccaagtaggacaattattacatcttaaagtttcaaaataatcttctttgactgcatgtctcacatccagggcacactcatgcaagggatgtgataccagggccttgggcaactctgatcctgcagctctgcagggtacagccttggcaactgcactcatgggctggtgatgagtgcctgtggctttaccaggtccacggtgcaagctgtgagtggatctaccattcttcctggaggcagtggcccctttctcacagctacactaggcagtaccccagtgtagcctctgtgtgggggctccaaccccacattttctctcagcactgccccagtagaggttctgcatgagggctccatgcttgcagcagacttctgcctggacatccaggtattttcatacatcctctgaaatctaggccgtgactcccaagcttcaactcttgcctgctgtacccccacagccttaacatcatgtggaagtacccaaggcttgtagcttccatcatctggagcagtggcctgacacatatctggggcccttttagccatggttgtagctggagtggctggaacatgagttgccatatcctgaggctgcacagagcagtggagctctgtgcctggcccacaaaaccattttactattccaggcctctgggcttttgatggcaggggctgccataaaggcctctgaaatgccctggaggcattttctttattgtcttggctattaacattcagctccctttacttatgcaaatttctgcagtcagcttgaatttcttccctgaaaatgggtttttattttctaccatacggttaggtttcaaattttccaaacttttattatctgcttcccttttcaatgtaagatgcaatttcagaccatttctttgtgaatgtatatgagctatgctgttagaagcagccaggctacatcttgaaccctttgctccttagaaatttcttccaccagagaccctaaatcagggatgtccaatcatttggcttccctggaccacaatggaaaaagaacaattgtcttgggccacacataaaatacaatgacactagtgatagctgatgaactaaaaaatattgcaaaaaaaaaatctcataatgttttaagaaagtttatgactttgtgttggatcattgatatggtttggctctgtgtctgcatccaaatctcatcttgaattgtactcccacaattcccacgtgttgtgggagagactcagtgggagataatttgaatcatgggggcagtttcccccatactgttctagtggtagtgaataagtcttgtgatctgatagttttatcagaggtttctgcttttgcatctttctcattttctcttgctgccactgtgtaagaagtgcctttctcctcccccatgattttgaggcctcctcagccatgtggaactgtaagtctaattaaacattttttttttcttcccagcctcgggtatgcctttgtcagcagggtgaaaatggactaatatggtaaattggtaccagcacagtggagtgttgctgaaaagatacttaaaaatgtggatgtggccaggtgcgctggctcatgcctgtaatcccagcactttgggaggtcgaggcaggtggatcacttgagatcaggagtttgagaccagcctggccaacatgctgaaaccctgtctctactaaaaatacaaaaagtagctgggcatggtggcatgtgcctgtagtcccagctacttgggaggctgaggcaggaggatcacttgaatcagggaggtggaggttgcagtgagctgagattgcaccacggcacaacagcctgggtgatagagtgagattccatctcaaaaaaaatgtggaagtgactttttaactgggtaacaggcagaggttggaacagtttggagggctcagaagaagacaggaaaatgtgggaaagtttggaacttcctagagacttattgaatgactttgaccaaaagcttgatggtgatatggacaataaggtccaggctgaggtggtctcagatagagatgaagaacttgttgggaactggagcaaggtgattcttgatatgttttagcaaagagactggtggcattttgcccctgccctagggatttatagaactttgaacttgagaaaggtggtttagggtatctggtagaagaaattttgaagcagtaaagcattcaagaggtgacttgggtgtggttaaaggcattcactttcataaggaaagcagagcataaaagtttggaaaatttgcagcctgacaatgtaatagaaaagaaaagcccattttctgagaagaaatgcaagccggatgcagaaatttgcataagtaatgaggagccaattattaatccccaagaaaatggggaaaaagtctccagggcatgtcagaggtcttcacggcagccccttccatcacaggctcagaggcctaggaggaaaaaatggttttgtggttcagacccagtgtctgcatactgtgtgcagtgtagggactttgtaccctgtgtcccagccactccagccatgactaaaaggggccaaagtacagcttgtgccatggctgtggtgggcacaagccccaagccctggcaacttccatgtggtgttgagcctgtgggtgcacagaagtcaaaaattgaggtttgggaatctctgcctagatttcagaggatgtatggaaatgcctcgatatccaagcagaagtttgctgcagaggtggggctctcatggagaacctctgctagggcagtgcagaagggaaatgtggagttggagcccccacacagagtccctaccggggcaccgcctagtagagctgtgagaagagggccactgtccttcagaccccagaatggtagatccactgacagcttgcaccatgtgcctggcaaagctgcagacactcaacaccagtctgtgaaaaggtctgggagggaggctgtaccctgcagagccacaggggcagagctgcccaagaccatgggaacctaccttttgcatcactgtgacctggatgtgagacatggagtcaaaggagatcattttggagctttaagatttgactgccctgctggattttgaactttcactgggcctgtagcccctttgttttggccaatttctcccatttggaacatctgtatttacccaatgcctgtaccatcgttgtatctaggaagtaatgaacttgcttctgattttacaggctcataggcggaagggactttacttgtttcagatgagacttcagactgtggatttttggtttaatgctgaaatgagttaagactttgtgggacttttgggaaggcatgactagttttgaaatgtgaggacatgagatttggagaggtcaggggtagaatgatatggtttgtcactttgttctcacccaaatctcatcttgagttttatttctataattttcacctgttttgagagggactcgttgggagataatttgaatcatgaaggcagtttcctccatactgcttttgtggtagtgaataaatctcaccagatctgttggttttatccggcgttttcacttttgcatcttcctcattttctcttgctgcctcctcttaagaagtgtctttcaccttccgccatgattctgaggtctccccagccatgtgggactgtaagtccaattaaacctctttttctccctcgtcttgggtatgtctttatgagcagcatgaaaacagactaatacagccacattcaaagctgtcctgggcagcatgcagcccacagaccacaggtttgacaagcttgccctaaaccatctctctcaagtgcaaatttcaacagatcccttgagctggggcacagtgtcaccagtctctttgctgaagcacagtagttgtgaccattactccagtttcaaataagttcttcatcttcatcagagaccacctcagtatggaccttattgtccatgtcactatcagcatttcggtcataacaatttaacaagtctctaggaagctccaaactttccatcatctttctgccttcttctgagccctccaaattgtaccaacctttcctccaaagttggttccacattttcaggtatctttatagtaataccccacccctggtaccaattttatgtattagttcattcttacactgctataaagaactttttgagattggacaatatataaagaagaaagaggtttaattgacccacacctccaaagactgtacaggagccatggctgaggaggcctcaggaaacttacaatcatggcaaagggtgaaggggaaggaagcacgtcctcgcctggtggcaggagagagagggagaggtgctacacacttttagacaagcagcagtaggaggatggtgctaagccattagaaactgccctcatgatcaaatatcctcccagcaggctgctcctccaacactgggaattgcaatttgacatgggatttcggtggggacacagagccaaaccatatcaatgagtcagtagtatatttcgttatttttttaaaggatatgaagaatgaattttggtgtcatttaatattttcttctttcctctacttttgccttttttgggtaaaaatctagtgtctcttttagcttttctcccttcttttgcatgtaatactgggactcatttggacagtatcagtcctcctgagactgtcaagtattgatttagtgacaggtgtttagaatgatgttgtctaccacgcttgatttctacaacttaagtctgatgtttccttttctggagtcaatcttgccactcatctttagttcaacaaactttccttgaagtttattttgtgtcaagtaggtcagagttcctatgctagaggtgagtacctcactatccagaggagaaggaagacaacctgattttttggtgtgtattctatcataaaacatgaaaactacaatattttaatggatagcacattttctaagtaatttaaaccttaattaaccaaaacccaactaattttaaacttaagtaaccatgtttttatattctcaattttcatgaaaaaaaatcacacaaaaaggaaactgactatttttaagtaaaatatcaattataattgtatatcacttgctttcatgaaagtattccaaatcattaggaatgattaggtagtctttttgtgtatctgtttctagaaatctgtttgtattatatagtttttctattaagaactttttaagaaatctcttctgggggcttttgtttattcttagtagttggaactaatgtagtctgactaaaatacacatgggtgtctgctctgtgatgtttaaacttatctgttttgtttgtttttcatttcaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacat

SEQ ID NO: 35830 - DNA, 96602 bp, Homo sapiens; identical to SEQ ID NO: 35829

SEQ ID NO: 35831 - DNA, 9246 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggtgaagcccccgccaggcccagagcccctgtggccccctcccttcgccgcggcgcccctgcctcctttacccggtgccgctgcgcacctctccgcatctctggcccggtgcagctgcgcacctgctccgccgcccgcgcccagggcgccttccctccctggccttccccgcccgctgccttcgctttctggccctctgcgcgcctatctctaactgcgcctctccacccttgcctgcctctctcccggtgctcgccctcatctacggttctatttgtttctaagttgggagcctctccgggcggtgcatttttatcctagagcgtcccttttggtttgcatttggggaaatgtcttctctcaccgttcctcacctcccccagacttcccttggactcccctctctcctgctcttccccacggcgcccctctccgttcgcgcttcctcccctctgctgcacgggggagagatggaagaagtggggatctgtcgaggcgcagaggggaggacaggcccagctcgcctccactccccaccggctcttatcctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtaatgggtgtggcatgggccttcctacagccctagcttttccacggccaggctgggttcggccaggggttcggaggccttttttgatacccaggggtatggggtgctgggccaggctcacaagcctgggttgtggcggttggatcctccttgtccggggagccagggtaggtgggtctgtgttcgagtttagcgtgtgaggcatgtcctgcctccgtgtgtctgcctgtgcacttgcatgtgtgcagacgtgtgctgcaagcaattttctttctgcgggctcccacttgtgcatgtggggcctcagatgggtggatgaggaggccacttcttgtgcatctgcctcagtgtgtgtgtggggtgggggtggggggatgttagggagcagtgtggggagagagctagatgtggtaggcaggcagtttagagccagaaggctgaaggactccctggcccctgtgtcctcttcactccctctcattccatgttcctcctttaggtcttttccgggctgcagtgcccagtggagcctctacgggcatctatgaggccctggagctgagggatggagacaaacagcgttacttaggcaaaggtgaggtcccttctcttttccagactctcccccacctcagccttatgcccctacctcacaccagtccccagtcctcctctagcatggcttcccctcctcccattgatcccttccggcccctcctggcccgacccagtccagcctcttcctttccccaggtgtcctgaaggcagtggaccacatcaactccaccatcgcgccagccctcatcagctcagtgaggcctgctctttgctggggatagcagggccagagttctggaaggaatcccggagcagggcaggaggaagggaagaaagaaggcccactcttaggaatcatggttacaagggggaagggtggggaacagcttccttaatgcaccctgctcccatgggagttcaggtcccctaatccaggtaggcccctgtcacagggacctggttggaccctggccaaatgtgagcttgggtgtgaatgaggggaccctctgccttagggctcagcctccagcctggccctgggtgatggaggctctgccctcagggtctctctgtggtggagcaagagaaactggacaacctgatgctggagttggatgggactgagaacaaatgtgagccggggccgggagaaagtggggaagcgtcagggtggggaggcgtggagcagatagagagctgaagggccagtgctgtagtggcttcctcaggaatgactgtcaggggcattctcctctcaaagccagagcaaggggagatgagtttagctgcagagggaaggaccgacagtaggcagaaggaagaccttctttgcagcatacagaggagggggatggcctgagagagtctgtggtctcagggatatttagaaagaggtgtggctctctgccgtttccaatctcctcctccccacccattcctctccctgctgttttcaagagagcatggatgaggtgttgctggggcaggggtggggagggaggagggggtctcctttactggctccttttggagactacagatggaggcaggagctagaaaggagaaggggacattgtgctcagcaccttcctctataatctcctagccaagtttggggccaatgccatcctgggtgtgtctctggccgtgtgtaaggcaggggcagctgagcgggaactgcccctgtatcgccacattgctcagctggccgggaactcagacctcatcctgcctgtgccggtgagcaataagccagcctgcggctctcccaggggcgggtgggggagggagcatgcaactcatgaggaatgatgggaggaaagtgaattgagggaggtaaagaggaaggatggggacgtgagacttagtccggaaagctgggggaagtttgggatcttgggttaacactcctggggcgggcagggaggggctctttgacccttctgtctttctgtggctccccaggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaaggtgaggccaggagccccactcccagctctaagtcttaccctattgtgggacatcagaaagggtgacacagttcaccaagtcctgagtaggcgtggagggtcctaggactctgcaaactccaaaaggtaccagttcttagagtggattgcagagagcctgccaaattcacatgcagacctagggggacagtatttttttttttttttgagacggagtcttgctctgtcacccaggctggagtgcagtggctcgatctcagctcactgcaagctccgcctcccgggttcacgccattctcctgcctcagcctcccgagtagctgggactacaggcgcccgccaccacgcccggctaattttttgtattttttagtagagacagggtttcactgtggtctcgaactcctgaccttgtgatcggcccgcctcggcctcccaaagtgctgggattacaagcgtgagccaccacgcctggccaggggacagtcttttacctgcctagccagatgtgttagcatctgttaagttgccactggaaggccgggcgcggtggctcacacctgtaatcccagcactttgggaggctgaggcgggtggatcacctgaggtcaggagtttgagaccagcctggccaacaaggtgaaaccccgtctctactaaaaatacaaaaattagccgggcatggtggcgtgtgcctgtaatcacagatactagcggggctgaggcaggaggatcgcttgtacccgggaggcggaggttgtggtgagccgagatcatgccactgcactccagcctgggcaacagagcgagactccgtctcaaaaaaaaaaaaaaaaaaaaaagttgtcactggagcccttgggaatactgggagatggtctggatgactgttggattcatcccatccattcgaaatctgtcctgtccccgtcccaacctcctaggcctctagaatccctaatttttctgtgccttgggggaaactgtatagggaatggaaagaatataggtagtggttaagagttaaggttctggggccaaataacctggatttatttgaaccttgacttgtggagttactgctggtgaactttcttacttctctctggaaataataacagaatctagctcatggtagtgtgaggcttaaatgaaatatatataaaatgcttagatgacatgataccaatgaaagtatagtaagtattattaagagaattccattcctctgtgttcctagaagatggcctctcctcccagacctggggataaccccaacagcatccccgccacacttccctcaggaacagccctccacctctgccctgaatgtcttttctttccctcctcctccttgcccatccctcctgcttgtactataatctcactgtattctgtccccagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaaccagggagagggtgcaggagccacctgcaaagactgggctttgtatgtagtgtaaaaatgcaggtacccgtgaccaatctgttctgtctcagatcctgattaaagtcatgggttctgaaaactactgggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagtctgcccagggcctttatctcaggatggaggcagttggtcgccatcttcctgacacagagcgaaagaaaatcaacataattgcagaattaaggatttggattagcaatgaggaagggcttgctggcagtgagaacaggaaaatgcaaagctaggttgtgaacccttgttactggaagattttttttggggggggggtggggttgttttttttgttttgttttttttttttgagacagagtttgactcttcttgcccaggctggagtgcaatggcgccatctcggctcaccacaacctccacctcccggattcaagcgattcttctgcctcagcctcccgaatagctgggattacaggcatgtgccaccatgcctggctaattttgtatttttagtagagacaggggtttctccatgttggtcaggctggtctccaactcctgacctcaggtaatctatccaccttggtctcccaaagtgctgggattacaggcgtgagccaccacgcctggctggtttgcttttaattaactttttttttttttttttttttttgtagagacagggtttagccatgttgctcatggctggtctcaaactactgggctcaagtgatctgcatgcctcggcctcccaaagtgctgggattacaggcatgagccactgtgcccagcctatggaagtggcgtgagatctctgctcactgcacgattctcttagcctcccaagtagctgggattacaggcgtgcaccaccatgcctggctaatttttgtatttttagtagagatggggttttactatgttagccagggaactcctatcctcaagtgatccgttcacctcagtatcccaaagtgctgggattacaggcatgagccactgtgcctggcctctccatgtaaggttttatgaaataagaatcaggagccaggcgtggtggctcatgcctgtaatcccattactttgggaagccgaggcaggaggactgcttgaatccaggagttcgagactggcctggcaatacagtgagacctcatctctacaaaaattttaaaaattagctgagtgtggtgccacacacctaaagtccctgctactcaggaggctgaggtggcaggatcacttgattggggaggtggaggttgcagtgagctgagattgtgccactgcactccagcctggatgacagaatgaggctctgtcaaaaaaaaaaaaaaagttaagaatcagttagggcaggcttacactggggggatttgtcttagcaaggatgagcaggtgtagttaaccaagggcctgtccatttcagggaataaaggggcatgttcctgcctgatgtagagacccagggaagatgaacacctcccccctccccaccatgctctctctgcagtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgagtgacttctggccctctcctgtgtggtcctcgtttctataagactccttttgcaagtgctccagcctaattctacccaggggtgccaaagagagcggggaacctggaatcatcctcacagttctctcacctctgcccctccacccctgattctctgctcccctcccagatagctttcccctagatgtttcctgacatagaccaaggttggggctgggaagagagtgcccagtgtgagagctggagaatcagtgctgtgtgtggatacaggtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgaggtgagggtccctggggtgggagcccctggcccagatggctaaaggccccatttgcctgccagaccatctgtagcaccaagggcctggataacagtccatttcctggataacagtccaacagataatattggtttttgcttcctgggtttattgatggcctgattgacaaatcccagagatcacatgggaaagccagggaatgctaagccttggggcaggacacaaaagcaggtggtgtgggggtggttggagtctgggggacccctagagagagaagcaggatcctcctgcatccctgaccacttcctttgtggttcatctctctcagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 35832 - DNA, 26154 bp, Homo sapiens
ggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaaggtacgcgggccgggccgggccgcgcggggaccgggggcgggacaaagggaccgcggccctgcagccccgggatcctgcctaccctccaggcgccccagcccctcccccgcggcctcccaagcagccccccgcgcgccctcctgcgctcccgcgcccctcccccagcctccctctccccgcacccccagcctctgagcccagcccccgcccccactgctgcgccctctgccccttgtttttctctactgcccggcgggccccggtgccattagcccaccttcccctcagccatcgccctcctggcttttctgggagaggcggccggccgggtgtggaccgggtgcccaatgggctcccccgcaacccggagcgtgcccgccagagctccccacggagccaggtaccagcggggctgaggcctctccggtgctttgtgtatgttcagagagagagaatggaaagcaggagggtaaacagtcacagagcaagccgttggctgctcatcagcctgaaaaaggtctccacccagggatcacctgtctccgccgctcatcccccaccttcatctaaggggcaacagaatctctcagggagccggggtataggagttcctgggtagcggccccttccgaaacctttcctcgattttacaatgaagtcaccttgcaacctagctttgcagtaccctgggtttggggtcgagaggttagggtgagcttcctatctctagcccctcacacccaaaccccataactggagatcataaggtggtgaacaaaaggttcaagaatccttacctgtcttttctaccaaacctcttcctggtgtcgtctttgtctctaggcctggttttctctggaaatggtctgcctctctttttctcactaccctcagagagggattctctttatggctttctttcagctccccagttcttcctgccggctttgcagctcgtcagaagtgtgcttagtggcttaggagaacttcctactgatgctggttgtgagcctggccctgcccttggggtctctctgggtgtgagaatcctgacaaatagctgctatttctatggcatgtctctacgcctgtgagaggctcttattcccaggcttctacctttgaccttttgcagggagatcaggctaggggcttagcctccggccttgggggaattgacagttgtgacctggttcagcttccatgctcttagctctttgtcatttacctttcccttcacagatctatctcttttcacctctcactgagaggcactgtcttctttgtgatgagtggggagaaaacgggtcaaaaagtaaaaagaaagtctcctggctcaggttcaaattagaatggaaggctaggatgctactaggtagcagagtgtggaaacatagaagtagggccagggttacttgtctcagatacagtttcctcggacagggtagatgttgtcttgctcttctccatcaggctgggtagtggatggcccttcctgtctaggagggcctatgaagacatttatacccagtcttcagaagcaaaatgcacaagctcactcagtcaacttgccctccttcacttccttgtaccttttcttgttaggctacattatagggggaatcatggctttacagagttcccctaagaaatgtctctcttagagccccagaggtattgcttccatgacctgaactttataaacctccagaattttacaaccctcagtgctgttggttaaagatgaggtgccaagataatagggtcctgcaactccaatttcagagtataactgaggaagagtagtaagcttccctgttccccccaacactggccacctgggctggtggcagcagaatttcagcttcctggttggggtgtccagggcctcccttttgccattttctttatagagactaaatggggagaagggcactattttctttgctccacatgcttccagagcccctgggggagaaatatgggagatagtggacaatttatctgagatctatttttctttcctttccctctttttccttagtatatacaagctgaaccacccaccaacaagtccctgtctagcctggttgtacagttgctacaatttcaggaagaagtttttggcaaacatgtcagcaatgcaccgctcactaaactgccggtgagtgcagaagtagcagggagggtggggggtggtggtggtgaatccttcaaactgaagagttgtattttaaaaaaagatttgtgaattttgtaatttttgaaatttgggttattttccaccatccctatccctgatcagggcattattggcttggcctagtctccagtttaccattctttttgtcttagtaatattttgtgcaacaaattatttcagagtacctgggatcagtccacaggtctctcatggcatggttaaaaggggacttgagatttggatttgtgcaggcttgtgttcaaatcctggctttgccattggatggctctgtgatcttgggcaacattcatgagtcttggttccttcatctctagatgggattagtaaacctaccttgtagagtttccttaatggtacctgaggtaatccagtaaagtgttagcacaaggtggtgctttctgtgtgttggtttctttcactcccctcttccaggccacatgatgcaatggcacaagggttaaagaatttcagctttgaggccgggcgtggtggctcacgcctgtaatctcagcactttgggaggccgaggcgggcagatcacctgaggtctggagttggagaccagcctgaccaacatggagaaaccccgtctctactaaaaatacaaaattagccgggtgtggtggctcatgcctgtaatgccagctactcaggaggctgagacaggagaattgcttgaacctgggaggcagaggttgcagtgagccaagatcgcgccattgcactccagcctgggcaacaagagtgaaactccatctcaaaaaaaaaaaaaaaaaagggagatcaattcagcatgggattttgtgaaaggattattagattattaagtgatgagagaatttacagtggaaccttgacatgctttttccgtatcttgattttgtagatcaaatgtttcctagatttcaaagcgggaggctccttgtgccacattcttgcagctgcctacaaattcaagagtgaccagggatggtgagatgattctctctattcttcttatatttagtttagaggaaatccccctttttgattccctgggatctttctggggtagaaattcttgtgagtctctttattttgctgggtcagtagacctgacttactacgtcaggaagatggttgggagtcagagccaaaacagtctccaagagtgagtgtgtgagtatcactgtgtgttttgtagaggaaaagggattcttaggttggcatctcaaacctttttttgtccctttgaagtaagcacagagagtgattcatggagttgagatcagtgaacctcagatcccaggtgatgtttggcaatagctgtgagcaagcttgcctcctaatttcccatattaagaagtcatggctgggcgcagtggctcacacctgtaatcccagcactttgggaggccgaggtgggtggatcatttgaggtcaggagtttgagaccagcctggccaacttggcaaaaccccatctctactaaaatacaaaaattagccgggcatggtggcgggcacctgtagtctcagctacttgggaggctgaggcaggagaatggcttgcacataggaggcagaggttgcagctggccaagatcgcgccagtgcactccagcctgggcaacagagcgggactccctctcaagaaaaaaaaaaaggccgggtgtggtggctcatgcctgtaatcccagcactttgggaggccgaggcaggtggatcacctgaggtcaggagttcaagaccagtttgaccaatatggtgaaacctcgtctctacttactaaaaatacaaaaattagccacgtgaggtggtgtgtgcctatagtcccagctactggggaggctgagacaggagaattgcttgaacctgggaggcagaggttgcagtgagccgggatcgcgccactgcactccagcctaggtgacagagcaagactccatctcaaaaaacaaacaaaaaagtcacgtgccctcacctcatctgcagacctgagctataccactcactagattattgcctcttcacaaggcggcgttacgatttccagaatccatcacgcatggaccgcaatgtggaaatgtttatgaccattgagaagtccttggtgcaggtaataggcatataccctatttatctcccttccctcagtgagaatctaaaacacccctttcctataatctcattctatttcttctctccacagaataattgcctgtctcgacctaacatttttctgtgcccagaaattgagcccaaactactagggaaattaaaggacattatcaagagacaccaggtaaatggtctggtgaggagaggtttcagaaactccatgactgttttcccagtgttttctataccaagcagcagccctgaattaccatgttttctgcttcagaggtggctctgtctacttggaaaaagacttgagttaaagccttgagtctgtctttttctgtctgcttctcccatttttcagtcctgacaggtttgcattactgttctagagactatgttggcctggggaaaaatagtatccacttctactgagctagagattgcgtgatctcagataaatgaaattcctgctctttggaactttatagtaatgaatagatgtcattgataaggatgtacagtggactttaaatttcccatgtatagattatctgttcagaagattatttttggcaatttttaattctttgacttttctccattattagcacaatcccagctgtttccctctgccacttagctggtgtgtgcttagagaatacaaactaactttaatactattataagcaaaatatggttaggaaggcagctctgtggctaaaccttgagtaattcagaggggaccataatttacccgcttctccttttaccatccagggaacagtcactgaggataagaacaatgcctcccatgttgtgtatcctgtcccggggaatctagaagaaggtgagacctgggttttcctgtccacttgagtggatggtttggactaggaggcagaggactaagatcaccattcagtacctgggctcctcctcttctttcaatcttgaatcctcttaccaccttaagttcctattaccaagtcccctgctacaacaggagagtgcattagttagggcttttgtacagtattttttttgtgtccccctttagcttatatctctcccttctcttcctctatccccagaggaatgggtacgaccagtcatgaagagggataagcaggttcttctgcactggggctactatcctgacaggtgaggatgggttcctggggcaggtttaagtataagagccagacccagaagccctaggacatctagcagagcaagaggccactctttcagagttatttttagatcacttaatttgttttcctctcacctagtaagtgaacctctgtcttgggggaggtttggacttagtggacaagccttgggctaaaaggattgaggctttatgtgtgaattgattatcccagcatcattttcgataagtaaatgttagaaacaatctaaatgtctaacagtaggaaaatgtttcagtaaatttgtatatctactcagtggactattatgcagtctttaaagtgatataacatggataatttataagtgaatattattaataattgcaaaaagtagcatgtaggcctggcatggtggctcacgcctgtagtcccagcactttgggaggccaaggcaggcggatcacctgaggttaggagttcgagaccagcctggccaacatgctgaaaccccgtctctactaaaaatacaaaaaaaaaaaaaaaattagcagggcgtggtggcacacgcctgtagttttagctacttaggaggctgagaagcaggataatcgcttgaaccggggcagcagaggttgcagtgagccaagatcacaccactgcactctagcctgggcgacagagcgagactctgtctcaacaaaacaaaacaaaacaaaaaatagcacgtaggctgggtgcagtggctaatgcctataatcccagcacttggggaggctgaggtgggcagattgcttgagcccaggagtttgagaccagcctaggcaacatggtgaaaccctgtctttacaaaaaaaaaaaatacagaaattagctgggcatggtggcatgcacctgtagtcctagctacttggggggctgaggtgggaggattgcttgagcccaggaggttgagtctgcattgtgccatgattgcaccactgcacttcaacctgggcaatagagcaagaccctgtctcaaaaaaaaaaagcatgtaaaatatcatctagtatggttatgattatgtaaaaacatcatctagtatggttatgattatgtaaaaagaaaattgtggaccaggcacagtagctcactcctataatactagcactttgggaagccaaggcaggaggatcactaaaggctggaagttcaagaccagcctaggcagcaaagtgagaccctgtcttaacaaaaacaaaaaccccagctggacgcggtgtctcatgcctgtaatcccagcactttgagaggccgaggtgggtggatcacgaggtcaggagcttgagaccagcctggccaagatggtgaaaccccgtctgtactaaaaatataaaaattagccgggcgcagtggcaggcacctgtaatcccagctactcgggaggctgaggcaggagaatcgcttgaacccgggaggcggaggttgcagtgagccgagatcgcgccactgcactccaacctgggtgacagagcaagagcaagactctgtatcaaaaaaaaaaaaaaattactgtggaggaaaaacagatatacaagtatcaagagtagttacgtaagggtgattctttttgttctctatttttgaaatgtttcgtaatgtgcttttactactttataatgaatagaatacaaaaaaaataagccaagaacccaatactttctgtaaatggaaagggtaaaagatctgcactttacttttccacaattctatcccattgattctactgtgtgctcaatttcccatggcagttacgacacgtggatcccagcgagtgaaattgaggcatctgtggaagatgctccaactcctgagaaacctaggaaggtgagcttttcttgtatcccctcttccccaaaaagaatgccaggaacagtctaccctttggaagtgaaacagaggcttgtatgcccttgagctttttctgttaagggtccccagacagagctgtggcttccaggcttctctgcagcatgatctgcctttgtactttaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgacaaatcctgttctttttttcctggcgcccttagcataagtctcagaacaaatcttcagtggggattgtaggctgacatttgtcctgattctccatcctataggtgaacagcccagattcagatcgacgggacaagaaggggggaaactataagaagaggaagcgctccccctctccttcaccaaccccagaagcaaagaagaaaaatgctaagaaagggtgtgccagcccctagcctgcccccgtgttcaccattctctccacatcatgttgaaggaaggaaagacaaatcccttcctataaccacctggccctgacctgggtgtgccataatactgcaggtgtcctgagagggaagatgaggagatctttagctgctcagttgttagttctggttctggccccactagtacatttaaagagagctttatcaagtgaaaagcctttgccacttcccattactgtgtgattactggtttctgtttgtactcagctctacccttggaattctctgtcacttcccttcccttgaacttcaacttccagggactccttgtccaaggatgactgggttctctttcactctctttccttcccagtccctcaacaccttacactaagtcaaagcgtggccacagagaagaggagcaagaagacctgacaaaggacatggacgagccctcaccagtccccaatgtagaagaggtgacacttcccaaaacaggtacaggccaggctgagctcctgggatccacccccactccccgtcttgactctcctttgccaaaccccaagtgagctgatttctcaggtccacctcccagtctacaggatcttttccttaaatttagctggttattggaattacggtcattaccctggaaaatcctctaactgtatattcatatctgagttgtggactgtgctttgtgcctgatagtagttgtctccaaactctttgattatgtgtttctgacagtaaaatatatttgagcatggccaggcacggtggcttatgactgtaatcccagcattttgggaggccgaggcgggcggatcacctgaggtcaggaattcgagaccagcctggccaacatggtgaaaccccatctctactaaaaatacaaaaattagctgggcgtggtggtgggcacctgtaatcccagctactcgggagaccgaggcaggagaattgcttgaacctgggaggtagaggttgcagggagccgagattgtaccactgcactccagcctgggcgacaagagcaaaactccatctcaaaaaaaaaaagggccgggcacggtggctcatgcctgtaatcccagcactttggcaggccgaggtgggcggatcacgaggtcaggagatcgagaccatcctggctaacatggtgaaaccctgtctataccaaaaatacaaaaaaattagctgagcgtggtggcgggtgcctgtagtcctagctactcaggaggctgaggcaggagaatggcgtgaacctgggaggcggagcttgcagtgagctgagatcacgccactgcactccagcctgggcaacagggcgagactccatctcaaataaaaaaaaagaaaaaaaaatgtatatatgcattaattatgtacttgtactgttaagccgctaccatgggaacgttttaaaacacaaacatatctaaaaaattgaaaaatgtaaagaatgataaaaacaaacatgaagaatcagggcgcggtggcttacgcctgtaatcccagcactttgggaggccgaggcaggcggatcacgaggtcaagagatcaagaccatcctggctaacacggtgaaaccccatctttacgaaaaatacaaaaatttgccaggcgtggtggtgggcgcctgtaatcctagctattcgggaggctgaggcaggagaatcacttgaatctgggaggtggaggttgcagtgagccgagatcgcaccactgcactccagcctgggcgacagagcgagactccgtctcaaaaaaacaaaacaaaaaacatgaagagaagttctgtattctctccctgagttgcagtggatcatcttttgcgtcctatgttagaaccccactttggagacattgctccaccaatactggtttacagtctgtattctgtagactcaccccaggtattccagaagtgtatttcaggggtaggattagggctgccaccaagaagagttctggcttctacctcctcatcaatcagctctctctcttctctatgtttgctcctgagcatatgtatatgaattcagttgaggaaagtatcctctgctttcaaaaatgtttaacacttaaccattcttccacagagtgatttggtcagattcagtatcagaccattaaaagcttacagatacatagatggagataaaggcctgtcaaagacaagaatcatttatgaatgtacatagagaaataagttaaattaatttttggttggagaagtggggaaagtagcaagaagtttgaagccctagaataattgtgactggagagaattactatattttgcaatcaggtggagacaatttttggagaaagtaggatgtctggaactattaaattgaaggcttgaattaggcaaaatctgtctgataaaatgactctctgttttcgcagtcaacacaaagaaagactcagagtcggccccagtcaaaggcggcaccatgaccgacctgggtaagacaggagcctcttgggcacggcagtcagagccaagggaaggggagggctcagctgcccccttttcgctagcctgatgggcttttggtagggctttcttgcccctcaggaggctccagccttacatcttggtttttctctttcagatgaacaggaagatgaaagcatggagacgacgggcaaggtggagccagtttagagaggccctacctctctatgtgattctgatttgtgattataaagttcattctgcccaaacttttcactgcccagactttacccactgtagactaattccagctttgttcaaaactctgaccctttcagagtcctggggcccatgactgctcagtcccatcacccatctttagtgtccacattcctggggtgtgggagaagcagagggttgctagggaggaagcaggaatgctgagtgtccagcagcctccatactcgtaggatgaggatgagaacagtacggggaacaagggagagcagaccaagaatccagacctgcatgaggacaatgtgactgaacagacccaccacatcatcattcccagctacgctgcctggtttgactacaataggtatggttgtccccaacttctcactgagtccttatttccctgcctccaggggtcaacaggctgttcttctccctgcctcctccaaataagttattttttcctcacccaaatagaccagagtacactttagttttaggggagctccttgtgtccttttgagtcttacagcctgtgggatgttctccccaagcttctaacttcagcaatttcgagctcttttccttctttgccttctaggcttttcctccctttggggcccccatcccttcaccaatgccttcttctgaaaccattctggcttttcttgcagtgttcatgccattgagcggagggctctccccgagttcttcaacggcaagaacaagtccaagactccagagatgtaaggaaatctcatctcatgattctccttctccctcctgtccccacattcacccttcctgatccagtaacattcagtttagcaaacatttcttgagcatcttccatgagccaggcactatgctaggcttacaaaggcacaatatctgcctttaggcagccctggcctagcatgtagacacatgttctttaggatttgcccaagggtgatattaagcatgttctatacataacaagtacctactccagtgcctcaacttctttttaacagggtatagagcctttaaatccatattactgatatcgtctatactgcagatattcctagcacaaaagttttgattaaagtgtaaattactattaccaggctggttcctgagagtaggttttaatagaaaaacaagagaaggaactaatagaagaccagtttatataaattaagggatggagagggctcactgggaaagaagtgtaggagccacggtggctcacgactgtaaatcatcccagctacttgggacactgagacagaaggattccttgaggccaggagttcaagaatagcatgagcaacatagcaagactcccatctctaaagaagtgaaaaaaaattagctgggcctggtggggcatacctgtggtcccagctacttcggaagctgaaatgggaagattgcttgagcccaggagtttgaggctgcagtgagccatgatcacaccactgctctccagcctggctgacacggcaagaccccgtatctaaaaaaattaatgaacaaggctgggtgtggtggctcacgcctgtaatcccagcactttgggaggccgaggcgggcggatcacaaggtcaggagatcgcgaccatgctggctaacatgatgaaaccccatctctactaaaaagaccaggcgcggtggctcatgcctgtaatcccagcaattcgggaggctgaggcgggcggatcacccgaggtcaggagttcgagctcagcctgaccaacatggagaaaccccgtctctactaaaaatacaaaactagctgggcgtggtggcacgtgcctgtaatcccaactactagggaggctgaggcaggagaatcgcttgaacccgggaggcggaggttgcagtgagccgagattacgccattgcactccagcctgggcaacaagagtgaaactccgtctcaaaaaaaacaaaaaaacaaaaacaaaaaaaattagccgggcgtggtggcatgcatctgtagtcccagctagtctggaggctgaggcaggagaatcacttgaacctgagaggcagaggttgcagtgagccgagatcacgccactgcactccagccggggtgacagagcgagactccgtctcaaaaaaaaaaaaaattagctgggcgtggtggcaggcgcctgtagttccagctacttgggaggctgaggcaggagaatggcatgaacctgggagacagagcttgcagtgagccgagattgcgccactgcactccagcctgggcgacagagcaagactccgtctcaagaaaaaaaaaaagattttgcctcaggccaaacctgcttggctttggataagacatggcagtcttctttggttaggaatacttcaagataaccacattgatgaggtgggtgagactgagaactgaacaagttttcttcccagctattccacagcttcccctctctgggggtccctccgtgttttttcttcatagcttgctatggttctctcttccttctcttcctggagaaagcagtatgtgtgaaaagaaagtagtgatcaggtgaaatgaattcaacatgacatgcaggcagggttggagtaggaactgaactcttggtataaaatagtaaatgatggctgggcatggtggctcacgcctgtaattccagcactttgggaggcccaggcgggcagatcacgaggtcaggagttcgagaccagccaggccaacatggtgaaaccccgtctctactaaaaatacaaaaattagctgggtgtggaggcacgcacctgtaatcccagctacttgggaggctgaggcaggagaatcacttgagcccgggaggtggaggttgcagtgagccaagatctcatcattgtactccagcctgggcaacaagagtgaaactccatctcagaaaaaaaaaaatagtaaatgatgataattgcctgcatctattgagagcttagtatctcccaggcactatactaaatgtccaacctacattgagtaatttaatctttacgtcaaccttagaggtagatatcatcttcagttgacagatagggtatagaggagtcaagtcacctgcataaagtcacagagctagtaaataaaaccaggatctgaatcctttaatctggcccatgatctgaaactttacactgtaccacatgatagctgccatttttttgagcccctacaatgcgccaggcactatactagtactttatagacctctcaacagacattccattttacaaatgaggaaactgaggtttaaaaattcgaagtaaattgccaaggtcctcatggtagaactgggatttgaacttagatcttttcaacttcaaaacatatgttttttaccgtggtatgctgactagctatatgcatgaataaggacttccttttaacatctgagtttggaaatgagtattttcttaacttctaattccttgtttaaaaattgtataaaatggctaggtgcagtggctcatgcctgtaatcccagcactttgggaggctgaggcaggaggctcacctgaggtcaggagtttgagaccagcctgaccaacatggagaaaccctgtctctactaaaaatacaaaattagccggccgtggtggcacatgcctgtaatcagagctactgaggaggctgaggcaggagaatctcttgaacccaggaggcggaagttgccatgagccaagatcatgccattgcattccagcctgggcaacaagagggaaactccatctcaaaaaaaaaaattgtatgaaatatccctaagtatagccaaggagataattcatttaaagaaaaccccatcaaggaaaagtaagacatatttgaaaccctttcatctagcacatagcaggcactcagcatgtagagtcaaataatctacttttttccatctttatcatgcaggagaagtcattagctctcttaccattttttcctttagccctttaacaaacatttatttttcttcttcttgtttctctctctctttcttctaagctacctggcctatcgaaactttatgattgacacttaccgactgaacccccaagagtatcttacctctaccgcctgccgccgaaacctagcgggtgatgtctgtgccatcatgaggtgggtcttgtggctgaggggaagggggtacatgaggatgcctgcctatggatgtgttttggcaacagtagagatgccagcaaggaacacagaggagcagacagaaaaaagcacctctagagaaaggtgaagtacaggtttggggaatgaatgacttgagggattagcaatggcattctctgaagtgtagaatataggacaaagaaggagcatgtctgtaattgaaagatactggttcaggccaggtgtggtggctcatgcctataatccaaacattttgggagaccaaggtgggaggattgctggagcccagaagttcgagaccagcctggacaaaatggcaaaaccccatctctagagaaaatgcaaaaaaattagctaggcatggtggcacgtgcctgtggtcttagtgactcaggaggctgaggtgggaggatcccctgagccctggaggtggaggctgcagtgagcggtgatcacaccactgcacttcagtctctcttagggaaaaaaagaaagaaactggttcagttttactagctattcaggaagaaatgttcggtaggtaggtagatatagagattggcccaggctgaagatgtagacttgggtgtcactggcatttaggtgataaatgaacaactggagtaggtgagatttcttaaggagtacaatgaacagaggaaaaggccggggttgggtggggagggggtttatgccccttctaccccccacttttcctcttcctcgtgcacctttctggctatccgtgtgaccctgtctctgcctctctctgcacagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcaggtagggtgaggtgctatggggatggggcgggttgggaagattgggcttctttgaacttttctttttctggtttttagggtaatggttcaggagtgttttgaggcttcttccttttccatgggatgcaaagggtcacgggaatcagccccatgtgtttagcatcctctctcagcctttgtacctaaggctgtaattgctgagggagaagagattatccttttactcaaggagtagacaggctaatgtaggggagtcaatagagaaaaatggcttaaaattaacttgcatgaaatttttaaactttgtcatctttgccacattttttcatttttgcctcataattatcatcttcatttttttttccatttccacttcatccattacaaaaattaggaagaaggttatgtggcttgcccaaggtcacagagtaccaaatctaggattagaacctaattgtccagctcctaagagaacctataaagataatgtgaatatgtatggatatcatgccaacgacatgtcttattaatcatgaagggaacatggaacagtggcatgagtgcccccagagcttgtgggccgcccagcatatggtcttgaggcctccagggccttggcctggtcatttcctgcccagcctccatgacgccaagctctgtcccccagggccgccaggttgatgctgataccaaggctgggcgaaagggcaaagagctggatgacctggtgccagagacggctaagggcaagccagagctggtaggtggggtgcagaccctgctgggctgctcattttcccctttattggggggcccctgcccgggaagaagagacatgagagcagaggaactacagcagtaagggaggaagtcccacccaggggtgtccctggctttgggaaagaagctccttctgtctgttttttctctctgtcagcccctggctcccggtggtcacttgtactcacctgtttctttccctccacaaatagcagacctctgcttcccaacaaatgctcaactttcctgacaaaggcaaagagaaaccaacagacatgcaaaactttgggctgcgcacagacatgtacacaaaaaagaatgttccctccaaggtaggaggtgcgggccgactctaggggtagagaatgttcgctcctcagaggtcacaggctcctttcttctcacctgcctgtgtttcccctgcagagcaaggctgcagccagtgccactcgtgagtggacagaacaggaaaccctgcttctcctggaggtaattggggcaaagaaaagagagtttttctctgaaaacagaagtgggctccgtgtagaggctcacgcctgtaatcccagcactttgggaggccaaggcaggaggatcacttgagtccaggagttcgagatgaacctgggcaacatagtgagactccgtctctacgaaaaattttaaaaattagccaggtgtggtggcacacacctgtggtcccagctactcaggaggctaagtgggaggattgcttgagcctaggaggtcaaggctccagtgagcttcaggaccagctccaggctggggatttgggccatttcattaacttcatatcctttcttagtgctacttcaagatcccccttggacctagcagagtacacaaataccagaacatagagaactttgaaaccagctgcccttagtaggatggggggagtcagccttcgagaaaagtggctaagtaagcggagttatgtctccaccactaccaccaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctaggtaatgggggtgggtggttccacctggccttcttagtttgcttttgaagggctagttactcagactgtgaatcctctcaagtttggctgccctgctggccttgtctgtgcgggcctcagctcaggcacctgtctaggctccatactagcttagatgaagacatgggcttgtgagtaagcttttgcagggattgccagaactgttccactgtgccgctcccagcctcattctttctgggtcttgcagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattggtaaggccaggcaggttcccagatttcttgcctttcacaagatccagagctacctggcctcctgtgccatttctgcctcaagttggcattagagcacaacatgaatgagaacattggtagggtttttattttccccatgagtttacctcaggggctctggagccctactagtcctctcatgaagattttgggtagaaaaatctttgcttgtagaaggggctgttagaaaagtcttgtgaaggccgggcgcagtggctcatgcctgtaatctcagcactttgggaggccgaggtgggtggatcacgaggtcgggagttcaagaccagcctggccaagatgctgaaaccctgtctctactaaatatacaaaaattagctgggcgtggtggcacgtgcctgtaatcccagctacttcagaggctgaggcaggagaatcacttaaacctgggtgccagaggttgcagtgagccaagatcaagccactgcactccagcctgggcaacagagcaagacttcgtctctcaaaaaaaaaaaaaaaaaaaaaaaagtcttgtgaaggctgggtgcagtggctcatgcctgtaatcccagtactttgggaggctgaggtgggcagatggtttgagaccagtctgggcaacatggcaaaatcccgtctctacaaaaaataccaaaaaagttagccaggcatggtggcatgcgcctgtagccccagatacacaggaggctgaggtgagagaaccacttgagcctgggaagtcaaggctgcagtgagccatgattgtgctactgcactccagcctgggcgacaagagtgagaccctgtcacaaaaaaacaaaaaacaaaaaaaaacaggtgttatggagaagctgggtgcaacggctcacacccatagtccaagctgctcaggaggctgaggtgggaggattgcgtgggcccaggagtttgagaccaacctgggcaacacagcaagaccctgtctctaaaaaaaaagaaaagtgttagacacagacgactgtgtattaaacatttcctgttttctttcttttctcatgggcccagaggagagcgggaatgacgaggctcgggtggaaggccaggccacagatgagaagaaggagcccaaggtatagagggatttctggaagctgcaggggctgcgtgcagcactgtggtgatggggaagttggccttgttcagcttaggtgggcaagggctggttttggacggggttgtctcctagaatcagatcacctccaaagtaagaggaataaatttagttccccgtctggcccctctgtgtgagaactaatcaccctaatccctgataactctccttttctatcactggaatttcaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaataggtgagcctcccacaagggtaggtgggggtgcaggacagaggtgaagctgtggggctaactcaacccttgtcctggcccagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaaggtgaggccagaccttgaagacctcagggaagaaaatgtccacttctctaatctcatctcacttagaggaaatctttcctcactcacaccttaaataatgctgacctatttattttttatttttatctcaggaggaggtaaagttagtcatcccttctctaagctttaaaaaatatatcaccattgggcctgttttcaaccctgtcagtatttgactccatgttaccctttgccacactatctccatgttcttcttttgagacggagtcttgctctgtcagatctcggctcactgcagcctccacctcccaagttcaagtgattctcctgcctcagcctcccgagtagctgggactacaggcgtgctacaccacgcctggctaactctttgtatttttagtagagatggggtttcaccatgttggccaggctggtcttgaactcctaacctcaggtgatccacccgctttggcctcccaaactgctggaattacaggcgtgagccaccgtgcccagcctccatgcttgtttatttatttatgtattttttgagatggagtctcactctgttgcccaggctggagtgcagtggcacaatctcggctcactgcaacctccacctcccaggttcaagcgattctcccacctcagcctcccaagtagctaggattacaggcacgtgccagcatgcccggttaatttttgtatttttagcagagatggggtttcaccctgttgccccaggctggtctcaaactcctggactcaagtgatctgctcgccttagcctcccaaagcgctgggattacaggcatgagccatcacacctggccaaaataatttaattttttaaaaaggctgggcgcagtggctcacgcgtgtaatcccaggactttgggaggctgaggcaggtggatcacctgaggttgtaagtttgagaccagcctggccaacatggtgaaaccccatctctactaaaaacacagaaattagccggcgtggtggcgcatgtctgtaatcccaggtactggggaggcaaaggcacgagaattgcttgaacccaggaggtagaggttacagtgagctgagatcatgccactgtactccagcctgggcaacagagtgagactgtcccaaaaaaaaaaaaagaaaaaagaaaaaagacacggtggctcacgcctataatcccagcacaaaaaagtcaagccctttcaccatgggttgtgaccacagcaaatttgttcttatacctgccagcatccaccctacctttcttctgtattgtcttcagttgggtcctcccactgatgtgctgtctcgcccctccttccctagcacttggctgctgttgaggaaaggaagatcaaatctttggtggccctgctggtggagacccagatgaaaaagttggagatcaaacttcggcactttgaggagctggagactatcatggaccgggagcgagaagcagtgagtagcaggagccctggaaccctgctgcgctgtgcctcagtttaaaatcggaggggcgtgtgtgtgtgtgtgtgtgtgtgtgtgtgtgtgtgtgtgtgtgtgtgtttcagtgaaagagagataagcaacagtggggaaagcctgagtgtgtgtgtgtgtgtgtgtgtttcagtgaaagataagcaacagtggggaaagcctgagacagacagggcttcaaagcagagcagggcaggaacagggcaggagtagggcagccagttagagacagttaagtggtctcacaagtgaagtctggggactgaagtcccacagaaggtcagctccatgaggcagggactctagttggttgttttgattgctgcatctccaggtccttgaacagtgcttggcccatagtagactcaaatagtgattgagtgaatgggcgtaacggatgatgagagagagggtaagagcctcagatccaggaggtgaacttggaaagggaatgggaccgacacagtgttgaaccattttgtctttggaggacataaaaagaaatagacaatagggactgggcacagtggcccacatttgtaatcctagtactttggtacactgaggcagatggatcacttgagcccaggagttcaagaccagcctgggtaacatagtgagatctctgtctcaacaatttattttatttatttatttatttatttatttgagacagagtttcgctcttgttgcccaggctggagtgcaatggtgtgatcttcgctcaccacaacgtccgcctcctgggaagcgattctcctgcctcagcctccccagtagctgggattacaggcatgtgccaccatgcccagctaattttgtatttttagtagagatggggtttctctatgttggtcaggctggtctcgaactcccgatctcaggtgatcagcccatctctgcttcccaaagtgccggattacaggtgagtcatcacgcttttttttttttttttgagatggagtcttactctttcgcccaggctggagtgcagtggtgcaatcacggctcactgcaacctccgcctcctgggttcaagcgattctcctgcctcacctcccgagtagctgggattacaggcacatgccaccatgaccagctaatttttgtatttttagtagagacagggtttcaccatgttggccaggctggtctcaaactcctgacctcaggtgatccgcccacctcagcctcccaaagcgctgggatttcaggcatgagccaccgtgcccagcccaaacattttttaaaaataaacaaattagccgggcgtggtggtgcgagcctgtggtcccagctactcaggaagctgaggtgggaggatcgtttgagcccaggaggtcaaggctgcactgagccatgtttgccccattgcattccagcctgggtgacagagtgagaccctatctcaaaaaaaaaaaaaagaagaaaaagaaatagaagatagggacctcagagaacttaaggtttaatgggagacatcaaatgaatatacaatatggagacatcagaaacagttaagaaggtttaaagtatctgacaaattcacattaagagattgcacatcagccgggcgcggtggctcacacctgtaattccagcactttgggaggctgaggcaggtggatcacgagatcaaggagatcgagaccatcctggctaacatggtgaaaccccgtctctactaaagaataaaaaaatacaaaaaattagcccggcatgctggcacacacctgtaatcccagctactcgggaggctgaggcaggagaattgcttgaaccggggaggcggaggttgcagtgagctgagatcacgctactgtactccagcctgggtgacagagtgagactcagtctcaaaaaaataaagagattgcacatcaagtttctaagtcctgagatcatagaataaagctaaagctcagaggcaaatgaattgatctgggatagcttcctaagaacagtgactttttagtgaattttgaagtaagaaaagaacttgaattgacaaaaggaactggaagcattttccaaatcaaggtaatggcaagttcaaagctttgtagctgaagtgagcttgggccaggttaaagtcattgcaataagaaaccatgtgggcactcaggagacataaaggtcatgggaatttgcacgaagtcgggtggggaggacagagggagcacaagcacaagatgtagattttgggaaccttctgattgagaggcaggctctttcagaagaagacaaagcaggggttgaggcatttgcctttgggatctgctgaaaattggataacaatactcaattggcactggcagctggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggtaagtgttatgttccagaacttttgttggctagaggaatccaggtgaatgtcccagttctcctcaaaggggatacaagatgagtgtggagatgaggttagcctcaatttctacagatgggcccatctctcttaggcccctaaatcagcaggagtccttccccaaactcgagagctttggaattttattcacttactctagtgtcagaaaaggggaagatagtgccaaggaatggctagattatccttgtttgtaaaagtgagttattctttgggaggccgaaatgggtggatcacgaggtcaggagattgagaccatcctggccaacatgttgaaaccccgtctctagtaaaaatacaaaaattagctgggcgtggtggtgcgtacatgtagtaccagctactcgggaggctgaggcaggagattgcttaaacccgggaggcggaggttgcagtgagccaagatcgtgccactgcactccagcctggtgacagagtgagactccgtctaaaaaaaaaatagaaaaggtgagttgttaagcaaaattttatacctaattttctccatctctcatctttattctcaggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccaggtgagaaggggccaagaggggagaagggtgagggagaggggtccacctggagggagggtgagcgggcaggtggggaagaggtcaggtattagagtttccacaatcctttttgaacactctggtaaaattagaatacaggaggaagggcctctctggccgtcctccaccattccccagcctggcagctgccacctttgggatgatgttggggcctttcactggtgggtcatggagcaatcctgtggcagagagcatctcagttgtaaacttgaaaagcagctgtttgcatgatgattgagtggcatccctttgcttattcctatcacgttcaaatgccccatatagagagtctttctatatgtttttctgagtatgaggtagaaaagagtgttgggaacagaagttgaacattatgggtacctcattcatccacccagccactgcatgccatgcccggttctgtctgtctgtggtggtctgggtctggagccatctctccggcgtactctaactgatttatcttccttttctccacagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaa

SEQ ID NO: 35833 - DNA, 7892 bp, Homo sapiens
agttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctggtaagtgcttttctctaggagctaacgttccattttgccgccccatgaccttgagccggggaacgatggtagctcgggcctaagggatccgtggtgttaaaaggatgcctggagccgcgtcttgctctctaatggctggagaacaagaatgggacacccataggaggtttcttcgacccagctctgtcccattttgtataaagtcctttgtgtgacggaaaaggtgcgggcaggtgcgttgaccttccggttgaataggggtactgaactctcgaaaaatggggtcttgtgcatgcggatgggaaggctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgcccggctaatttttgtatttttagtacagatggggtttcaccatgttggccaggctggtctcgaactcctgattttgggtgattccccccccacctcggccccccaaagtgctgggataacaggcatgagccactgcgcctggctagttgagtatttttaagactcggtcttatggcttaggtttaggagtctccaaaacttgtaggtttttgtatttgctattgctatgtgagggaatgctgttaggttaaggctcagtaaaatgaaaaatttatgacagttaaagtcagggaatgggattattgtttcctaagataataattttctttattgcagaaagttgggttagatcctagatgatagtttatctgatttatgtaagaaaggggaggtaagactgtggttcctcaggtaaagggatggacttgagagttgatagggagggatatataagattatcatttgctttcaacaaggtgaatagatactatcctctcttctacctttacagatttgctcccattcatgctgaggctccagagttcatggaaatgagtgttgagcaggaaattctggtgactggtatcaaggttgtcgatctgctagctccctatgccaagggtggcaaaattggtatgttattaaggggtacatattttccaaacctaatatgggaggaaaaactcatacaatgttatgagtggatattgacatctattcctcactgatgagtacgttctgactttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagaaaggatctgtggtcgtttctccgatttgggaaccttcagtatgtggcttctctactcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtaagagggaaggcttgagaggacctggttcatctggcctttcttcggatgaggctaaggatgtagacacctaagacctttttttcttttaggtgtctgcattattgggccgaatcccttctgctgtgggctatcagcctaccctggccactgacatgggtactatgcaggaaagaattaccactaccaagaagggatctatcacctctgtacaggtaagaaaaattacatagatgaagatctgatttgtataaaggcagggtgcagtggtgcatctcagctactgaggaggctgaggcaggaagattgcttgagcccaagagatcagcctggggaacaaagctgtatgtatgtagagagatgtataaaactgactgggccaggcgtggtggttcatgcctgtaataccaacactttgggaggctgaggtacgcggatcatgaggtcaggagttaagacaccaccctggccaacgtggtgaaatcccgtctctactaaagatacaaaaaattagctgggcgttgtggcaggcgcctgtaatcccaactactcagaggctgaggcaggagaatcgcttgaatccgggaggcagaggttgcaatgagccaagattggggcactgcactccagcctgggtgacagagtcagactctgcctcaaaaaattaaaaaaaaataaatgaaggtatacatttaaatgtagatcacaaagcaatggtttctagtctgaggggagtccggcgctatatggaaactgagcattaaatatttactgtattagggctgagtgcagtggctcacacttgtaattccagcactttggggccgggcacggtggctcacgcctgtaatcccagcactttgggaggccaaggcaggcggatcatgaggtcaggagatcaagaccatcctgacttaacacagtgaaaccccatctctactaaaaatacaaaaaattagctgggcgtggtggcacctgtctgtagttccagctactcgggaggctgaggcaggagaattgcttgaacctgggaggcggaggttgcaggaggttgtggtgagctgagattgggccactcactccagcctgggcggcagagtgataatccgtctacaaaaaaaaaaaatttactgcattaatgtactatacattttcaaatatatatagatgggatatatagtaaaattacataaattttacatatagtaaaaatgtggctaaactgtaggaacttttcatgattcagtgtaatgaactattgtgcaagaagttttttgttcttgtttttaattcttttttttttttttttgagacggagtttcactcttattgcccaggctggagtgcaatgggtgcgatctgggctcactgcaacctcctcctgggttcaggtgattcctttgtctcagcctcctgagtagctgggattataggtgcccgacaccaggcccggttaatttttgtatttttagtagagacggggtttcaccatgttagtcaggctggtcttgaactcctgacctcaggtgatctgcctgactcagcctcccaaagtgttgggattataggcttgagccactgtgcccagcctcttttttatttttttattttttttaatttttatttttttgagacggagtctgttgcctaggctacagtgtggtagcacagtcttggctcactataacctccacctcctgggttcaagcgattcacctgcttcagcctcctgcatagctgggattacaggcatgcatcaccatgcctggctaatttttgtttccgtttttttttttttttttagtagagacccccgtctctactggtgtcgaactcctgacctcgtgatctgccctccttggcctcccaaagtgctgggattataggcatgagccaccgtgcctggcccccagcctcttgtttttaattctaaaagtgggcattaaaatagttaaaataaaagatgaagaacaaaaagaatgatactaaaaattcttccatcatggctgagagaccagataatctgtcagcttattcagcaggtattaggggtggtaagaagggtcttttgagtgctaagaatatggagtgagatgataaagataggtcagaaagggggatggcttaagtaaaattactttggttcgctgggcgtggtggctcacgcctataatcccaacactttgggaggccaaggcgggtggatcacgaggtcaggagttcaagaccagcctggccaagatagtgaaaccccgtctctactaaaaatacaaaaaaattagccgggtgtggtgatgggcacctgtagtcctagccactcgggaagctgagacagagaattgcttgaatccaggaggcagaggttgcagtgagccgagattgcaccactgcactccagcctgggcgacagagcgagaccctctcaaaaaaaaaaaaaaaaatttactttggttcctgttcttcatgggatctcactttaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctactttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaaaggaatgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgagattttgagtacaaatcttgaatgtttactgtgctgtggtcccattccaacaaccgtcaagcaatatatgtaatatactatgcttaattatattttttaatttaaaaaacaaacttacccattgattttgtttgaaaatactctacatttaatttgagtgtgatttgttacttgattctctagctcccttttattttatatgtattttttgagactgagtctctgtcgcccaggctggagtacactggtgcaatcttggctcactgcaacctccacctgccgggttcaagtgattctccagcctcaaccatccaagtagctgggattacaggcacacgccaccacgcctggctaatttttgtatttttagtagccatggggtttcaccatgttggctgggcttgtctcgaactcctgaccttaggtgatccgcctgccttggcctcccaaagtgctgggattacaggtgtaagccaccgtgcctggcccatgtgttcttaattcatactgtatcatatcttgtaaatttgatttgtgagggaaatttaagctttctaagatgacatgaattcatcacattctaactgatggcctgaagtggtgaggaatgttacatgatgcagaaagttgatatccctccgcttcttactctttttttttttctcccccatcatacaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcag

SEQ ID NO: 35834 - DNA, 12276 bp, Homo sapiens
ggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgtaaggcggggctgaaccggagggccgggcgggcaccgcgcgccgccgcgctcctggcgggcccgggaccgcggactggagcccgccgcctcggggctgcgcagccgtccttctcggcgtcctccggggtcggtcctgtgtccctcctaagccccaccgtcccggccatttcttcccgcatcgatgcagtctccgcggagaacaaagcggctctagagcgcggcgttccccgccctctggggcttccaggcaccctgaggactcggcacaatctctgcggggacggggtgggcactacacctgtcctccatcctgctggacataactagccccacatccctggctccctaaaatctgggaaaagcccgttttctaatgggacttttagttatcgttgaaaaagtcatagtctggttcatttctgtcctttaaacaggctcgtttctggcgctggagacatcaaacttactaaagacggcaatgtgctgcttcacgaaatggtgagaggtgctctgggctaggtcagaaaggtcttgattttccgtagaatgttttctttgtagaaagatttgcagtgtccattttcaaggtaggagaacattcagaagtggcgtgtaatcagtaatagtcctgagtgcctggagtctgacagccctgcctttgaatccctgcttttttgccattcacagtccgggctaaagggctgtaattgtatattaaagttaattattttaaaacttgaaaaattaagagaggttgacacaatcacatgggcaaaatgcatgaggatgatttttcttttcttttctttttttttttttttaattagacgaagtctcgctctgtcgaccagcctggagtccggtggcacaatctcaactcactgcaacctctccctcccgggttcaagcgattcttctgtctcagtctcccaagtagctaggattacaggctcgcgccactacgcccagttgatttttgtatttttagtagagacaggatttcaccgtgttggccaggctggtcttgaacgcctgacttcaggcgatccccccgcatcagcctcccaaagtgctgggattaccaggcccgtgcccagctgggttttctctttttaaaacagcagtttctctgttaggtctcatctctatctccaactggaggggagataaatctgtctctttgcaagtcttagggatggagaatattagattattgaggggagtatgctttttactcatccctaaattcccaaaacttagcagttcaaatccaagaaaaggaaattatttcctgctgatttgagttcagaataatatgtagggttttgctagtggtataccatgccatcaacatccagatgaaatatctttagtaaggacttgctaacctaggaggtgtagtttttgtttttagtgggctcagtggtggcccgtgtttgaaaagtggagccacagttaaacttgacttcagaattgtttgggggctaggtgtggtggcttatgcttgtaatcgcagcactttggcaggccaaggtaggtggatcatttgaggccaggagttcacgaccagccctggccaacatggttaaaactccgactcagctaaaaatacaaaaattagccgggtgtggtcctgcacgcctgtagtcccagctgcttcagaggctgaggcaggagaatcgatcgcttaaacctgggagactgaggtttcggtgagccaagattgtgccactgcattccagtgtaggagacagagtgagggtatctccaaaacaaaacaaaaaattatttgggttttagtgtgtgagaaatacagcgtaggtagagagaagcacattgaacatttacaatttaagaaataattataaaatggacacacacaaccaccactgtagctaataaattgttgctaccacctcagaagtctcgtcccattggaacctctctccaatctccagaagtctgtttttcagttttctttgaaaaaattacaaacctacaaaaataattataatgtgtgtgccctttaggagatacctggcttattctcactagagctctacacttgccataaagaggcaaggatgtacaattatgtgttactgttaactggtagctctgtcatcttgagtaaacttctactgagcctcaagcttcctcatctgtaaagtagagataacctgggaaataaattacacatgaagacgtttcaatcattataattgcatgtgcatgatagttaatcgaagtaatttgtagccaacatttgggtagctttttcaagtagatagcactcaaagaggcccttcctgcattttgtctgtggtatatttagactgcttcatattgttttaagtgattcattctttttctacttacagcaaattcaacacccaacagcttccttaatagcaaaggtagcaacagcccaggatgatataactggtgatggtacgacttctaatgtcctaatcattggagagctgctgaaacaggcggatctctacatttctgaagtatgcacaactcttgtttctgtaatttttttttgtatataggaagtgtctgatatttatacaaattgatgtgctgttaatagtagctgaggtcatacagtagaattagggggcttaaatctgggtctttatcctggtctaaaacaaattgtgaccttggacaggttatagaacctttcttggcctgaaaataattttgtaatcaagttgcattgcctatgtgatttgcatctgtctttagtgtagattaataattgagatctaaaaatggaatgtttaggactaggcatatttgttaggaaaaaggcaaccaaaagcttatatttggataaattccacttttttagccctgactagttccaaggttaaagcaaacctcagtgaatatgaatgtattgtcagaatttcctggagaaagagaacagtctttatttttattagtaaatgatgtgagttagtttgagattacctatagaaaggatagaatagtccaggcgcagtggctcacgcccataatcccagcactttgagaggccgaggtgggcggatcacctgaggttgggagttcgagaccagtctgaccaacatggagaaaccccgtgtctactaaaaatacaaaaattagccaggcgtggtggtgcatgcctgtaatcccagctacttgggaagctgaggcaggagaattgcttgaacccaggaggtggaggttgtggtgagtcgagattgtgccattgtactccagcctgggtaacaagtgcgaaactccatctcaaaaaaaatgaaagaaaataaagataggataatgctaccatctgtgagttgttgggacacagtgttggttttgaaatgattcagagtggtttgcacagtgaacacccaagtgtgctttatagttcccttggctttgaccctgtgctagagcattcattacctgttcatctgctctgcattgaaaggaatatttgtccttttaaatgtattcagaaagccagcacattatattacctcgtgttcaaaggtatgatgatccagaacactccttcaataattacctgaactttatcatgaactatggttgcacctaattgaagatgcaagtgttaatgtgtgtttattttagggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggtatgtattaaattttgtctatgtctggtatagtatacctatatagaaaatctctgatagtagaaacatgaatatgattaccaatttcaattacaaggtgctgtgtaggttcatttttgtggcaatgatacctaatctgtgtctctaaaaatgaggaaattaaaataatagtatacctaaccaggttataaaagtaaaattgaagctttcattaaaaggtttataaagtggagatttttttattagaaagcttccagttaccagtatttttaataaaacgaggaatgttaatgttaattaatgttaatgtttgggaattatagatggagatttcagaaatgtaaatgacttcagctgttgccttttacatataatgtattctatttgctgatagaaaaagacttaaatcagtgtagaattgtaaaatgaaactgcctactttagccttctgaaaagcaacatgtttctgctgcaaattgaatttacttaacggttatgctcctccaattgcaggctgtagtggactccattttggccattaaaaagcaagatgaacctattgatctcttcatgattgagatcatggagatgaaacataaatctgaaactgatacaaggtaggtggtagaagactgtgaaatactaatgggcatggaggctcacacctgtaatcccagcactttgggaggctgtggtgggcaaatcacctcaggtcaggagttccagaccagcctggccaacatggggaaaccccgtctctattaaaattacaaaaattaaccaggcgtgccgggcatgactgtaatcccagctactcgggaggctgaggcagcagaatagcttgaacctgggaggcggaggttgcagtgagctgagaccacaccattgcactccagcctgggtgacaagagcgaaaccccgtcccattaaaaaaaaaacaaaaacaaaaaataaactgtgtttagaaatttaggggtgctttgtacaatatagatagttggctttttttttttttgagatggagtcttgctctgtcgcccagcctggagtgtacagtggcatgatctcggctcactgcaagctctgcctcccgggttcacaccattctcctgcctcagcctcccgagtagctgggactacaggcgcccgccaccatgcccggataatttttgtatttttagtagagacggggtttcaccatgttaaccaggatgatctcgatctcctgacctcgtgatccgcccacctcggcctcccaaagtgctgggattacaggcgtgagatggcaattttaaaaatatctttggatataaaatgttatatatttacctgaagatataagttggataaactgctaggagaatattgtttttagtaatattttctcctgaaataaggtgaatgttatgtttatggttagaatgattctgaaaagtgaacaacatcagtcatttggcatttattgaattgctaggtacaaagcataatgagaagtagtagaggaatttaaaaaaatatttttttcaaagagttagttagaaaacatgtttgttttccctttggggtgtgtgtgtgtgtgtgtctgtgtggagaatggagtctccctatgttgcccaggctggttttaaattcctgggattaaggtgtcctctcacttctgcctccgtaagtgctgggattacaggtgcttggtagaaaacatgtttttaaaggacgtcatcacagtttgacagcctaccagtgagaccatctctgcagacttttctgtacagcgtaggatcttcaggtaatttaagaaataggccgggcgcagtggctcatgcctgtaatcccagcactttgggaggccaaggcgggcggatcacgagatcaggagatcgaaaccatcctggctaacacggtgaaaccccgtctctactaaaaatacaaaagaattagctgggcatggttgtgggtgcctgtagtcccagctgcttgagaggctgaggtaggagaatggtgtgaacccaggaggtggagcttgcggtgagccaagatggcaccactacactccatcctgggcaacagagcgagacttcatctcaaaaaagaaaaatgtgactgcgtgaaatatcaataccttctcatttcagtgtttaatatattaaatacccatctgaaaatcaataaccataattttgtgtgtgtttaaacagcttaatcagagggcttgttttggaccacggagcacggcatcctgatatgaagaaaagggtggaggatgcatacatcctcacttgtaacgtgtcattagagtatgagaaaacgtaagtttatagccccttaacagtgaaatggagaagcttcgtattttaggcgagttacttttttgtgaaactttgtttcccactgtaaggacaataatgctcaaattggtttgggggagctataggaaacagtctctgaagatgcataaggggcaggattggagctcagtgaactgttaaatcttaggactaatccagtttcagaagctgctttcttaatgtttccctgctttctgtaacttttttttttcttaatagagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaaggtgagaatgaaaactcaatgtataaactaaatagtacgtatcatcctttttacttttaaggtgaaagatgttgaaattaatttttatttttgttacagggaattgaccccttttccttagatgctctttcaaaagaaggcatagttgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatacttttttccaaagagctccccacaataaaaagctttttttaaaaattttttattattattttttgagacagtcttgctctttcgtgcagtggcatgatcttggttcattgcgactaccacttcctgggttcataggattctcagcctcccgagtagttgggattacgggtgtctgccaccatgcccactgaattgctttgtgtttttttagtagagatggggttttgccatgttagctaggctggtctcaaactcctggcctcaagtgatccacccacctcaacctcccaaagtgttgggattacaggtgtgagccaccatgcctggctaataaagagctcttgtccaccttttagatttcatttgctaacttggggagagtggtttaaatggagggttaagagaaaagactagtttttagctggttgatggcaaatggaaaggcttaaagtacattttaaaatttaattttgtgtgtaattctgaaaaattccttcctaaaaattactggtcttatctttgaaattcactggtaacgttgcttatccatctcccttaaaatgctatttcaggctgactcttgcttgtggtggggtagccctgaattcttttgacgacctaagtcctgactgcttgggacatgcaggacttgtatatgagtatacattggtaagtgtatttttttcttaaaggtaatagaaccttttagctcgtgaattatttttgtttgtttgtttgaggtggggtctcactcctgcccgggctggagtgcagtggtgtgatcacagttcactacagcctcatcttcctgggttcaagtgatcctcccgcctcaggcttctgagcaggtgggaccacagacgtgtgtgctaccatgactggctaatttttttttttcttggtaatttttgtagaaacaggttcataattgtgttgcccaggctggtcttaaactcccgggctcaggctgtccttcaccctcagcctcccaaagtgctgagattacaggcatgagccaccgtgcctggttcatgaagtctttagcagaaaaattaattgaaattcaggatcagatttttgtttatatacattttgaaggtttatgtgtagtaatgggaagccattgatggggaaaatcacatttcttttatgtgatttttcaaaaggagataatttgctttaatgtgatcaagtttgttccttattaatatgctacttgtcattctctgtaagtccctcttctctcttcactctgcacaaatcctgtttttgaaaatcatattttttctacacatagggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggtaagatcctcactgtatttcaattcttttatattgttttgctggtctgaaaggcatggccgaatactgtgtttttatcagtagtttacacagccagacaccatgcaaaagcagtcttccctttagaatgactgatggtatgctaaggtttttcatagcatatcattattaaaggtgaatacaaataaatgaactaatactgatctgttgaaagctgccagtggctagtgaagccattctggttgaaccattctcctatttggtatgttagtcacttgtattttgtcatagtaaatttgtaagaaattaatggctttcatatgtatattttgttattcataattagttctgcagttttcttagcatttttccttttcccccatccaacaggctgtgtggttccaggtgctggtgccgtggaagtggcaatggcagaagccctgattaaacataagcccagtgtaaagggcagggcacagcttggagtccaagcatttgctgatgcattgctcattattcccaaggtgtgcatgcttttaacagtcaatcttccaaaagattcagctgatcaaacctttctgataatgtaggatttattcataaagtggattttggataagcaagtttgatcagttttctttctgactctagaacaggtattcctcatcatccagatatatttggtttctctgggaagcctgaatagctgacattgcagatggcaagagataacctgtagtttaatatttgcagtattaggggttatacttgagtacaaacttgctttttgcttttgttttaaactgatatcattgttttctattatataccagttttgatatataatttatgactggtgtattgctgctgggtttggggtagttgagagagttgatcagtaacttgtgtctggtattctctgaagggaacataaatgttctgtctttatgcaatgagtttttttttttttttttttttgagacagttttgttcttgtttcccaggctggagtgtaatggtgcgatctcagctcactgcagcctcagcctctcgagtagctgggattacaggcacctgccaccacacccggccaggtttttttttatttttagtagagatggggtttcaccatgttggccaggctggtctcgaactcctgacctcaggtgatccaccttccacggcctcccaaagtcctgggattacaggcgtgagccactgcaccaggccgagattttctttttcttttttcttttttttttttttttttttttttttactatcagttattagttcctgttttctcaagaattaaatttgtttactttaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaatttggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctggtaagtttgggaaaatgaaaactaaactgttagagaatcatacttttttcatttggtgttctctgtttagttgctcctttcccccatgaataatgtgatcagctggaagtatggaaactgaactagccctctgatgtgtagaggggaagggggaaatttaattggatgtaatgtgtgcagcttggttggaagtgggaagttgagtcgaattagggctcctaatcatctgagccatcttatttttgtccccctttcagcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 35835 - DNA, 20871 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtgagtgacgctacgcgacgcgggcggcttcgggccccgcaggcggcagctcgcgctgggaccgccatactgcccagttgccgccggccgccactcggacgcaggccggggctgcgcggggatcccgaggcctgggggtgggcggtggcccttgggtcgcgggctgcagacgggccgggcgggtcccgcggccatcgggcggacgcggaaggggcaagggcggggcggcgagacgcttcccggaggaagtgagctgcccgcccgcagcccgctcctcgccccttccctttctagtccccgacgtccctgagaggaatggggacgacagccctggttcgggagcgcccgctctcggcccggtgctgcgctgggccccagaagttgcgaaagaaaggacctcggccctgtcctgagcccctgtgggccgaagagctccttgcctagctaggggcatctgcactggaaagatcacttaaccgtgggccttcgctctcttaagcgaaagcacgttgcaaacccctgcttccagtggtaagactcagagaatgctaatggttaagaatcacaaggactccctcttccacctccattctgctcattgctcaccgtcggaggaagccccgggtttcttccaggagctggggacccccctcgaatgttcctgctgaggctgctgtgccaatagatcacagtggttaagatctagagccaaggtacacaggacctgatctaaaaacaagctgtcctgcagccagctgtgttgactctctaaacctcactttactcatttgtaaaataggagtaatattcccctcagagagttatgagggttaaaggaggaaaagcatggaaagagtctagcgccacggcatggtccttacttatctaccagatactaaactccgtgaggacggtgatgagatctgttgtagccctggtcattgacacatgacagatgtaaagtgactgttcaaacagcccatcagactgttgtataccaaggcacatgctaggtgctatctaggatacagagaagagagtaagaagacccaggaacctgtgatctattcgaggaggcgggactttatacctgaaaaaccaaagtgatactttccaagtaatggagccaataatgacttcagagtcagagtggttaagaaagatctgcatggggagaaataaagcctttgatgaagattttaaaagatgagtaccttcctgggccgggcgcggtggctcatgcctgtaatcccagcactttgggaggccgaggtggacggatcacttgaggtcaggagttcgagaccagcttgaccaacatggtgaaaccccgtctctactaaaaaatacaaaattagccgggcgtggtggcacatgcctgtaatcccagctgcttgggagactgaggcaagagaattgcttggacccaggaagcggaggttacagtgagccgagatcgcgccattgcactccagcccgggcaacaggagcgaaactccgtctctcaaaagagggggaaaaagaaagagtaccttcctaaaagaggaggcatttcttcaacacacctttccactcacaccacccactccctgcatcccagtgttcctgactctgtttctgtaaattaatctatttttccatattggaaaaagggcattctgtaactgtttgtaactatgaaaacagttccttccacaatgaaaagatcaggaaagtactgagtacattcaagcagatgtgtgccttagaacaagtttcaaaaaaggacagtagagcttacctatcgtgggatcagatacttcagggatacaaagtaggtcctattaaagcttaacatttgtccctttagtaggtgggacagtcttggaaattatagagaaattagaagaaatgcaattaaaactttcgttcattgcttcaggaagaatttctttttctgttttagttctaatgtaagagattgttaacagtgagagtcccggagtaacatctttatacttaagaaaatgtatttggaatcgtaatgtactcatgctcatgcctttacatgttccaggtctacaggtccaactgctgccactggcagtaatcgaagacttcagcagacacaaaatcaagtagatgaggtattgctctgaaatgttggaaatatgaattttaaacaaatatgagtactctggaaatctgtttagaaaaagtatcatcaaagtgtgaatgtaaagcaaattctgactgtatcataattgtaacgaaactttgctccctgctgtgctggaagatctaatctaagcaaaagtcagactttctaggtttcacgcttgttttcctgtgatagaaacctgctcataacatttagctcaggagaaataaaaaatcatatgcctaaaacatgaacatcactccctgagtgcattccccaagaagcactttataaaatcggataatacaatgttaaggattaggtctttagattgctcaagccaagaccagttcttctgatcagatttttttatcaaaatgctttgtcttcttactaattgtccagcctgagcaagcctctctgtagaattcatctctaatggttgtccattgacacacacaaagtagatactgtcaaactccattagctcagcaaatctctgtttgtagaattcttgagctagaggacctccatcttttgttctgcgccgtatgtggagaaccacagcagaagattgagaaattcagactagtgtttccacattcctaaaagccgtcactgtccgacaaatatatttcggtctttctgcatttagctgccctgaaaaaacagttaaagttatgtcagatactgttgttaaataatatagtaatgttttgatctgatggttttgttcatgaacttatacaattttagattttcacagtaagaaacccattgtaattctgtcctgcctggaaattctgtttacttacaaaatcaaattggatttttttttttagccaaaggaattttaaggagagttgtttttttattgaggcaaaattaccataacatacaactaaacattttaaactgtatataattgagtgttatttagtatattgataatattttgcaaccattacctctttccattttcagaactttttcatcaccccagaacacctcatgcccatttagtaatcattcactatttccccttcctcccattctctggttacctctaatcagctctctctttctgtggatttgcctgttctgggtatgtcatataaaaggaatcatacaatgtgtggccttttgcatctgccttctttcacttagcacaaagttttttgcattcattcaagttgtaacgtgttgtaccgtgttcctttttacggttgagtaatattccattgtatgtgtatacacaatttgttgagccatccatttgttaatgagtcttcgagttgtttccacctttcagcaattatgaataatgctgttataaatattcacaggaaagattttgtttagacataggctttcatttctcttgaatgtatacctaggagtagcattgctaggtcatagtagctgtatgtttaattttacgaggaactgccaaattgttttccacaatagctgcaccattttattttcccaccagcaatgtccaagagttcctgtttctccacatccttgccaacacttgttttccattttgattataaccatcctactgagctctttgggttttcatttgcgtttctctaatgattagtgatgttaagcatcttttcatgtgcttattggccatttgtatgtctttgaagaaatgtctgttcaggctttgcccattttttaattgggttgtttgagttgtgagagttttttatgtattctggatattaaatctttctttatcagacatgtgatttgcaaatactttctcccattctgtggcttgtcttttacattttttttattttttttatttttatttattttttttgagacggagttttgctctgttgccgaggctggagtgcagtggtgcaatctcagctcactgcagcctccaagccccaggttcaagtgattctcctgcctcagcccccagagtagctgggattacaggcgcccgccaccttgcccggctaattttttgtatttttagtagagacagtggttcaccattttggtcaggctggtctcaaactcctgatctcaggtgatccacctgcctgggcctcccaaagtgctgggaatataggcatgagccaccgcacctggcctgataatgttctttgatgcacaaaagtttttaatttttatgaagtccaatgtatctgtttttccttttgttgttcttgattttggtatataagaatccacagtcaaatccaaagtaatgaagatttacccttatgttttcttctaagagttttatggctttagctcttacacttagattattgatccattttgagttactttttgtatatagggtgaggtggggattcaacttcattcttttgcatgttggctcttcaattggcccagcactgtttattgaaaagactgttggatggccttcgcactcttgtcaaaaatcaattggccatagatgcttaggttgacttctagactctcagttctattccatcagtctatatgtttgtccttatgccagtatcacactgttttgattactgtagctttgtagtaagttttgaaattgggaagtgactttggggagtactgccctcttagcaatattaagtcttccagtgtgtgaacataggatgttttcccatttaatgatgtctcttaacaatttctcttagcaatgttttctagtttcattgtccaagtcgttcaccttttggttaaatttattcctaggtattttattctgttagatgctattgtaaacacaattgtttccttaatttccttttcagattatttgttgctggtgtatagaaacacaactgatttctatgtgttgttgttgtaccctgcaactttgctgaatttgttagctctagcagtttgttgtggattctttggtattttttatatagagagaatcatctgcaaatacagataggtttattcttcttttccaatttggatgccttttctttctcttgactaattgctctgttcagaacttccagtacagtattgagtggcagtgtgaaagtgagcatccttgcctcgttcctgatcttaggggggaagtctttcaccatggagcatgatattagttgtggattttcccataaatgccctttatcatattaaggaaattcccttctatccttaatatgctgattgttttgatcatgaaagagtgagcccattttttctaaagtgaaagtttggctcaaagtaataaagtgctgacctgaaagaacaatgtgcctgtagattgtctttgaagtctctgtgcctccattttttttgagacggagtctcactctgtcacccaggttgaagtgcaatgacgcagtctcacctcattgcaacctcctcctcctgggttcaagcgagtctcctgcctcagcctcctgagtagttgggattacaagcgcccagcacccctcccggctgattttcttatgtttttagtactgagacagggtttccccatgttggccaggttggtctcgaactcctgaccacaggtgatccacccacctcggcctcccaaagtgctaggattacaggcgtgagccaccgcacctggccctgttcctccattctttgtgcattacttgctgtgatcacactcatctaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaaggtaattatcttttaactgacctttacatttaaccccccttctccattctcagagaattaacaggctacagataatggactttcacgactctgggaggtgggtttgacttcctccacatggaaatgtgggtccactgtgaatccgaaacactgactgcataccctttcctagccccacactaggaatcctctatgtgctgtggctgatcttcagaagatgcaggtagaacaggaatatccaaaatcactcacagtcatcagcccctcccaaccctctaccccagcagggccccaaacagataggagagggctggaattggtcagttttctcgtagttctgtgaatggttccaaggtcaagggaaagaaatgctagaaagccacagtgtgcccaacagaagagtagaaagcagctctcccaggagcacgagccaaagcagattttatacagttagcgtgctgcaatcagatccagatgtatcctgtcctctgccttgtttacaagtgacactttgagacacagggcaagctgagcagcctttccatatgtggaaaacttgtatacacaaacaaatgcctagctagaggccacacatcatttgaacatcttttaaaagcagataagttaccttcaggccctaattgagaacatttaatttaggctttagaaattattaattactccagactgtatgcacctgaatttccctttcagtgactagatgaatattatataatactcttcaacaagcacattatgtctgcatttgaaatgtgatatggacatatgttttgttacagatgtgggcaatcgggattactgttctggttatcttcatcatcatcatcatcggtgagttacccttttctaaactgattggaaaagtcttctccatgtgttcacagaccattgattttgtgtacaagaactcagattaaaatttccctccgaaatgttagttttggctaggtgcggtgactcatgcctgtaatcccaaagctttgggaggccaggagtttgagaccagcctgggcaacatagcgtctctacaaacaattgttaataattaaccaggcatggtagtgcacacctgtaagtcccagctactcaggaggctgagacaggaggattgcttgagcccaggaattcaaggctgcagtgagccatgatcatgccactgccctctagtctgggtgacagagtgagaccttttctcaaaaaaaaaaaagaaaggttcatttattccaaggttttcagttttctttaataaatgttttaagtacttgagttttgtataagtctgagatttgatacaaacattaatcctttgaagttagagaaaatctattcatttccacttcttttctctgaatatatttttttcacatatttccttttatgtaatgtagtggttaaaagcatggagtgcctgtgatccatcctggctccaccaccatccagctgtatggccgtggacaagcaatttaatatctctgggtttctgtttcctcatttgtaaaatggggataataatagtccctgtcttgtttgtttgtttgtttgttaaaggacagatctggtaaatatataaaaattggccgggcttggtggcgcacgcctgtaatcccagcactttgggaggctgaggcgggcagatcacgaggtcaggagatcaagaccatcctggctaacacggtgaaaccccgtctctactaaaaatacaaaaaattagccgggtgtggtcgcgggcgcctgtagtcccagctactggggaggctgaggcaggagaatggcatgaacccgggaggcggagcttgcagtgagccaagatcatgccactgcactccagcctaggtgacagagcaagtctccgtctcaaaaaaataaataaataaaataaataaaaattgcttaggttggtgcctggcatataataataaaaataatagctatataaataatatatatgtatacacaaacacacacacaactattattatataatattcaaacaactcactgccatcggtagcccagtatatgagaaccgaaacatgacttctttcattgatagatggatgttagtggatgtttccttttagcaggaaggtacagttacttggatccttttgactctagtctccttcctctagccctctatagaatggagagaagccagtagtaggaaatcagcccagtctaatttctgatcacatttagactgcagcattggatgttggcttgggattcacactgagagactaacctgctgtttcccctgcctttttgcatctctcctccttcttagtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgattgtggcacctgtgctccttgtagaggaatagctgcacctggtccgagtcctaaaaatgccattccttgctgctccccatacctgtcccttagaagccccgaaactgtctcccccttttctcaccagcccctctctaggtactctacccttttggtacccagcatttccgcataccccagtgaacagaagaaaaccgctccccttgtgaaaagtgctttttagtataggcgatgaggaggaaactggcttttacacaattaccaaaattcaggatgtggctttggagttccctaaatagatggtctttctaaagtgatgtgcagagccgaccccgtctgtggtagactagatggctgctggcatggaccctgggatagatgagtggataggtgagggacatccccagacacatggctctgttcctgtagatccttttttcctcatgaatgtatttccattcttatcgtagaacccctaggaaacaatataatacgggtggaagaggacttttgcttatgtttacaataggaaaatccaagtccctttcccgaattacaggtcccacgatgatctggtcctttctagttttctgacttcatgtcacacgactctccagctctctcttctccaagcaaggtactccaccaaagtatagctgttgacatcggagagacttgtgcccatgagactttcaacatcagggtgtggcttgaaggccagagttagctatgaatgaaaacaggcaaggaagccctgagggagaaatggacctgataaagtttgtttcggtttctcatcagcaaactgacttctttccaaaggtcttctgcaggtactttcagctctgccgggtctacttcctcacccgcggcaggcgcctctcatctcaggttgaaatccgccttccccactcgcggcaggcgcctctcatctcaggttgaaatccgccttcccagaggcctgccctgctgatctgactaagcaggctctggcctccccactccacctttctcccagttactcttccttccagtagtttgttttctacacatcgctttaggctttatgaacttgtttatggggttgtttgtatggctttctcaataaaacgtcaactccctgggtggcagggactttgggccactgttctatccgctgggattccaagcgtccctacccagatctgcacgcaataaatgcttgctgaacgaatgcagtttgacaaaacccagcttcggaggagagcaagccaacctagagtatcgcttggaagatataaggtggtttattcaatacctaacatgaacactcacctcacttttcccctcttcctttacatacaatttcatccatccaacaaatactgaatattttttctgtaccaggcagcgaagaggggcggcactctgcactgtacctttcatttctaacatgttgagatactaaactgagctttcagacattttttttaaagggctctacaacttcttttctgaaacagagtgtcttttacgtttgtcttcctccagttgccaaatgaatctaattttaggaagtgcagggaagtgttttaagttccaccgtcaaaattctgtttctgggccggtgcagtggctcacgccagtaatcccaacattttgggagaccgaggccagcagatcactggggcttaggagtttgagaacagcctggctaacacagaccatctttaccaaaaacacaaaaattagccaggtgtggtggctgcacctgtagttccagctactcgggaggctgaagcaggaaactggcttgagcccagaagacggaggttgcagtgagccaaaatcgcgccactgcactccatccagcctggacaacagagcaaaaccctgtctcaaaaaataaaaaatctgtttctaaaaatcgggtgggctttttaccagggctgctttatggcccggttcctccaagtccaccccactcaccgaaagagttagcggaggatgggggcggttggggtgggctcggtaggtcacgggcggtgaaaaccgtgggaacccagaaagacggccaaagcacgatgaggaccgctgccggcagcccgccccaccctgggctcctccccacacccgctcgggcagccgggagccacctacaaactccaggactcgaccccagagcgctggcctgagccgcccctgctcgcccccagtccccgcctctccctccctctaatgcccccgccctcgacaccgtcgcccccccgcccctgcctctcgctccccacgtctctcggcacccccgctcccatccgcccccccgtccccgcctctcgcccccatccgtccccatttccagcctccccctgaccccgactcaagccccccgactccgcctctcgcccctctctgcccccgcctctcactcccctctccttccccgcccgcctctcacgtggaggttgggccggacccgccccgccccacagagcccgggtcccgcccccacgtggctggcagcttcctggccctatcatttctgcgctggcttcagcggctccgccccggcgccgtgccagggggccggacactccagtcgcgcggcacaggcctgaggccgctgagggccaccccgtcccctgcccgcccgccggcctgctgggattggccgagcgccggcctccgcccgagcccgcgcgttatgtaacgcgccccgggggccccgccccctcgccctggcttatataacccgggcgcaccggctcgcgccccgccccagggccaatggaggcctgcggagtcggccccgacgaccaatcgcacggcccgggggcgggaccggtcacgcggcggcagggggcgcggcgccggctgctgaccggcacgcggcgagcctcgagactgcgcgagggcggccccgggggcgagcggctgtgcgcggggccaagggcgggggcagcaggtgagtgcgcggccgggcgggagttctgggcggccgggcgggagttctgggcactcgcgcgcggcagaggagccccgcgagccctgccctcggtactgggggcccccggagcgtggcgcttccgagccacccgcctccccgggccccatccctcggcgcgcgggaaagttggggcaggggtgaggaccgcgcggtcggggcgccccagccagccgggccgctggcgtcggactgtctgttccatttgtcccttgtcacccttgtctcctccccctaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacaggtgacgcgctggcttcaggccgagggccccatgcgttcgttgtccttccctggagcagggaaagggggacctaaatctttttattcttttgttttcaagcccaggggaaagtgtaaaggggagactcgggcaatgtaggatgaagtgatccgtgacactgaagaaaattaccgaagagtatcaggagggaaaagtggttacaaaagttagctgagttggggctcaagtggattaagggaaagtaagtggagaatgtttgtcattcaccagttgctttgcctcgagttccccacctagaggaagaggggtcaccaccctgtggactgatgccggtagagcacttagaaacttacctggcttgcagtttgtgttccctaagccgcaagatgctgttgtcttcagaggatgaagttgtaatttttttttatcttccagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaaggtaaacaagccggagagaaatttcatcctacgaatgcaccaggactcatacaagcagccagaggagtggtcagtggggtctcagtcagacaaataatttgagctttttctggtgctttgtggaagatgagcaaatctacaccgattccattcgtgtcttaattgttcacatgtgaaagaccaggaaaactttatctgtataatagtgtataatacctatgcaatgttttgctcatgtgttgcaagagagtagagtttagcataagcacattttgaaggctgaccttttaaagaaatattgtcttctatggaagttatgggaaaaaaatgcattccacgaaatagttacctttacatgccgtacacatactttcaaaatgcagtaatgaggctgggcgcggtgcctcacgcctgtaatcccagcactttgggaggccgaggcgggcagatcacgaggtcaggagatcgagaccatcctggctaatacggtgaaaccccgtctctactaaaaatacaaaaaattagccgggtgtggtggcgggcgcctgtagtccagctattcgggaggctgagacaggagaacggcgtgaacccgggaggcggagcttgcagtgagccgagatcacgccactgcactcccgcctgggtgacagagcgagactctgtctctaaaaaataataatgataaaaatgcagtaatgatatatcaggaatttaccaaactaaaaatgaaccattgtaaacactttttctctctgacatttccagggatttcattaaagccatattctctttagcacaaacctcagtgcttcatatatgatatgttcctgaatgacagagtactgtttctgctccccccgcaaaaaaattgtgtatgcatctgaaatttttagttagtaccttaaatgtatcttgcttcctgtgatccagaacatgcagaattcataaaatcaaatcttaagtttgcacaactatcagtattttaggtaaaagcagaaaatgatctgtttttgagaaaaatgcactgaggtgttctcatccgaaaaaaataatccagcttgatagtgatgaaatggtttcctaaagatactgttgtcactggactacctgtttatctccctgtgtttcttagcaaacagtgagtttttccagattctcagtcagaatggagcacctcaggcagatgtgagcatgtacagtcttgaggagctggccactatcgcttcagaacacacttccaaaaacacagtaagaattcatgcattttgccatatcaacctgggtgacttttcctaagggcctgctctagatgtaggcttttaagaaggataacaacgtttcagcaaccacaatttgagagaagcaaaggaggaactgctaaagaggcatggtgtagcttctccgcccttgccagagaaaacatctaaaagcagaagcagcccgttctgtgtgctgtgcagctcagtgactttggttatgaggtgcttctagctccttagcattcccaagctctcttgaattaagagaaaacaaaaattacactgcagagtaatttcctgcaccttattctaatctccgaattgttaatttctatttatatcattcttagttccaatacctactacttcaagttgtaacaactggatgttatagaacaggtgagttgagatgctgtcatttttcctaaaattttggaagagacctttagtatatcttttttaatctctcttcttgtttgacagagtaatcttcatgtttggttgatacggtggagattacttattttaagtaacataattgttacttaaagattttgtaatagtggaacgtgcgcaatccctagtattataacagtgcttattttatggactggtgtgtacatagtactgtaggaggtgctatggagatttttaaaaatagcttaagaaaatatttgtcttttaagatatttaaaataaagctagagaggaaagtatgccaatgctagcaaacacaaactgctgattataaataagtttcatttatgtgtaatggaaaaaattagagcagtgatgcttatgtaatgaggtttgtcaaggacagcttcttgaagaaggtgaatcttcagtgtgtcttaaagcatagaatctgcgttgatgacgagaacaccgtccacccaggtgtatggcacagtttgcagagaagttatgtgccatacgtattttagtctgcatagaataagctagtatattttttggcatagaaattgaaccttcagtaggtgaagtgcaggtcttaggagaagatttaagaagcatgttggagaaaattatttgaggagttttgttgcatttgtaggttgtgcctgtgtattttaagatactggtcatgttagagatccagaagaaatttacctttcagggaatattgctagtgagtatctcaatatttgcatttattttaaatgtttttcataggatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagaggtaacaggaccaatgttcagatgtctatctttcctcatcaagatcagtttcattcttacaggaatagtacagaaattaacatattatttagaacatgcacactatctggtttttcttattcctgttatagaaagtcacgtgatgaaaacagcattttaaaagcttctgataacatactcaatacgtttgtttccattttgtcacatctgtttcacagatgatatgtcataaatattatttcattaccagcgtattgtatagtggtttagttgctatgaaggctctgtttcctttaagttaaaattaaatgtttttcctccttcatgatttccttgtatgagaaattttactttggagataaaatttggatcattaggctgggcaaggtggctcacgcctgtaatcccagcactttgggaggttgaggcaggtggatcacctgaggtcaggagttccagaccagcctggccaacatggtaaaaccccatctgtactaaaagtacaaaaattagtcaggcatggtagtgcatgcctgtaatcccagctactcaggaggttgaggcacgagaagcacttgaacccgggagacagaggttgcagtgagccaagatcacaccattgcactccagcctgggcgacaagcgtgaaactgtttctggggaaaaaaaaaaaaaaaaattcagatcattagctctcttacagtttttcttgcccctgaaacttatgagtcttattactttgttttccttctggaatgcttttctttcataattcaaagatgcctattgcagttttctttgtgacattcagtcctgtgtgatcttaatttatttctttttagtcatccttcattattttatattctttgtgaagtgtctcttaaagagctttaaaatatatatatatatatatcagcgttctctttgattccaagcccttctctctaattaaaaaaaaaattcattgtagtaaaaaacacatacagtttactatctgatatagtttggctgtgtccccacccaaatctcatgttgaattgtaactcccacaattcccatgtgtcgtgggaggaacccagtgggagataattgcatcatgagggcgtctttcccatgctgttctcgtgatagtggataagtctcatgagatctgattgctttaaaaatgggagtttctctgcacaagctctctctctttgcctgctgccgtccatgtaagatgtaacttgcccctccttgccttctgccgtgattgtgaggcttcctcagccacgtggaactgtaagtccgttaaacctctttcttttgtaaattgcccaatcttgggtctgtctttatcagcagcatgcaaacggacctaatacaccatcttaatcatttttaggcattcactccattgctgtgaaggatgtttacattgttgtgaaacagatctccataactttttcatctttatatctgaaattctatctactatttctaattttttacccagtagttaatttaatgaagggtagctttgcgtgtttcttcttccaattatagattgccccatcttttaaaaatatttttacataagctctagaaaacatgcatgtcatccctgcttgcttctagctcatctcttttcccatctttcaaaaatactgattttatttctcatcccctttcctaaatacacattttcaacctttgtctgtatttgtttctctgcttttgttagctgttcattccgtaaacatttatttaataatcacgtgggtcaagaactagtccggatacagatacagctgtgaacaggacatacacaatattgtctgccaggtctttcccattttttccccaggtatttttccttcagcactgcctgtggcttttcagccttttcatttttgctgattactgattactgcgatatttcccttctgtattagtccattcttacgctgctataaagaactatctgagactgggtaattaataaaggaaagaagtttaattgactcacagttccacatgactggggaggcctcaggaaacttacaatcatggcagaaggggaagcaaacatgtctttctacacatgatggcaggaaggagaagaatgggagccgagtgaaggaggaagccctttataaagccatcagatctcttgagaacttactatcatgagaacagcatgggggaaactgcccccatgattcaattacctccctccgggttcctcccaccacacatggggattatgggaactataattcaagatgagatttgggtggggatacagccaaaccatatcattctgctcttaagccctcccaaatctcacgtcctcacatttcaaaatgcaatcatgcttttccaacagtcccccaaagtcttagctcattccagcattagaccaaaagtccaagtccaaagtctcatatgtgacaaagcaagtccctttcacctatgagcctgtaaaatccaaagcaagttagttatctcctaggtacaatagacgtacaagcattgggtaaatacacccatttcaaatgggagaaattggccaaaacaaaggggctacaggccccttgcaagtctgaaatccactgaagcaataattaaatattaaagctccaaaataatctcctttgactccatgtctcacatccaggtcatgctggtgcaagaggtgggctcctacagccttgggcagctctgcccttgtggctttgcagggtacagcctcccttatggctggtttcatgggctggcattgagtgtctgtggcttttctgggctcacagtgcaagcttttggtggatctaccattcttaggtctggaggatggtggccctcttctcacagctccactaggcagtgccccagtgaagactgtgtgggctccgaacccaaatttcccttacacatctctcttagcagaggttctctatgagggctccgcccctgtagcaaacttctgcctggacatccaggcatttccgtacatcctctgaaatctaggcagaggtttccaaacctcagttcttgtcttctgcacacctgcaggaccaacaccatatggaagctgccaaggaatagggcttgcaccctctgaagctatggcctgagctgtaccttggtcccttttagccatggctggaggtgaagcagctggaatggagggcatcatgtcccaaggctgcacagagcagtgggggcctggacaggcccagaaaaccattttttctctcgtaggcctcagcctgtgatgggaggggttgctgtgaagtctctgacatgccctgaagacattttccccattgtcttggtgattaacatttggcttcttgttacttctgcaaatttctgtagcaggcttgaatttctccccagaaaatgggtttttcttttccattgcatcttcaggctacaaattttccaagttgttatgctctgcttcctctttaatgctttgctgtttagaaatttcttccgtcagatacctaaatcatctctctcaagttcaaagttccacagatctctaggccaggagcaaaagttgccagtctctttgcatagcagaagtgtcctttactccagtcccaacaagttcctcatctctctctgagaccacctcagcctgcacttcattgtccatatcactatcagcattttggtcaaagccattcaacaagtctctaggaagttccagactttcccacattttcttgtcttcttctaagccctccaaactgttccagtgtctgcctgttacccagttccaaagtcacttccacatttttgggtatctatggcagcaccccactctttgcagtacaagtttactgtattagtccattctcatgctgctaataaagacatacccaagactgggtaatttctaaa

SEQ ID NO: 35836 - DNA, 20871 bp, Homo sapiens; identical to SEQ ID NO: 35835

SEQ ID NO: 35837 - DNA, 11143 bp, Homo sapiens
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggaggtgaggggggcgaggctgccaaccctgggcctagggatggcgcgtggccccggggtagccactgcagtcgtggccagggccgcaggccccgctgtgcagcgcgttcagctttgacatccaggacttggggaaggagctgaggaagtagacaggaagttgtaggaccttcgttctgcgaccttgatatccatggcaggggctcgggatttactaagcagtcattgatcgtgagtctcggccagccaagtgcctcccgtaatctgcaaataagtgtgaggtttgagggggcccaccgctactagacacctgccaaacactggcccctggagctggtacagaagatgggttacatgtaccaggggtcgtgaaagcagcatgtgctcatttcttcgtaactccacactggagagagcagtgagcaaaacaggcaaacccaaggtttctgctgccatggacctttgttcctgggtcgagccgaccacaggataggtgggaatgacatgcagtgttgtggtcaggaaaggcctctctgtgtgagccgtgtaagaaggaaggatctagccatgcagacatttgtgctaggtagagagaacacaaagggagcctgtgacccttggggtgggaggcaggtgggtgtgtttgggtgcggagatcaccatatgaggtctgagaagtaggcccattaggagtttggattttattttgagggcaggagaatgtcagataccatgatatgacgtggcagcccatgtcacacacaagtgaggaaaacgagggtcatggaggtcaaggaatctgcccagcttcccagtttttggcagagctaggcttcacactgcctcagcttaaagcccttaatttcttaaaccactgggctgcagtccatacctttgccccttgcacctcctctaatttatgggccaccttctccaggtgtcctccggggcctcattccttaacctctccagcactggaaggccgaccgcttcttccttgagaccttctctggttcttttcctcttcctcgtctgcccttttcgttggatcctcttctgccctctgcatgttccaccccgcccagctccctcttgcggtcttacatagccaccggcatgactcataacatcctttatgctttgcccctctgcccttcctcttgcccgttctagcctctaaattctgggctctgtattaccagtagatccacgtaagagcttgcctttccttttagaccggtgtgctgtattttggatactggcgctaccagtttccttaatacaggttgaaaaacttggagtcatctttgttgtcccagatctctcatgcagattaatttgacaaatgtttattgagcctactccacgcctgccgctgtgcaaggttctgtggctccgcccctggtggtatgtagctcactgtgttcctgtttgcttgttttgctcctagtactctcatggaggcctcggtgcctccctcctggacgccttggtagtatgcttttcatagtttgatgcaccaaactggttatttggttatttggggtgtgtgtttggcttttactataggttcaaaatgagtcaccccctcccaactcctgggttacaaaaggtggttgcatttagggtgttgagctgttttctttgcttcgccctggcacctgtgagctttttcaggtgtgacacactttcctatagctgtgcttggcattatcctagcacagaccctgggcttgtctgggatgagacaggcctccctcgttcctctgccctaggcttgcttttttacatgttaaatcatgcggtggtggggatccatgcagacaagccatgctaacagccagggcgtctttaagagggggttgctgtgaaagcctgctgccgggttgggagcaggttaaaaatgctatgcctgcttattttaaatgctgttcatggaacaaaaatctgtgtagtgactttgtgagaagttgtgatgtttatgttgtgtaactttgtgcaggaacactgcgtcttgcagtgggtgcacagctctgagtagaaaccacctcttcataggaagcctgtggccttaacactaggcagtttaagcttttaaataataccagagttactaactagtgcagaagtgacatgctttttcttttttcctgctagagaccatttgtttgtgactatgaagggtgtggcaaggccttcatcagggactaccatctgagccgccacattctgactcacacaggagaaaagccgtttgtgtaagtagagacctgtttttaggcttttgaagtgggttgtgttgggcatatagacccagtaagaagattgatgttaactcacgagatcaggaatgtgaagcctggcagggctcggtggctcatgcctgtaatcccagcactttgggaggcggagatgggcagatcacttgaacccaggagtttgagacaaacctgggcaacatggtgaaaccccgtatgtacaaaaatacaaaaattagtcagggatggtggtttgtgcctgtaatcctagctacccaggaggctgagctaacataaaatgctcatgggtggggacaagctaaagtatatcaacacaatgggataccctacagccaggaaaatgaatgcagatgctctctgcaaagccatgagaaaatcaccagggcactttaattgaaaaaccaaggtgcagaagagtcctctttaggctacttttatgtgtgtaaaaaagctagggggtagggggaggggtgagtagtgggtgttgggtaggcaggaagcaactatatttgtatttgttcctatttgtaaagaagtcttaaaagttacataacaaaactaaaaatgtcatctgttttgggagcagtgggggatcctggccaagtagggggtggggatggtaggaaatgccatgcaaccaggaactactggacatgactcttccagctcatgatctaacccagaccctgcccctctttagctgtagttccccgtttcccactgctcgctggacagtgctacttggctatctctgtgtcttcttaaattccatgtggtaggctgggtgtggtggctcatgcctgtaatcccagcactttgagaggctgaggtgggaggattgctttgaggccaggagttcaggctgggcaagatggtcaggtccatctctattaaagaaataaataaataaaaaattccacatggcccaaatttgtcacagtcaaactgagctcacttttctgtttgatcttctctcatgttcttgtctggagaggtggcctcgctgtctgtccagtgacccatagcaaagataaggcagctccctggactctccattctttctcccatcccttgcaacaggtgggttgccagatcctgtaactgacccatcagatccagcagccactgtcttatctcggtcccttcctctggctggaatgacagtttgcaggccagccctctcccccagtgccctcccgtgtgcttcccttaaagctgtgcagtgctttcaagcacggcctacatgtgaaatccaggtttcaagtgtgtcctacaatgacctgcgtgatttagcccttttctgcttatcttgccccatttgcttgacttgcaggcatgaagctgtggtccagctgtgctaactaaccagccccctctccaagtgtgccggggtctctcacgcccacttgggtcttgtcaggactcttcctggcctgtcctcctatcccatacccggttgggttagatgcctgtgtcaggtttagagtgaagaatggcaggaaccccagcacaagagatgcttaaacaagatgggctctttgtcttgtgcgactgaaatacagaaatacagaggcaggagctctggagcctcttctgactggtctctgccatcctcatcttgggctttaacctcactgtgatgcctgtttgggcccatctgtcacataagcatgccactggcaggaaggaggaaagggcataagaggcatgcccccttatttagagactttgtgggggttgagcaggatgggctggactcagccatgagccgccctaattgcaggggaggccggagagtgcactttctgtcggccacctgcccagctaacactcagcattctgtccctgcagttaggggggcttctagggtctctgccacagcgcccctcccatttgtgggcctctgtgctgtgcctcccatggtcactgctggcttgtttgtctctgcttggccctaggaatgggacagtgcctgcctcagggttatcagtgagtgatggctaagattgagcctgggaaaggaagtcctgcttcatccctcaagcttacgaaggctcatcacaagaggcacaaattttcttttgggaaaaaaaaaaaaaaaaaaggaaaaggctttgcagaggatttagatcattcaaagccaagatgccaagataaggggaaccagaatggcttggtaagccagagaacataatggttatggttctgctctaagtatctgttttacctctaatgataagccaagacaagttttatggaggcctttctggaaatccagttcataatgacatctcaagcagcattaaggttgtcagattctaagctgagaataatttgtcttaagcatgatttaggcctagtgtaggcttttgggactagtgtatttcaccttcccatctgcccagtgtgtataaaagatgactgatgtagtgtgtataatttcagaagcctaatatgaaaaagcattttgttacatgatagtcatcaggttgagagtctatgtggtatggcttaacactctggaattcgctaagactattttatagtattactattctttggaagaattagcttctataaagtaggaagatatatgtgtcttaaaacttcttctcccttggtttattaatattttggtttatataacttcttacagttgtgcagccaatggctgtgatcaaaaattcaacacaaaatcaaacttgaagaaacattttgaacgcaaacatgaaaatcaacaaaaacaatatatagtaagtatgattttatatgcttaaattttttgagtatttttacacttactgcctatgtttctgacattttcagccaggtgcggtggctcaagcctataatcgtagcttgaggccaggaatttgagaccagcctgggaaacatagtgaaatgctgtctctgaaaaaaaaaaacaaaaacagaaaacaaaacaaaaaattttggggtaacagagaccctgtctctaaaaaataaaagtgaaaaataaagttttcgtcaaccaaattttgtctgccaaatgtctgaatttacttaatgccatcataatgataaaggttttaatttggaagcagacattgtgcaaattagtgtattgggagactattccaactgaaacagttttgctttttcaaatgttatatgattcttcaaacctttttgagataaagcagaattttacagtaacaaaatgggtgaaagcagaaattttatacagtctccaaaattgttttatcttgaggattctgttacgaactgttcattttgttttgactttccataagactaacgagcctttacaatttaacagtgcagttttgaagactgtaagaagacctttaagaaacatcagcagctgaaaatccatcagtgccagcataccaatgaacctctattcaagtaggtacttcatgtggctgaaaatgcctggattctaggtgtgaataagattggaaatgcaagggtggtgttgagcattgtttcatgttttttggccatttgtatatcttctgagaaatgtctgttcatatcctttgcccacttttcgatggattgtttttttcttgctgatctgagttccctgtagatcctggatatacattctttattggatgcataatgtgccagtattttctcccactctctgggttgtctgtttactctgctgattatttcttttgctgtgcagaagctttttagtttaattaggtcccatttatttatttctatttttgttgcatttgctttcagggccttagtaagaattctttgcctaggctgatgtccagaagtttttccaatgttttcattttgaatttttagtttcaggtcataaacttaatttgagttgatttttgtataaggtgagagatagggatccagtttttccagcaccatttattgaatagggagtcctttccccagtttacgtttttatatgctttgttgaagatcgggtggctgtaagtatttggctttatttctgttttgttccattggtctaagtgcctatttttaaaccagtgccaccctgttttggtaactgtagcctcgtagtataatctgaagtctggtcaaaggaaaagaagtcactatatgaaaaagacacatgcacacacgtttacagcagcacagttcacaattgcaaatacatggagccaatttaagtgcccatcgaccaatgagtagataaagaaaacgtgatgtatatacaccatggaatactacacagccataaaagggaacaaaatgatgtcttttgcagcagcttggatggagctggaggccattattctcagtgaagtaactcaggaatggaaaaccaaataccatagttttcactaagtgggcactaaactatgaggacaaaaagacacagtgatttcataaactttggggacttggggtggggagtttggggaggggggtgagggatgaaagactacatattgggtacagtgtatgctgcttgagtgatggtgcgctaaaatctcagcaccactataggattcatccacgtaacgaaaaaacacttgcaaccccaaaagccattgaaatttaaagcaacggtgggacaaatcttctgaaagcttcctaatcaacatttttctgttaaaatgtactgcatatgcacatttatatattgggagcattttaaaggtttactttgctctgaaagaaatatttaatgtgtttcaaaataatttttgagattattctagttgtggttaagcttaaaggctgagaaattacttaactattcaaatagagcctgtgcaactatatgaaatgtcattatggagacactcattatgcttttcctgtagaacaaaacaagtagttgggtttatctgcaattagggttttttgaggaacgtgagggtggctggacaagttgggtagacctgcaaaagggccagcggctctctgcatggctctggccatccggcactttcccttgacttgcacaggctgccctgtgccttggagttgctgcagtgaccttgcctgtccttgcttgtgggtctgctgctgctgctttgctgctgatggctttagcacagagggggcccgtgctttttattgctcaccagaggcagatgcatctactgctgtgctgtctcgcacaccccctatgcagcatcattaggaaagctagacacaagtgattcagaatggcttaggggtttatctaagccaagtcagataacctcttgaactatctttttgtagccatgaaagcagagtatatttccagaggtataaagatgaaaactgtttaaatgggtcaaaaaaagtaacgtgacttttttctccaacagtttgttttgtcctaaagctggtcaagtaacttgaatctcacctgtgatgagagctacattttaacatgggtttggttatgggaagaggcaagactttggtgggagaaacaggacaaagtgccattgaccttgagcggagttctctgtgaaaatggattggctaatacctcatgtgttgccaatgcaggtgtacccaggaaggatgtgggaaacactttgcatcacccagcaagctgaaacgacatgccaaggcccacgagggtgtgtacggatagcctgggtgtgctccgagggggatgccaaatcctgggcgcctttgaatctgttctgtgatcacgctgaaaagatgggaaccctgtgaacaggggacaccatcctgcttatttgggtcttacactcttgtccaaagaggcactgtatatgtctgtttttccactaccgtatcattgctgttcacatgtaatgtgttgtttgttcacaacaagcgcctggttacacattacactgacgaatgtgctgatgctccagccatggctttgatgcttctgtcatttttaacctcttctattaatatttactgcctgtgccattcttttccttgttggccattcacaaggcttggataatcgtgtgacattttgagagccatcagatgttacgtttctcaaaaaaaaaaaaaaaagacttgattatattaactatttgaatctatgatctgtttccttgagggatttttgctaatctgtatttcaatttcccaggtcctagaatttatgatttttttttttttaagaggttagtagctaacagtgagaggcagcctcattgtttttagtttctagttgggtggaactcagccctagtgttgtatacttattaatcccattttagtgctttgcacatatccattgttattcagtgtttttctctgggtccttccagtttattttcttccttagctgtactcttttaaaaaaaaaaaacaaaaaaaaacttttttttttttttttgtgataaagttaaaatataatgtaccctactttttttgtgcagtatgacacttacaagatggccagactagaggaagccagaggtgggcatggtaacactactgaaaagttggtggtgtgccatggacaagggaccgactgcagagtatgtttgctgaggaaaatagaggcgaggatagagcaggcaggggaagggaaataagacatggagataggaggttaaagcagttgggagtccatacacagcctacccaacttcctgagaactcttagagaggaaaaggcatccttaggcatccttcctgtgaagtttgcctattccgtgatcacgctgagaagatgggaactctgaagtttgcttcacaggaaggtaaaatccttaaagggaggcaccttgctgtgccactgttcagttttactataacatcaatctttttttagtttttattcccacctcaagaggctgagttgaatactattaggcggggaatggaaaattatataggcacctaagtttcctttctagttatggtcagtgtttacactgagtattcatgacagacaatgcaccaatttttttaataggctatgtatgtcaaaaaggatgttcctttgtggcaaaaacatggacggaacttctgaaacatgtgagagaaacccataaaggtaaggcaggcatgaatggcaggcatggtgtaaatgtttgtccccacagaactgatttagtgcttttcaagagtgaaatgctgtgtgctttaaagtaaaagggtttctctatgatattttgtgaagtgctgggtatgatgttgttggaaaggtgagcagagctgtgccaggtctctgagccaccccaccatgcacaattagcatgctgaaggcggtggcaggtctgtagtgaagaatttcgggaggcactgctgttctgtgggaccgcctgggaaacagtaccctgcatactgggggacaaggaaggacactggtctgcttcattttctgtacctccccacagtcaccttcctgagagccctgcctcttggcaagtgaacaatgactgtgtggcatttaagaacttcagagaattgagacaaacttcctaggtgataaaaactggggttgtttccttgggaatttctgatttgtatatagtgatcaggtttcaggcactgaatgttacttatatattaggtattaattttttctaaatggtaatatctggggaaatttgtgaaatttgtctgtctgtcccaccagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaagtaagcactcaccctcatactcatggtcctatagtctatgctttcacaacatggttttcatattaatatttcattaataactttctctttcattgtagcaaagtctcactaggcatgctgttgtacatgatcctgacaagaagaaaatgaagctcaaagtaagttgaaactacttaggcaagcttagttttcaagtggaaattgtttaaggccagaaggagtctgtttggaattcttttcacctgctttactgtttgagtctgcactactgttgaagactttacttcctcataaagcaatgttgtacactatatctgctggtacatatgactatcgtaaaattaactcagacagttttgattttgaattctaatcgtgtgtcttccttattcccaaaggtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcag

SEQ ID NO: 35838 - DNA, 124335 bp, Homo sapiens
acgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaaggtaaaccgagcagcggccctgctggccctctgaggctcgggggcggtcggtgcctgggtttctctgtccctccggtctcctagcttcgactgctccgcgcgtgggtcatcggcgtggcgacttggtggcttgtactctgcggaatctctggggtcatagcgtctcgggctggttcctgcggccttctgcttcctccttcccttttcttctggtcagagttcatgaagcagccccgagataatccaaggatctcacctctttagattctgagcggagtcccgaggtgtgtgggctggcttgccccggagggaggcaggtcgcgaatgccgcctgctcggccctcccaggaacagcccccacaggagccctcacagagacagctccagatgtggatggcgaggagaaacgctcctgatgcccagcgcctcggcccgagtggcagattccggcctccctctgtccctccagtgactgcttgggacccggacgccgcaggctcccacggccgttttcccctcatcgcccgcatgctccttaatgccaaactgcctttcgtttctccccggacgcagttgtctgatgcctctgttgctttgcttctgttctgtttgtaccgtgtatcttcacctgttaacttttgtgcatcctgaaaggatccgttcagatcggatcttctccaggacgcctcggatcctcctgactttcccctagagccttgcactgtgcttacctctgtcctgcacttactgtgctcggcagtaccgggcagtactaaagctcataggcgtctgcgcgccctcttagcatggcagctcctctagactgggtacctggcttattcactgctgtgcccctcgccctgaacgttcctgatgcttgaagaccctcagtgaatgttagttgaacaatactaaatggatatgctttgtgaaagagttcctagggagagttctatttctgagaaaacagccctaaaatgtttattattttaccagtgggctgagcgtacctaattcagtccaacatgtaaataggccggggccggtggctcacgcctgtaatcccagcactttgggaggccaaggcgggtggatcacctgaggtcaagagttcgagaccagcctggccaacatggtgaaaccccgtctctactaaaaatacgaaaattagtcgggcatggtagcacacgccagctactcgggaggctgaggtgggaggattgcttgagcctgggagatggaggttgcagtgagctgagatcacgcaactgcacccccagcctgggccatagagtcagtccttgtctcaacaaaaacaaaaaatatccatggaaatggaaaagtggaccaataccttatgaagcggaaggacatcatcctagtgtttcacagaaggggaggcttctaacacaggtggacagtaggatctttcgaagtaaggtattaatgcagtcaaaccttcctctggctgctgaatgcctgattatatgtgctgtatggaaaagcacagttgtctaaacctttgggaaatagatgtattcctttttcctcaagttgggaggtagaggtcggggaggtgttacagtccagaggaaagtggtgaggagtttgggtagtgccattaatgatgtgcctatctggccagtgtactttgctataggtctggtcttctgcaccttgggacagagtttgatggaggagggagaaatattgactagacaacactgtaacacttttttttttttttttggaagacggagttttgctctgtcaaccagatgggaaggcagtggtgcaatcatagctcactgcagccttgaactcctggactctagcgatcctaccgagtagctaggactacaggcattctaccatacctggctaattaaaaaaaaattttttttgtagagacagggtctcactacttactactagatgggtctcatttctaccatatattactgttataatttatcataatactttatttttattttttgagacagagtctcactctgtcccccagtctggagtgcagtggggcgatctcagctcactgcaacctctgcctcccaggttcaagtgattcttctgctcagcctcccaagtaggtgggattacaggtgtgtgccaccatgcccagctactttttgtatttttatttattttattttttgacacagattcttgctctgtcgcccaggctggaatgcagtggcgcgatcttggctcactgcaagctccgcctcctggattcacgccattctcctgcctcagcctcccgagtagctgggactacaggtgcccaccaccacgtccggctaattttttgtattttttagtagagatggggtttcaccgtgttagccaggatggtcttaacctccagatctcgtgatccacccgcctcggactcccaaagtgctgggattacaggcgtgagccaccgcacctggccgtcaacaggttttaacacaactaagtcacagctgccgtctggctgacagcaagcctcttcacttatgctgcctatctcctgatataccctcttttcatctacttaaattctacttatctttcaagaactaggctaagtcccataccttcttaaaacttcctcagactactctaagttacactggtcaccttttttgaaattctggtgaccttatagtcagaacatgtaatttagcacttcagttttctagtacttttatgtatggtaatttcatgaaatacatcttacatcacaatccagtacacacatacaaaacttatttgtaacaactgaaacaatttgttaaagcaacgcttattacatgtgatgaactcttggtatccctaaagtatatcttaaaaaaaaaaaaaattgctgcttggctggatgtggtagctcatgcctgaaatctcagtactttaggaggctgaggtgggtgtatctcttgagcccagggtttgagaacagcctgggcgatattggcaaaaccccttctctactaaaaataagaaaaattagctgggcttagtggcgcacacctatagtcccaaccactcgggaggcttatctgggaggatcacctgagcctgggaggttgaggctgcagtgagtcctgtttgagccaccacactccagcctgggtaatgggagtgagactctgtctcaaaaaaaaagtgctgctcacaacctgctaaattgatttggtcataatctaataagttcaaatttcagtttgaaaaatattacattatttaattctcaccacgtaatggatttttatatccattcaattatctgactctgaggctcagaggggctaagtactttattttggtgcagcttttaagttttggaactgcctttcttaaaatcttgtgctctttccatgccatctctactgtatattactgttataatttatcattgaaacatatattcagtaaatattctatgggttatatgctagagatgcaaaaatgaaaaaaacaaagttcctgttttaaaggaatgtctaatctggaggagaaaagaataaacaagtagtttaaataagattatttgagatatttgattaaacatggcagattgagtacatgaatttatctctgttggtgctttccatatcccactaaagcaacaataaggaaagaaaatgatattaatccacaagggcaaagtgagtaggaaaggaaacaatagctgagatatatcggaagatttttggaagattctgaagttgatggagaagtggtcactgactcagagcagagagaccactacctaagttcctgaagaggggttatactggttgagcctcccagcagaactccagaaggcccaaaacttggatatactaggtgccaggtagggtgggaaagaagaaaaagactattctaaggaacagttaggtcccaagatctcttttaccaccaggtgactttaccttttcttagcagagtattggagactttttctctggggaaactgaacagatgaagaggctctagaatcatctgagctgttaggcccaagttgaaaaaaagggaattaaattgaattctgcatgctaaagggtagtacttcccagctgtgagaagcaacactggtagtcacacatatactaccttcctggcagagatttggaaaattatttggaatggctgcagagaaaagccagcttgctactccatcatcttgtggtgaagatcagcagttgataagctttattcatgcagagagcttccttcaggcttttaattgttttaattatgaacaaatagccaaggatcaccagatattcaaggaaaatttccaacaagacaacgtcaaccccctactcaaaaacaacaaaatactaaggaaaaactttggaggagggatcagaagacacttagggaacaaaagaaaacctaaactgtaacaacctcagggagataagtgaaaatattacatctctgaaaaaagaactgagtgctattttaaaaaaaaagacataggaaagagctcttaggaaattaaacatattttgaccaaaacaaaatattcaatagaagataacgtaaaggaaatctggacaatggagcaagaacaaagaaatgggtattaggagagaaaataaaattaaatgtttaataaaaaagatccaatatctagttaatgagttctagaaaaagaactgagaacatagaaactaggaaattatcagagaaataatagagaattttccgaactgaatttttcagtttgaaaagccaatccgatgaataaaaagaaagctcatatcaaggcacattatcctgaaatatcagaaccgtagcattagatttctcaacagaaaccttggatgctacaaatgacagaataatgctttcaaaattcttaagcaaaatttttgatcctagaattctattccctaataaataatccaaatttgagggtagaaaaaaattttttaatgtaagtgctaaaaaattaacttcttacacatccctactcacaaagctaattagagaatgaatgtgtccaccaaaatggcggcgtaaaccaaggaagaagatactggatcctggaaacagggtaacatagaatagtgagaaaagccccagggtggcatctgtgcaatgactcagtttggaatatgttctggatgggtccaggagggaggtctctagaaaaaaacattttgaccatgtggactatggttttaagagagattttagaggtgagtatattagagttggagttaggcacataaaaagcaaatgaaatacatgagttaggcaaattaaactcagtaattatgttactgagcattagcattagtattgttatgagattattatatgtgtaacatggcttaaaatatgtaaataaatataattctacttcatcccttggtgcttgagaattaagattcttggtggaggagaaaagagatacagatgtaatacagaagggagtaggtaaaaaattctgtaattctgaaaaagtattagtataaactttaattagtatttcatctttaaatgtttttctggctctgtccactgaagaagcttagaaataatgaccaaatctgttacatccataccattgtgatcttaaaatatctttttctactagaagaaatggctggttgcagaaattgcttattccccatggggcaggaagtgtacaatgtgagtctagaatattttgtcactgctaattgcaaggaagttatcaaagcctacttgagtgatgccgaaaggattcaggagccaacctgtagttctcacttaccaaagttgagaaaatttgagctttaaaagagatagtaattgcagttgattaaaacccatcaggctgggcatggtggctcatgcctgtaatcttggcactttgggaggccgaggcttaattaagcccaggagtttgaaaccagcctgggcaacatggcaaaacctcatctctactaaaaaaataaaaatcaaaaattaagaaaaaaaaccccatcaggtatgtttaaacaagagtttgtgataatattttaaaaatcaactaattatagtctttggaggataacagggaacctactcattgtcttgaaaattgacaaagggaaacaatcatatgtttattgtttttcctgtatgaactgtatcattggataattaaatagtagatgaggagtagtgtcttctatcaaacgtatttaagtaataactgaaaaagaaatgacagaacattaccatcatttttgacagctgccaatgaattgatctagcaggggttctcaaaatacggtttgtggagtccttggggtagtctctgagaccctttgaggggacctgaaagatcaagactattcataataatactaagatattgtttgccattttcattgtatgttgacatttacactgatggtgcaaaagtaatggtgggtaacactgttggcatcttagcatgaatcaaagcactggcaccaaactagtagtcactatatttgtcatgcacttatgcattcacaggaaaaagaaaagcactaattttcacttaagacctcgatgaagcagaaaacattggttaattttattgaatctcaacccttaagagatgatttgcattatgagctaaaccaactactttttttcatgaaacacattttacttgagagaacaaatggcacacatgtgatggttaattcatacttgagtattttacagacattttctcaaaaacgaatgaagtcagcagtcacgtcaaggaaaacaactgaagtgtttgtttctaaagataaaatttgggctttcaagtgaaaattagaattttagaaaacttgtatctgcttcataacttcctactattaaaaattttttttttgttttttaacgggacaggtaatattaacaaaggtgagtttttggaattatataaagtcaaaatttgaaagggccgtataactcatggagccgatatttttccaaaaaaaccaatggatgatgttctgcattctttaaataataatccactcatttatggatccattgaatggatcagtaagagatccattcaaatacaatattttattataacagagtatgaaaaattcattgatagacggtttcaaattctacattccagctaacttttttttttttttttttttttttttttttttttttttgagacggagtctctctctgtcccccaggctggagtgcagtggtgcgatcttggctcactgcaagctccacctcctgggttcacgccattctcctgcctcagcctcccgagtagctgggactacaggtgcctgccaacacgcccggctaattttttgtatttttagtagagactacaggcgcccgccaacacgcccggctaatttttttgtatttttagtagagatggggtttcacggtgttagccaggatggtctcgatctcctgacctcgtgatccgcccgtctcggcctcccaagtgctgggattacaggcgtgaaccaccgcgcccggcctaacttttaagaaacgtcggcccgggagcggtggctcacgcctgtaatcccagcactttgggaggccgaggtgggcggatcacctgaggttaggagtttgagaccagcctggctaacgtggtgaaactccgtttctactaaaaatacaaaaaattagctgggtatggtggcgcgcacctataatcccagctactcaggaggctgaggcaggagaattgcatgaacccgggaggcggaggttgcagggagccgagatcgccccattgcactccagcttgggcaacaagagcaaaactccgtttcaaaaaaataaaataaaaaaagaaacctccacttggcggggcgtggtggctcatgcctgtaatcccagcactttgagaagccaaggagggtggatcacctgaggtcagaaattcgagaccagcctggtcaacatggcaaaaccgcaaaaccccgtttttattaaaaatacaaaaattagccaggcgtggtggtggacgcctgtaatcccagctactcgagaggctgaggcaggagaatcacttgaacccaggaggtggaggttgcattgagctgagattgtgccactgcacttcagcctcagccacagtgcgagactcagtcaaaaaaaaaaaaaaagaaaaaagaaacctcctgtctcaagaaaaaaaaaggaatgtccacactcggttgggtctagtgagtggctcatgcctgtaatcccagcagttggggaggctgaggttgaaggcttacttgagcccaggagtttgagacccgtctgggcaacatggcaagaccccgtctctacaaaagatagaaaaattagctgggtgcagtagtgcatgcttgtagtaccagctactcaggaggctgaggcaggaggattgctcgagcccaggagtttgaggctgcagggagctatgttcatggcactgtactgcagcctgggtgacagagcaagaacctgtcttgaaaaaaaaaaagaatatccacaattccaatactcttcccttttccaactacatgtctgtgttaggtcacatgatgtacttcatagacttcaactaaaacaacataatgctaaagtttgaatgaagaatcagatatgagaattcagctgtctcctgaattaaagataattgcagaaatgctaaacaatggcattcttcccactttattttggaaaatacaattatttttcatagaaattatttatgttaacatgtaatggatttattgtttttgatgaattggaaaatcttttaaaatgtctttagttttaagttctattatgatagctattggtagatataaccttcataatcgaaagctctttgccatttccaataatcctcaagagcgtaaaggggtcctgagactaagaagtttgagaatcgctggatgtagtctctgctgctaacaacacagagaaacaatcagatatatgcttcctaatgaaagaatacactaccacctatagttttgtcaaagggatagaatgtacaatcaaattttggatccagttgccaatttacaggaaatacagagaacagaagtacacattcaactacatgagtatgcaatctgcaaaatccagactctgggaaactgtaggtcaaatgctttggttcttcaacagacacatcttactgtatttgaaaggaaaagaaagtagtagagggaagcctgtagattaaaagagaattaaaagacacttttttaaaataaatgggcaagactaaactataatgtctttggatgcgtatttgggtgataaaagtatgaaatattccaagagagtaattactgtaagaatcgggatagtaattactttgggggtagagtggggattgagattgctacagagtacatggaggagtttctggggtggagggcaaagttctatttcttgacctgggtgatggtagcaagggtgtttgccttaaaacaattcattaggatatgcatttaactctagaaaaaaaaatcctaaaaattgtacagtaaggaaatggaatcataagtagacaactggcccagcagttgaaaaaaatgtacttaataaagcaaacaccgagaattaaattaacaccaaattgtgattctgctatgtaagaagggtaagagatatgtaaactaatgtatatgtggggtggcagaaaaggtctgatccttattggtccttataggagattatgatatgacttcttacattgatgaagaaagaaatagtagtataagaaggatatttagaaacatgtcagtttctaacaagaaatatctgaaagaattgaaagtggatgttttgggagcaaataagactactgggtgcagagtagtgaaacaggattgctgtttttattataaagtttgtggtactttttgtctttatcttttgtttttgcatttcttttatgaaaaaataaaatataaatagaacattgctagcacctcagaaggccctcttgtgtcctcttccagccactgaccccttgccttcaaagggttactattattctgacttctgacctttaatatgctggattaattctggttaaaccttaaaaaggtttctgtaattcaagaattatggagaagaattgggatgggtcagagataggaacacattaagtgttttggtactgtgcaatgaaatgtggcatttaagtcacatatcatgtttcaaacttttgtgacccattagtgagtcgtgaactcaatttagaaagttgtcttagaattaaaaattgaaatagaacaggaaatactgatgccagcaagcccacaaagtggggcttatcttgggagggttctcagcttcacttagagtgagccaacagtgaaagaaagcaaattagaacagcaaggtacagcaaaatggctgctccatagacacagcagggctgtcgcataggcagagcagcccagagtagcccagtggattgctggacagctatatttatacctactgttaaaaggggggtgggttattcatgaactttctggaaaaggggcagggagtccccagagtcatataacttctgaggcattgccacagcatagtaggtaaattgtcatgctgttggtggctgtgtcttatgtaaatgtgttataattcgcatataatgagcaatgagggcaactagaggttgctttcattgccatcttggtcttagctgatttcagctggtttatttgtcacatccttttttgatcagcagggtgatcagtagtgactgaggctcaggagacaagtcctgttggtatcctaccttgaaataagaataaatatttcatgaaagttttgcttcacttatgtatgtatatatgcgtgtactgggttgtgttgtaaaatgtattttattttggtttgcagtcaaaagaatattcaaagccatttctctttaatgtgaccactcaccagcaaagcactacatcttacctaatcagtcatcaagttcagtagattttacttcccttgtatttctgaggtctatttctttcttttttgcttctgtcttagccctcacctggcctgtttcagaattatgctagttggtctcactgcctcccgccatgctcctttcatcatttcttcacattgtgtctaggatgatctaaaatgcaagtctcgtcatcccagtctctttctctttttaaaaatagactacttttaagagaaattttaggtttacagcaaaattgagtacaaggtacagagatttcccatgtgtttcccctatccctccatatatagcctctccctctatcagcaagggcacacccagagtgatacatttgttatgatcgatgaacatacattgacacatcattatcacccagagaccataatttactttagtgttcactcttggtattgtacattctatggattttgaaaaatgtgtaatgacatgtatccagtgttataggatcatacagaatagtttcactgccttaaaaatcctctgtgttccacatattcatccttctctcccaccagcacctggcaaccactgatctttttactgtctctataaattttaccttttccagagtgtcctttacttggaatcatagtttgtagtcttttaagattgtcttctttcacttaatatgatatgtatttaaggttcttccatgttttctcatagcttgatagctcatttctttttagcactgaataatattccattgtttggatgtgccacagtttatccttttacctcctgaaggacatcttgattgcttccaagttttgacagttatgaataaagctagtataaacatctgtgtggttccatcatagtggctcgtgactgtaatcccagcactttgagaggctgaggcaggaggattgcttgagccccggagttcgagatcagcctgggcaacatagtgagatccatctctacaaaaaaacttaaaaattagccaggcatgattatgagcacctgtgatctcagctactcaggaggctgaggtgggaggattgcttgagcccgggaagttgaagctgcagtgagctgtgatcacaccactgcactccagcctgggcaacagagtgagactccatctcaacaaaacaaaacaacaacaaaaaacacccatttgtaggtttttatatggacataagttttcaactcctttgggtaaatgccaaggagtgctattgctaattcatatgtgtattgtgtgtgctttatttttgctttatttatttatttattgaaactgagtcttgttctgttgcccaggctggagtgcaatggcacaatcttggctcactgcaacctctgcctcctgggttttcctgtctcagcctcccgagtagctgggattataggtgctggccaccatgaccagctcatttttgtatttttagtagagacagggtttcatcatgttgaccagtctggtctcgaattcctgacctcaaatgatccacccacctcggcttcctaaagtgctgggattacagatgtgtgccaccatgcccaacctgtacatgtttagttttgtaagaaattgccgaacttcctattgctccatatccttgccagcatttgatgtcagtgttttggatttttgccattctaattaatagtggtatctgattgttgttttattccagtctcattttaaaaaacattgtcatctgggcatggtggctcacacctgtaattgcagcactttggaagctgaggcaggagcatcacttgagcccaggaatttgagaccagcctgggcaacatggcaaaaccccatctctacaaaaaatacaaaaattaacttagcgtggtggtgcgtgcctgtagtcccagctactgtgggtgcaaagggagctgaggtgggaggattgcttgagtcagggtggttgaggctgcagtaagttgtgatcataccactgcactccagcctgagtgacagagcaagaccttgtctcaaaaaacaaacaaacaaaaacactgtcttcaggataaagcccagaccagcattgcagggcataaagggtcccttgtgagttggctccagacctagactaaactttcagctccattacttattagctctatgcccctgggttagttgtttatctctctgtgtcctagttttcttatctgtaatgcacggaacctaccttttaggatggttgtgaggattaaatgagtaaatacatgtgaaatgcttaacacaatgcataccacagtaagcgcccaataaatattagttgttatcattgtttggacctaaggtacttttatgttcatatcacttttattttattttattttatttttggagacagagtctcattctgtcatccaggctggagtgcagtggcactatctcggctcactgcaacctctgcctcctggttcaagtgattcttctgcctcagcctcctgaggagctgggatcacaggcgtataccgccatgcctggctaatttttgtatttttagtagagacagggttctaccatgttggccaggctggtcttgaactcttgacctcagtgatcctcccgcctcggcctcccaaagtgctgggattacaggcgggagccaccacacccagccatccttaacactttccactttatgttttaacctatgtcataccaaattatttacagttcttccacagagaaaaaactgctgtattctcttacttctagatctttactccaaaatttccttctctttcactttgctaactgctactcatccataagaacttaatttaaatggcagtttctctgggaagcctttcttttcctccctccaagtctgggtagatgtctctgtcaagacattctgtacttctgacactgtagtgtaactgtctgtcttaggttagactggaagcactctgagggcaaggattttatattatttattattagagtctaataataatgtgttttttgtttgaatgagtagtgaatgaatagatttttattgtgtaaaaaatgtaactatacttggctgggcgcagtggctcacacctgtaatcccagcactttgggaggccgaggcaggcagatcacaaggtcaggagtttgagaccagcctggccaacatggtgaaaccccgtctctactaaaaatacaaaaattagctgggcatggtggtgtgcacctgtaatcccagctactggggtggctgagccaggagaatggcttgaacccaggaggcagaggttgcagtgagccgagatcatgccactgcactccagcctgggtaacagagcaagactccgtctcaaaaaaaaaaaaaaatgtaactatacttgtttgtatttattatctctttctatatctctagtttgtgaagcctggagctgagaattcaagagactaccctgacttggcagaagaagcaggtaacatagaacatttagatctttgaacattcatagtttattatgtggtctgtcttgatttcatggatggggcagccttgcaagcacaaaaggaagcccagtcaagggagaagaacccgtacagagaaatgtctagtgactcactacaaaggaaaagagcttgggcattcttagcagctacatagccagagcagagagtggcttacaattttatgtgctatccaaatatgtgttgagatggttaagggatctgtgggagagagaggtagggtcattaaaagggataacatcattctagtgtgtgttaacttcaggagttctaacaaaattagtgtcttcctttcctggaaaagggataatcacattccaaatgtattaaatacctgtatggtggttttctttacttcactgagccaacatagagaattctttttctgtcactagattactgcatgactaaaggaggtgatgcagtttgttactgtttattataatgagtattagtacttttgagcaaaagacgggtgaatattggtgtgagtggaactaacagggagaaggatctacaggtgtatgggtcctggttctctaagcattcagcattctttagagacgtgccacgaccaggctgcatctggctgcactgtgggtctgagttgtagcagagagatccccatccattgttcttcttctcccccacctctctttttttaaaaaaaggggacaagtatgaaagcttctttacatgatatatataaagaattttttttttgccatcaataagaaatttaattatttttaaaaaatccaaatgctggcattgccagaaaaatttaacaggtttttttttttttttttttttgagatggagtttcactcttgttgcccaaggtagagtgcaaatggcatgatctcagttcactgcaacctcggactcccaggttcaagtgattctcctgcctcagcctcccgagtagctgggattacaggcacacacctccacgccaggctaatttttttgtatttttagtagaaacggggtttcaccatgttagctaggctggcctcgaactcctgacctcaggtgatccaccgacctcggcctcccagagtgctgggattacaggtgtgagccactgcgcccagcctaacgggcttctttttatccctgcagttatactaaaaattcacacacgcatgaaaatggaaaaactaccaatacttgatttctgtactctatttttccacttgcaatcatatgcttaggtgccctttgactccatggaaaaaaaatctaatgttcagaactaccaataacaagaacagaatatttttgtttttgagaatgaaatggttcccaacatggtgggttcttttttttttttttgagacggagtcttgctctgtcgcccaggctggagtgcagtggtgcaatctcggctcactgcaagctccgcctcccgggttcacgctattctcctgcctcagcctcctgagtagctgggactacaggcaccccccaccttgcccagctaattttttgtatttttagtagagatggggtttcaccatgttggccaggctggtctcaaactcctgacctcgtgatctgcccacctcggcctcccaaagtgctgggattacaggcgtgagccaccgcaccccgcccatagtgggttcttaagcacattctctgcatatgtagtatgctagcttgatgtctgttgttactcatttggcatggatagtgcacaggttggtgtcttcaaaaaggccaacgagataggcctcacttacttcttgcaaagcaccaatagctgcactttggaagtgccaatctgtttttaagtcctgagcaatttgttgcaccagacgctggaagggaggtttgcgaatcagtttagtggacttctgataacgtctgatttcaccgagtgccacagtaccaggcctgtaatgatgaggtttcttcacccctgcagtagagggcacactcttgcgagcagcttttatagccagttgcttcctggatgctttaccagtggttcatttcgggcagtcagctttgtactagccatggtatagagacctccttacttaccctccttctttgggtggaactctgccagctagaggtggtgctggtgatagagaggggcagcagtgctggaacacctaaataaatgttttggtttgggggcaagtactctaagcttaggtgccggttgtttaggggaattctgggaaatacctgctgtcaacacctggagaccttctctttcatcccataagttgttaggcacagtccttttcctagggagcctccccaactcaattcctgctacgttgttgccaggcaacccaaaaggagttactgtgtttattccttagatgttcctgcttattaccataagtaatattatggggaaatccagtgcatatatatttagattttgcttcaactttttttttgttttcttttttctctttctaactattccttcaacatcaactctgattattcaactcaatacttaaatgttatacaaggaatcagagcatgtctgttctccaaaaggaaggttcaagagatttgattaattgcagtggttctcagggcagacattattcatttaatgtttatcttctgcgttgttaaatgttctcctctcaattgatgcctccaaatagtttctgcctgtctttgaagtgggagatgctttgatcagctttctctatattttttgaccaatttcttttatttcattaaaaaatttgaaattactttagtgtgtgtataatattttgattataaaatggtaatactgaggtaaagttaatgatgtttgaaattaactctggggattgactagtaataagaaatctggccgggcatggtgactcacgcctgtaatcccaacacgttgagaggccgaggtgggcggagcacctgaagctaacttttgtatttttagtaaagatggggtttcaccctgttgtccaggctggtcttgaactcctgacctcgggtgatccacccgcctcggcctcccaaagtgctaggattacaggcgtgagccaccgtgtctggcctgctgttagcatttaaaggaggtacagagtaccagctaaacatacctttttgtaactcattctttcccactgattataagagcaatgcatgtgttttattgtaacgaataattatatactaatgaaaacaaaattttgacccagacctagtcactattagtatcttggtgttattctattttagcatttttcccctatggctatatgggatcacatttgtagttttgtatcctatttatttatttatttagatatttttaaggacaacatctcactatgctgcccaggctggagtgcagtggctattcacaggtccagtcatagtacactccacctcaaactcctgggctcaagcagtcctcctgagtagctgggactacaggtactcgccactgtgcacagcttgtatcctaatttctgaaatttattttttcatgagcatttctccttctacttaaaattgtttggaaaagggccaggtgtggtgactcatgcctgtaatcccagcactttgggaggctaaggcaggcagatcacctgaggtcaagggttcgagaccatcctggctaacacggtgaaaactccatctctactaaaaatacaaaaagttagccagattggtggtgggcgcctgtagtcccagctactcaggaggctgaggcaggagaatggtgggaacccaggaggtggagcttgcagtgagctgagttagcaccactggactctagcctaggcaacagagtgaggctgtgtctcaaaaaaaaaattgtttggaaaagaatgtttaagttgtgcataatatatatatatatatgccattatttttgttggacatttaggttcccaagtttttgatattttagaaaaattgtaatgaacattttgctaaatagatgtttgttctaatctctgtttatttttgaggaaagagcctagaagtggaattgcaggaatagtgaatatgatcatttttaagtttttttgttttttttttttaattgagacatggtctccctctgttgcctaggctggaatgcagtagtgtgatcatggctcactgcagccttgacctcctgggctcaagcaatcctcctacctcagcctcccaagtagctgggaccacagacgcacaccaccacgcccccctaatttttgtatttttggtagagacagggttttgccatattgcccaggttggtcttgaggtcctgggctcaaggaatgctcctgccttggtctcccaaagtgctaggattacaggcatgagccactatgcctggcctcttttttttgtttgtttgaaacagggtctggctctgttgcccaggctagagtgcagtggtgagatcatggctcactgtagccttgacctccaggattcaagtgatcctctctcttcagcttcccaagtacctgggaccacaggtgtatgctaccacacctggctaatttttattttttgtagagatggggtcccaggctggtctcaaaactcctgggctcaagtgatcctcccacttcagcctcctaaagtacagtaagccactgtgtgaaaccaagattcttgccaaattaattttcagcgtttacacccgtagagtctcattggcaacatatgagaatgttcttctcaacatagtctcataaacattattataagacatttgttttttgtccatacgttaagcaggaaaagataactcattttttgactaacccaattctgtaaccaattacttcataaattataataattgattattataattagtatctttgtgaattaaaaaaatttcaaatacatttatatgtttaaaaaaaaaaaaaaagccaggcttggtggctcacacctgtaattccagcaccttgggaggccaagggaggtggatcacttgaggtcaggggtttgagaccagcctggccaacatggcgaaatcccctctctactaaaaacacaaaaagtagtgtggtggtaggcgcctattattcctgtaatcccagttacttgggaggctgaggcaggagaatcacttgaacctgggaggtggaggttgcagtgagccgagatcgcgcccttgccctccagcctgggcgacagagcaagactctgtctcgaaaaaaaaaaaaaaaaaacggaaaatacaggaatagagggccgagtgtggtgactcatgtctcttatcccctcactttgggaagccaaagtgggaggatcgcctaagcccaggagtttgagactgcagtgagttatgatcacaccactgcactccagtgacagagagagatgttgtccttaaaaaaaaaaaaaaaaaaaaaaaaaaaagaatgaagagtggcttataattctcaggcctgttccccatggacaacttcttttaactcgttttgctttcgttcttctggtgattatctaaatacttcaagtttttgatttgtcagttttagatgtctgtttgctgctcactgtcataaatgaggatttagctcacacttttttttcaacctcactgtcctctttccagtttacttacataatttttctcatttacttacataatttttctcagttcctctactagttatttctgccacttttgatagcatccttaagctctctttcttgttccatagacagagtcacctcttgatcttttctttgtaagatgagcacattagtgctatctgctcccagtaatgacagtctttctcattttaccctctagatgtgcagtggagctacagggatgaataagacaagggacaaggaccttgtcattaaggagctgtaagactcttcagatttaatgtagatagatgtgaagttataacagaaagtgttaagtaccaaaaaggagatacggaaaagtgatgcagtagcttagaggaaaaaatgattacttctgaaagtagagatgtgacatgatttgatgaaggatttgtcatttgaattgagcatagactatatagaggtagtttactttgagaaaactctaaacttaattttcactctcctaaaacaaatacttaaagcactttttgataaaaacctttcgtttttataggcaagaaggctttagctgatgcacagatcccttattcagcagtggaccaggcatgtgttggctatgtttttggtatgtattaaactgtgtattctaaaatttttttacctaaatctagcagcaactatacaaacaatgcggaggcatttgtgaattttaaccctcaaaaactcagaattcattcaattatatttgtattgaagaaaaaagaaaaaaatctcagaattcaaagtctgatttaagggaattaccactatttaaagatttcccttgtgtgtcaacctagtgtaatttttcttttggtgactattccaaattatactgtaaagatcttctttggcctttttaaaaatatggccaggcactgtggctcacgcctataatcccagcactttgggaggccgaggcaggcggatcacgaggtcaggagatcgagaccatctggctaatacggtgaaacccttcctctactaaaaatacaaaaaatgcgcctgtagtcccagctactcaggagggagaggcaggagaatctcttgaacccaggaggcagaggttgtagtgagccgagattgtgccactgcactccagcctgggcaacagagcaagactccatctcaaaaaaaaaaaaaaaaaaaagcatactgtttcattgaataaatgtattataatttattttatcaatccccttttaatggatatttaaaagttccagtcttttcacagaatttaaaaaatacttaattgtcaaatattgaatatattcaaggtataaaataagatgatttatgtatatattgtataataattgccacaatccagttaattagccattaattaccacccatgctgtacgttagatccacagaactcgttcatcttataactgaaagtttgtaccatttgactaacatctctctgtttcccccaaccccaacaacatttttttttttttgtttttggcaaaggggtaaggtgtgtgtgggaacccctacatcattttaaatgattatatgatattctactcttgaagatctactacagcttatttagaagtagtaatgatattttctaatttctagttgttataaaaattctatgaatatatacagtattattaaaatactatagtaggtgttactgtagatgaatatttgtgcatatctatgattcatttctttgagatatcaagatatcaagagaattctagaagggaaacgtactgggttaaagggatgcagaatatatttattgaaaagcagatccctaactttcctgattttgctgaagactcctggagcctgtaccttcagatattcccatcacactgctccagcatgtctaccttggtggtcatgttacttgtgtttgaaatgcttgttccttggtgccataaagaaatagcacttgaacataaatttaatttactcagcaaggccattttaacttcctgcagaaagggtacactcgccagcagttttgccacgagagtacactgagcaaaggagacagggtcatttataacctgatgcgtccaccctactgctgtgtccagttccattggctggaacgggacctcacattctgtatttgtcctgattggctagcaacttagaactttttaaaagaggcaaaggcagaggagaacaaaggaaggaggaagtaacttgtggaatgctgagaaaggtaaaaacaccttcaaataaggaagaggaacaggctatgacttaatgcttgcttgggccagtataagcatgccagggcaaatatttaggctaaattgtgggagctaagaatgtaaagtgtaatgatttctttaccatggctagcagatatttaagaatgttagcacaggtctttgaataaattttgcttctaagagaagttactatttattcctaattaaatgaggaggaaagtctttgaagaggaacctctactttactttttacacttgggaaaggaaggcacatgtgtatttaacatggatcatgttttcctggaatgccttggcatgcagggtcttttaaactttttgaagttgtggaatctttatatgaaaagtaaatcatggcctttaatcactggcataggtttaaagattttatttatttatttatttatttatttatttgagaccgagtctctctctgtcgcccaggctggagtgcagtggtgcgatctaggctcactgcaacctctgcctactggttcaagtgattcttctgcctcagcctcccaagtagctgggattacaggtgcatgccaccatgcctggctaattttttgtatttttagtagagatggagtttcaccatgttagccaggatggtttcgacctcctgaccgcgtgatctgcccgcctcggcctcccaaagtgttgggattacaggcatgagccaccacacctggccaaggtttaaagatttttttctgacatttaggtgttaatgaaatattgctttctttatcatatagccttagccagatggaactgttttctattaactgatcatttctttacttctctacctctgtattatataaagaaagtgcacatatattctgttttcagtcttttttgcagagtaaatgatggttagtgttaaaactgtttctaagatatttactgtcttgcacatgttatatgctaggcaaaggtataatattgaaaaaacccataatgtagtattatgttgcattgcaactccataattctccatattaaaatttttgtttttctattcaggtgactctacctgtgggcagagggctatctatcacagtttgggaatgactggaattcctataatcaatgtcaacaataactgtgctactggttctactgctttgtttatggcccgccagctgattcagggtggtaaggagtgcttgtctagtgtacttaaatattgccccattttaatcatttaatcacacgaccatcagaggaattattttataatgtatttgttttaaaaaagtcttcatcaggccgggtgtggtggcttatgcttgtaaccctagcactttgggaggccgaggggggtggattgtttgagcttgtgaatttgagactagctctgggcaatgtaacaaaaccccgtctctacaaaaaatacaaaaattagccgggtatggtggcgtgcatctgtagtcccagctatctgggaggctgaggtgggaggatgacttgagcctgggagacagagattgcagtgagcctagatggcaccactgcactccagcttgggtgatagagccagaccttgtctcaaaaaagccccccaaaaaacaaaaaaaaggctttatcagccaggcatggtggctcacactcgtaatttcaacactctgggggaccaaggcaagagcatcacttgagcccaggagttcaagaccagcctgggcaacgtagttagaacctgtgtttatacaaaattaaaaaaaattagccaggcgtggtggtcccagctatgcaggaggctgaggctggaggatgtatgatcataccactgcactctagcctgggccacacagtgagactgtctctaaaaaaaaaaaaaaaaaaaaaaaattaattaaggtaaaataaaattaaaaaggcattgtgagatataatttatagaccataaaactcacctttttaaagtgtacgattcagtgttttttgtatattcacagaattgtatacctatcaccactatgtaatattagaacttttttttttttgagagggagtcttgctctgttgcccagactggagtgccgttgtgccatctcagctcactgcaacctccacctcccgggttcaagtgattctcatgcctcagcctcccaagtagctgggattacaagtacctaccaccatgcctggctaatttttttgtatttttaatagagacggggtttcactatgttggccaggctggtctcaaactcctgacctcaagtgatgtgctcaccttggcctcacaaagtgctgggattacaccttggcctcacaaagtgaggtgtgaggcttaccttggcttcacaaagtgctggtgtgagccaccacacctggtcatattagaacatttttatcaccacagaaagaaaccctgtacccattagcattcattctctattttctcctcccctcagtccctagaaaccactaatttactttctttttgtggattttcatattctgaatatttatataaatagaattgtacaatacatggccttttgtggtttatttcacttaacacaatgttttcacaatttattcatgttgtagcatatatcagtacttaattccttttcatggccaaataatattccattgtatggatatatcacattaaaaaaatagatggactgtattttaaacgtacaagaaaaataaaaaataaaataagtagaaatgaggtcttgctatgttgcccaggctgatcttgagctaatggctttaagcgatcttcctgccttggcccctcaaagtgctaggatggctacaccacatttcttctacctgtttatcagttgatggacattgttgcttgcattttttttgtttccatcagttgagggattgtttctattttttggctgttatgaataatgctgccataatgggcatggtgtctggcacctgtaatcctagcttcttgggaggctgaggcgggaggatcacttgagcctaggagactgaggctgcagtttgctatgactgtgccactatactccagcctgggcaacagagcaagacactgtcttttaaaacttggggtagcggggagggcgtagataatgccattgtaaacattgtgtatatatatatattttctgtggctgtgtattttcagttcttttgtatatgtatcatatcctatgtttccatatattctagggttttttattaggtcctctctctgttccactgatttgattgttgatcactatttcactacccagcattttaattattggaactttatattgtttgataatgctagtggtccctgtttctgttcttttattttttttaagaaaaaatgtggcaattctgtctttttttttttttttttttagttcagcttctgcaggaatatttggctcttcagttgaactttaacatcatttttaggggcccccctctctccaaaaataattcttttgagattttcactgggttcattttttagtttttaatttcaaattttaaatgtttttctaaatgtgattctaaattagctttttatattcattactgaaacacatttctacattaacatgaaattttattaacatattgagactcaagagaagaattaagcaccttattgatttttcctcttttctttttttagaaacagggcctcactctctcaccaaggcaagagtgtggtagcatgatctcagctcctgccacctgtgcctcttggcctcaggtgatcctcccacctcagcctcctaagtattaataattgggatcataggcgtgcgccaccatacccaactaatttttgtatattttgtagagatggggtcttgccatgttgcccagactggtcttgaactcctggtctcaagcgatacatctgctttggcctcccaaagctttgagattacaggtgtgattcaccgcacctggcccgatttttcctcttatctagaagaatataaagattttctctataatttttctgttattaaaaactttgtttggtggcttatgtttgtaatcccagcactttgggaagctgaggtgggtggatcacttgagcccaggaatttgagaccagcctgggcaacatggtgagactccatctttaccaaaaaaaaaaaaaaaagcaagaaaactggtcatggtgccacaggcctgcagtcccagctacatgcagactgcttgagcccaggaggtctaggcttcagtgagccatgattgcactactgcactccagcctgggtgacagagtgagacactgtctcaaaaaaaaaaacaaaaaaaacaaccaaaacccagcaaaacctttgtggtgccgggcatagtggctcatgcctgtaatcctagcacttgggaggtcggggtggacagatcgcttgagcccaggagttcaagaccagcctgagcagcatagtaaaactctctctacaaaaaataaaaaaattagctgaatgaggtggcacattcgtgtgccaccccattcaactaatagagagctgaggtgggaggatcgtttgagcctgagaggttgaagctgcagtgagctgtgagcctgccactatactccaatctcggtgacagactgaaactttgtgtcaaaaaaaaaaagcaaacaaacaacaacaacaacaacaacaaaaacctttgtggggttatagtatgtttttatattttatttaaattggcttatttatttagagacagaatttctgggctcaagtgacctcctgcctcagcctaccaagtcactaggactacaggtgtgtaccaccacactcagctaatttttcaaacattttaattttttaaatttttgtagagacagagtcttactatgttgcctggctggtcttgacctcctgacctcaagcagtttatctgctttgatctcccaaactgatgggactataagttcgagccattgtgtgctcacttgacgtacttatttgaattgaagtatttaatggtattttgttggtgtttggaaatttgaattttcaaaataattacgttttcctttaaggtgtggcagaatgtgtcttggctcttgggtttgagaagatgagtaagggaagccttggaataaaagtgagtgttattttggcatagttactaaatgagctaatataacccaaaagttgaaaggtgatacttacatgtatgcatagatcttggtattttagaatagtgaagaatcttagagataattttgttcaaactgtttattttgccaatgatgaaactggtgttcaaggatatgagattattggaatttgaagttgacttatctatttaatttaaaagccattcatttattcatttttttgataaatgaattacattcaataaatgaaattcattcaacaaattgaagagagttaataaaatgtgggacttctgattctggtaatggcaagccaagttttttgagccagttctctcactgataacaactaaaatatttggatagaatatgaaaaaagaaatcctaaaggtattgaagaactagcaagagagaggaactgcagatgagtgccagagaattaacatcagcatttgcagctacttttgccttgaagatctttgctgatcaggcagctgtgagccacaattttaacagccccctggaatgaaaggggaaatagtcaaagctcaggccttcccaagatcagaagtttaatacccacattaaattgatactacgtaaggtaaactctttgggtaggatgaacctgaagtaaaactgcccacttccatgagatgatagggagagttaccatggcatccagtaaaacaggggaggaaaaaaaaagagaaagaataaaaaactcagtaaaacctttcattgagttaataaatcacagactagccctcatgtgggatcactgccaacattctcattatctaagtcgtccaggaaacctcaaaccatgaattgaatctaaattagttccagaatggtagtaacctagacaaattttcttctggaggaaagcacctttcttccaggctttgagaacccttcaaataaaattttaaggacacgcagttaaagataaccaaggattaaagaaacaagacaccacaattgagaaccgaaaggaagaaggagcagtaaaaactaatctctgaagaccgccaaaactagatttattggatgcagatttaaccatgtttgttatgtttagagaaataaaagacagcttgggaaccgctttaggctataggaaattacaaaaaagaacattattggcatgaaaaaaaaaaactaaacagaatttatagaaaagaaaaatgaaataaataaaattaaaaattcactcatgcctgtaatcccagcactttgagaggctgagatgggcggatcacttgaggccagaagtttgagaccagcctggccaacatggcaaaacccgtctctactaaaaatacaaaaaattagccgggtgtggtgatatgcgcccgtaatcccagctactcgggaggctgaggcaggagaatcgcctgagcccaggaggtggaggttgtggtgagccaagatgcgccattgcactccagcctgggcgacagagtgagactccgtttcaaaaaaaagaaaatgagttgaagataattttttactgttatctaagattatactattatctaacttatgtgatcaacctgatcccattttctctgttgaaacattaaaggacctctaccccaaattaagttaaatatatatgataatatttcttagaaaccacaaaagtggcacttaataggcattcaaatcaatgagttgtttccctctttaaagaatgcctttaaaaagtggtagaagttaggttggatcttaaagataatttaggagtgggtaaggggaaatgagctcttcctagatgtcagggaaagcatcatgagcctagtcatgggtgtttgaatgaatatgatatacctagggaacagttttaaaaactgtctggattagagtggcagctggagaagactgagaaataaggttgtgtaagtgaatatataatgtttatgatacatgaaaaatatgtatttttttcagcagtgaatggtacatatgctggtaacttttatttgaaaattattaaaaattatagtaaaattcatccataatcccatagtacaattaaaaagaaatatatataaattaaaagtccctccttctgcctttttttttttttttttttttttttgagaccaagtctctctctgtcacccaggctggagtgcagtggtgcaatcttggctcactgcaacctccgcctcctgggttcaagcgattctcctgcctcagcctcccgagtagctgggactacaggtgcccgccaccacgcctggctaatttttgtatttttagcagagatggggtttcaccatattggccaggctggtcttgaacttctgacctcgtgatctacccacctcggcctcccaaagtgctgggattacaggcgtgagccactgcccctggcccctggcccctggcccctggccccttctgtctatttaatcttgtccctcagaggtaaccaatgttaataattaagtatctatatctcctgccattttcccaaattaatacagacacatgtaactaagcattcatatgcatatacacacacacatgttaaaaaacctttgtaaatttactgcctggggtaccccccttgcccatgcctccagctacaaaacaattcaatttttttttccaaaataaaacctcagctagctctgccaaaaaaacaaaacaaaacaaaacaaaaaaccacacataaaaaacctttgtaaatatatagagaagattaatgatattttacatgttactttttcaattaacagttgaacacctttcctgattagaacatattgatatacagtgagccatgactgtgccactgcaccccaacctgggcaaccgaggaaaatttaattttaacaaagtccagcttttcaattctttctctcatgaattgtgccttttgtggtgtatctaaaaagccaatgccaaacccaaggtcatctaggttttctgtcacatgtgttttacatgtaggtctgtgatctattttgagttaatttttgtgaagggtgtaaggtctgtgcctggattcattattttcatgtggatgtccagttgtccctgcaccatttgttgaaaagattatcttttttccattatattgcctttgcttctttgtcattgttaatttttgtgaagggtgtaaggtctgtgcctggattcattattttcatgtggatgtccagttgtcctagcaccatttgttgaaaagattatcttttttccattatattgcctttgcttctttgtcatatatttatgtaggtctatgtgtgaactctttattctgtgccatttatctatttgtctaatttgtctgaatttttttttgtcaataccacactgtcttaattactgtagctttaggtaactcttaaaattgagtagtgtcagtccttctgttgaattttttcacaagtttttttttttttttgagatggagtctctgttacccaggctggagtggagtgcggtggcacaatcttggctcactgcaacctctgcctccctgtttcaagcgattctcctgcttcaacctccgaagtaactgggattacaggctcccaccgccatgccgggctaatttgtgtatttttagtagagacggggttttaccatgttgaccaggctggtcttgaactcccgacctcaggcgatccacctgcctcggcctcctaaagtgctgggattacaagtatgaggcaccgcgcctggccacattttttcacaagctttttagctatctattgagatgttcttattttgtttgttattcttttttagtttgttaatatgatgaattatattgattgatatttgattgttagtctatcccatattctggggtaatgtttggtatttggtcatgatatattatcctttttgtatattgttggatttgatttgttaatttttttcttttaagtgacgggttctccctatgttgcccaggctggtttcaagctcctgggctcgagcaatcctcccgcctgggcctcccaaagtgttgggattacaggtgtgagccactgcgccgggcctgatttgttaaaattttgttaaggatttttgtgtttatgtccgcaagggtgttggtttgtttttttctttccattgtgcaggttggtcttgaacttcagggctcaagtgatctgcccaccttggcttcccaaagttttgggattacaggtgtgagccaccacacccagtctagttttaatacgagaataatgctggcctcatagaatagctgagaagtgttctcctctcttctgttttttggagtagtttatatgtaaattggtatttttttctcttaaatttttggtagaattcaccagttcacatctggtctggtgacttcttttcttttctttaaaaaaaattttttttttttttgagatggaatttcactcttgttgcccaagctggagtacaatggtgcagtcttggctcaccgcaacctccacctcccaggttcaagcgattctcctgcctcagcctcccgagtagctgggattacgggcatgcgccaccacgccctgctaattttgtatttttagtagagacagggtttctccatgttggtcaggctggtcttgaactcccgacctcaggtgatccacccgcctcgacctcccaaagtgagattacaggcatgagccaccgcgcccagccctaaaatatttttaatttaaaaaatattttttttttgcattctcatctttgggtcatggcctggtgatttctttatgggaaagttttcaatcttctgagtttatatataaatatattactattgaggttgtctattttttttgtaaagtgagcgttgatagtttatgtccttcacggaatttgtccagttcatctaaattattaaccttattggtaaaaagtcattcatgttattcccgtctttttaatgtaggatctttggacgtgtcttttcccttcccttcttctggtgttggtaatttttatcttctctctttttccatggtcatcttttgtcagggtgatcatggaaaaagaaagtttacaataaaacgaccagcttttgtttttactgattttcaattttttttttttttttgagacagagtctcactctgccgcccaggctggagtgcaatggcatgatctcagctcactgcaacctctgcctcccgggttcaagcaattctcctgcttcagcctcctgagtagctgggattacaggcgcctgccaccacgcccagctaatttttttatttttagtagcgacggggtttcaccacgttggccaggctggcctcaaactcctgacctcgtgatccgcccgcctggcctcccaaattgctgggattacaggtatgagccatggcgcctggcctatattcttttttctagtttattctactcacttctactcattctttttcattctgctcattttctatttcaatctgctctcattcttgatgtttcctttcttctccttactttgggtttaatttattctttattttaaattagccacgcccagctaattttttgcagagacggaatcttgctatgttgcccatgctggtctcgaactcctgggctcaggtgggccttccacctgggcctgccaaagtgttgggattacaggcatgacccaccatgcctggctactatgtatatgtgtgtgtgtgtgtgtgtgtgtgtgtgtgtgtgtgtgtatatgtgtgtatatatatgtatgtatatacatgtgtatatatgtatgtatatatatgtatatatgtatgtatatgtatatatgtatgtatatatgtatatatgtatgtatatatgtgtatatatgtatgtatatatgtgtatatatatgtatgtgtatatatatgtatatatgtgtgttgtgtgtatatattatgtgcgtgtgtgtgtgtgtgtgtgtgtgtgtatatttatttatttattcattcccaagacagagtctcactctgtcgcccaggctggagtgcagtagtggtgtgatctcggctcactgcaatcttcacctcctgggttcaagcagttctcccacctcagcctcccgaatagctgggactgtaggtgcataccaccacacctggctaatttatgtatttttagtagagatagggttcaccatgttggccaggctggtcttgaactcctgagctcaagtgatccacccgtctcagcctcccaaagtgctgggattacaggtgtgagccaccacgcccagcctatttcctttggttctttttttttttttttttttttttaattatactttaagttctagggtacatgtgcacaacgtgcaggtttgttacatacgtatgcatgtgccatgttggtgtgctgcatccattaacttgtcatttacattaggtatatctcctaatgctatccctccccccaacccccaccccacaacaggatggaatagttactggcacatactggatgcccaataaatatttcttgaaagagttaatacctctttggtcacttgattattttttcttcttcccatgtttccctgtggagcatgtcttaactgatttgattcacattgacaatttctggtgtactatgtgcttagaataaataaatatcttaatagcactgtagtagttttgaaagagacacttatcatgtcagctgcttatgaaattttgttcccccctcttagttttcagatagaaccattcccactgataagcatgttgacctcctgatcaataagtatggattgtctgctcacccagttgctcctcagatgtttgggtatgctggaaaagaacatatggaaaaatatggtatgttacagttaaaaaactttgaggcttcttactagttatatacatgagatgagaaatgacagttatttattaaggaactgtggaggatgccaggatatataagatgtaaaatgttttttgaattaaatcgaagtaatagttcttgtagaacttagtcatagagaaagtatttatatatagactatggtatgggaagtacctagagtactctatagcaggaagttgaaataggaaaaataacacaaatcttgtctcctttaatcatggactataaattatttttttccaagctgagggtttcactctgttatgcaggttgggtgcagtggtgcgatctcggctcactgcaacttccatctcccaggctcaagcgatccttccaccccagcctctcgaatagctgggactacagatgtgcaccaccatgttcggctaattttttgtatttttggtagaggtggctttttgccatgttgcccaggctggtctcaaactctgagctcaagtgatccacctgtctcagcctcccaaagtgttgggattacaggcgtgagccaccatgactggccatggactataaattgaggatcttaaaatgtcaaccaagaagaggtgaaagatcaagctattcatactctacattcaatatatcagcaagccttttctctatattctcagtctatccatttctcaccatttctgctacttttgctgtagtggcataatttcgcacctgaaatttaggagtgttctaactggtttctctacttctgcttgtgcacctccagagtcaattctctactttatagccagagccatgcttttaaaatatatcagatcatttcactcctgtgcttaaaattctccattgtttctcatgacattcagattgaaacccaaatgtcttcttatggcctatgagcttctacatgatcattcccttcaccctcattagctctctgactgtatctccgaccattttttctttcactagtctgctccaaccacactatcctttctttctgttcctcaaacacaccaagcttttcttcaggtagggccttagcttctaccctaagattgtcagagccagctcccttgcttccatcaggtctttgcttaaaagccaccttctgctttctttcatcactctccttcccagaacttcctattcactatctcctgctttatcattttatatggcacctataataatctgacatatatctgacacatacatatatgtcagattattacaggtgccatataacatgatatatatatatatattcttgtttattgactcttccaaccagaatataagttcaacaaaagcatggatttttatttgtcttatttcctgcacattgattgttaacctagaatagtacctggctaaaccaaggataaaagaaaaaaaaaaaaaagaatagtgcctggcacaaatcagtgttgtgtaattaattcatctttaaaatttagaaagaccctccatgactattcaaatcaaagtagtcccctcctgttatcctctttcttagatagcttcatattgcttccttcatagcacttagcactatttatgttcatatatttatcatatgtgattttacttgtttaattttcatcttccttattagtctataaactccacgaaagcaggtccatgtctgctttgtttaccttgatatacacagccaagcacagagcttggcatgttatttaaccagaaagaagttttttttttttctttctcttctatagtctgcagcatatttaaatactcaagaaacatttattgaatgaaggagtgaatttccatatgtatgttatcttattcagctatcacaagaatccattatcggaggtgttattatctcattttataccagaagaatctgatattcagacaagtttttgaccaggatgatagggtcaataagtagcagagcctatgttccattctatttctgtctcactcaaaagcccttgcgcagccctttctcccagtaatagtagctgctctttgttgcgtgcctcacacatcttagatattttacacaccaaatataacaactattttaagaggtaagtgtatgcctatttttcatatgaggaacctgaagcttggagaatttgagtaacttcttctaataggtgataggagagggtttcacacccaaatctgccatactataaaacctccattcttttcattgtttctcatatagctatatttaattttaaataataaaaagcttttactgtatattaacttttagttttcttgtcattcctgtacatagttgagggacattaagtactttttgttagcatttattataggtacagaaacatgttttgcttgaaattttcatttgtgcttggctttccttttttcttttttgacctattttgtgaaggggaaggaaaactgaatattgtaatagcatttttgtttaaaaatcataaatattttaaattacttaattagataatgaatgtggccagattataatttgaaattaaatttgtttatggttgtcatttgaaaggtttgtcaaatttttttcttttctctctttttttttttttttttgagacagagtctcgctctggagtgcagtggcatgatcttggctcactgcaagctccgcctcctgggttcacgccattcttctgcctcagcctcccgagtagctgggactataggcacccgaccaccacacatggcattttttgtatttttagtagagacggggtttcaccatgttagccgggatggtctcaatctcctgacctcgtgatccgcccaactcagcctcccaaagtgctgggattacaggtgtgagccaccgtgcctggcccaggtttgtcgattttaaaagatgatatgcttcatttttagaggtatattgtaatatactttaaaaatattttgtttagaagtaatttcagactgaacaagaatgttgccaaaatagtacaagaattcctaatacttttcctctagattttctaaaaattaacattttgccatgcttgttgttttaatgaattctttttacctatattgctatgtaatttttaaaaaatgtaaggctgggtgctgtggctcacgcctgtaatcccagcactttgggaggccaaggcggacggatcctgaggtcaggagttcaagaccagcctggccaacatggtgaaaccccgtctctactaaaaatacaaaaaattagccgagcctggtagtgcacacctgtagtcccagctactcgggaggctgaggcaggagaattgcttgaacccgagaggtagaggttgtgagccgagatcgcgccactgcactctagcctgggcaacagagcgagactccatctcaaaaacaaacaaacaaacaaacaaacaacaacaacaaaattaatttaaaaaagtttgagagtaagttgcagttctttcatagtcactacagtgataaaaattgggaagttaatattgatatgatgctattatataatctacagacctcattctaaatttcaccagttatctcactaacatctttttctggcccaagagccctcatagtttttctttttcagtgttttcttgcctccatttatgcataggttatgtgcatgggttttttttgttttctccatttgaactttactctcaatttgttgagctccataaaaaatcttattggtatttttactaggattgtattaatcttgttaatttagggaaaactgatgtatttatgaggctgagttgtcctgtcaaagaacagggattatctttttatttattcagttctgtctttgtgtctttcaggagtgttttaaagttttcttcatatctaagtgttttatttcttgttaaacttattcctaaataccttctttaattcctttaatcatccttgctgctgctattgcacatggacttttcactggtgttatatcctccaaggtggtcgttgcttgtgtatacaaaggctactgatttttttttccccccaacatggagtcttgctccgttgcccaggctggagtgcaatggcatgatcttggcttactgcaatctccatctcctggattcaagcgattctcctgcctcagcctcccaagtagctgggattacaggtgcgcatcaccaagcttggctaatttttgtagtttttttttttttttattagagacctgattttaccatgttggccaggctggtcttgaactcctgacttcaagtgatccacctgcctcagcatcccgaagtgctgggattacaggtgtgagccacatacctggccagctattgagttttatatattaatcttatgacttgctatctcactgaagtttttaatttttgagttagttttattattgattttacttataggggtttccacatatgcagctatattatatcatctacaaaaagagatggttttactacttcttttctcattgtaatatttgaactgacttatctaattgtatttgcaaataccatcagtacaatgttaagtagcagtggaagacagtaagcatccttgtcctgttcctgatcttggtgttttaagtaaggtactgagttaagcacatagatatatctattatatgttgaaaaagtatccgtcagtgtctattttcttgagtttttttttttccaggaatgggtattgaattttgtagcttttccagtatctatggagataattgcattatgttccccacttagatctatggctggactattttagtaatggattcctaacagtaaaccaagtttgcatatctggaataaatgccggttgatcatggtgtattgctgtttttaacatggaattaggttctgttgctattattttatttagtaatttcaaatcattatttgtaagtgatatatatatatatattttattgttatcaagtttgggtgttaattttatactaaagaaataggggccagttgtggtggcttacgcctgtaatcccagcactttgggaggcagaggcaggcagatcacgaggtcaggagtttgagaccagcctggccaacatggcgaaaccccatttctactaaagatacaaaaaaaaaaaaaaattagccggcatggtggcatgcacctgtaatcccagctatttgggaggctaaggcaggagaatcacttcaacccgggaggtggaggttgcagtgagccgagatcatgccattgtactccagcctgggtgacaggacaagactccgtcttaaaaagaaataggagccacgcacgatggctcatgcctgtaatcccagcactttgggaggctaaggtggacggattacctgaggtcaggagttcgagatcagcctggtcagcatggtgaaaccctgtctctactaagaatacaaaaaaattagtcaggcatggtggcaggcgcctgtaatcccagctactcaggaggctgaggcaggaaaatcggttgaacctgggaggtggaggttgcagtgagccgagattgtgccactgcactccaccctgggcaacagactgggactcctcaattaaaaaaaaagaaataggaagctattttaatgctctgaaacaatttatggaactttgaaaccaactgctttgtaggtttggtagaattccttgtgagataatctgggcctggttctttctttttggcttggtaatctattttttttttttaatgtttaaacattctatatccaatggggccaattttggtagtctgtagttctccaggaaattatccacgtcatttagattttcaaatcaatttgtatagaagtctgaaaagtagtattttaacaatgtaaatttttatttctatttcaatgatattctcctcttgtcatttgtttattttgagatggagtcttgctctgttgcccaggctggagtgcagtggcactatcttggctcactgcaacctccactgttgctgtcaattgctatgggattgaacaaagggggacaaatgcagaaatgaagagaaagacaaaaagatctgttttgaaagaaggggtcagggggctccttgcttctagtgaacaagcaccctgagcttttacagcccttcatatttattaggtagaaagagcagggaggcagaggtaactgttggtccgctgcttgatttatcacaggtacacacaattgctttctttgtacaacaggtttccgatgttcctatagataatcacaaggaacactgtgcttggggtgtgactgccctcagcaccccttctggcagcagatgcagttgtcagttttccaacatcctgctttcatccagtttcctgtttgctcatatagcctccagtggtatactgagtcagtcacgaccctcactcttttggcctgtaacactctgcctcctgggttcaagcaattctcctgccccagcctcctgagtaactgagactacaggtgcgtgccaccatgcctggctaattttttgtatttttagtagagatggcgtttctccatgttggtcaggctggtctctaactcctgacctcaggtgatcggcccgtcttggcctcccaaagtgccagattacaggtgttagccaccacgccggcctctcttgtcatttattctttgtgtgcatttatggtttctcccttttcccttgatgaaattagctggtagtttgtctcttttgttaaatttttcaaaataacaggattttgattaattatgtctattctttctattctttaccctcattcatttcttcatcttcctggtactttcttttggtttactttattcttatttttagttttttgacttggagaattcaatattttatttcttgttaatataacagctttattgaggtataattcttatatcatataatttactcttttaaagtgtacaattcagtgatttttaatatattcacagagttgcatgaccatcaccatgattaatttcagaacatttcattaaccaaaaatgaaaccctgtacccattagcagtccattacctcctcttctagttcctggcagccactcatctactttgtttttctttggatttgcctattctggacattttatataaatgtacagttggcccttgaacaacagggggtttagtggtactgacctgcacagtcagaaattcatgtataacttttgattccccccgaatttaactaatagcctgctcttgaccagaagccttagtggtaacataaaaaattgatttacacatattttttatgttacatatattatacactatgctcataataaagtaagctagacaaaagaaaatgttattaaaatcataaggaagagaaaatatagttactattcattaagtggaaggtgatcatcttaaagatcttcatccttgttgctcttcttcttcatcattttcttgttgagtaggctgaggaggaaggggaaggttggtcttgctgtcccaggtggcagagacagaagaggtggaagaggaggcagaagaggcaggcatacttgatgtaactgtcattgaaaaaagtccccttatagtggacccatgcagcttaaacctgtgttgttcaagagtcaaatataatcaatatgtggcctttctggatatggtgatacacacctgtaatcccagcactttgggaggctgaggcaggtagatcgcttgagcccaggagttcaagaccagcctgggcaacatgatgaaaccacaaaagttagctggtgtggtggcacatgcctatagtctcagctacttgggaagctgaagtgggaggactgcttgagcctggaaggaggaggctgcagtaagccaaggtcgcacctctgcattccagcctggttgacagagtgtgaccctgtttttgtttgtttgtttgtttgttttttctaaaaaggccaggcacagtgactcacacctgtaatcccagcactttgggaggctgaggttgggggatcccctgaggtctggagttcaagaccagcctggccaacatggtgaaaccccatctctactaaaatacaaaaattagccgggcgtggtcgcgtgtgcctgtaatcccagcaactggggaggctgaggcaggagaactgcttgagcctgggaggtggaggttgcagtgagctgagattgcacctctgcactccagcccgggcggcagagctagactccatctcaaacaaacaaacaaacaaacaaacaaaaaaagtggccttttgtgactggcttctttaagttagtatattttcactgttcattcatgtcatagcatgtattaggacctcattcctttttactgcttaataatattccttatgtcattcatttattcttattaataaatggttagtggtatatattttcctgattactgtgttaaatgtatcacattgattctgatatgtagtattttcattatcattattttctgacaagttctataatttccatttctattttcattttttacccaagaattatttcatggaaatattttttaaatttccaggtggacttttaattttattagtaatttctagttttattgcctggtgatttgagtgtgttgtttgtagactgaggggattcttagttctatggtgccctcttctgtaagtgtagtagaatggggtcttgcaatactacccaggctgactctttttaggtgcaatcatggtgcaccacagccacaaacccctgggctcaggcaatactcctgtctcagcgtcctgagtcgctgggactacaggtgtaccttgtcctcttttgctgcttttctccttcaccgctcaattgcaccatacaaatgtcctcttacatacaaatgtcctcttatgctgcttttctccttcactactcaattgcaccaaaagggaccttgccctttcattttgcttttttttttcctctcagaacttatacctttaagattcccacctcagatctcctgtgtttttcagcccattccatatagtcatggtttgatctataggaatattttcttggtattttcacacttggggaggaggtctttcttttcttggtagtttagagcagttgttggcctgcgattatctcccctcttctctgcacagtttcctcagcctgcccatgtacccttaaaggtttgtgtagaaacgtgagcagttgttggctgggatttggtcttatatattttttcttttctttttcttttttttttaacttatagataatttgaaatttggcattttctattttctagttatgctgagagtatgatttgtgctattttattttttctggttattctgtattggttttagaggctatagagagacacagatttttttttttttttttttttttttgagacagagtctcagtctgttgcccaggctggagtgcagtggcgcaatctcagctcactgcaagctctgcctcccgggttcacgccattctcccgcctcagcctcccgagtagctgggactacagatgcccgccaccacgcctggctaatttttctgtatttttagtagagacggggtttcaccgtgttagccaggatggtctcgatatcccgacctcgtgatccacccgcctcggcctcccaaagtgctgggattacaggcgtgagccaccgctcccggccgagagacacagatttacgtggcctccatttttcctcaattacctggaaatcctgttactgatgtgtttttaagtgtatatattttctcaagttttacattgctcagaataattggacagttttctagtctaaaatttgaaatataaatgtacactattttagtggaaatgtcattgtagggaacaagggccttgaccctctgaaggttcactgaaaatcacttacatgaggcagattaacaggagaaaaggcatacaaatttatttaacgtgtgtacacgggaacattcagaatgaagactcaaaaaaatgggaaattgtccatttttatgcttaggttcaacaaagtatggaacagccctatagaaatatgattggacaaaaagcatatgatctaatgctaatagactgagtggagaaacccagccaggcctgtccatctaggttcttcttggcctctttgagcacacattccttccttctgggcgtggggcaggtccctttctggaatgggggtcttatgacccacagtcaaacaagataggtcagatagtttgtttatgaccagtttttacacagaaaggtggaggaagttaaagtaatatttctaggttttatgactggctttggggaaaaggagttctggtttctatgacctgccttggggaagagggattctagtttctatggttagcctcaggagagaatgggcctgagagacaggagggtaggagaaggtcagtgaaaaacttttgcttctgaggctatcatttgggggtattgtttctttattcttcattcgacagatttctaaatgaattgtagaattttatataatttaaattgttatttaaaattgctgtttgtgagtgttctgaatgtgcactagaaatgaatatgtaagaaagcttatagtagtttaaatcatttgtagaaccagccgagtttgtggtttcataattaaattataggatattaaaatagtttgacataaaggcatagcctttgaatagtcaaaaatcttaattggcaattcagaatcagtagtcaataagcccttcatcagtggccaggcttaataaatatgtaagtgactggcagaatatttttcaaggggatgctgtcttttattgattaatcagatcctatgttacgaaaaaaggaagaaaagatacgaacattattgaacatctcttatgtcagacaccatgccaagtactttactgttttagccacccttcttcctaccaatctatgcatggattgcttgcaaatctaatagagacaataaagcatgtgtacttcctaaaacaaggaatttgtcaccaactgaggccaccaatcccaatttttaggagattccaattgttacaattccctttttcatgttgaacccaaatctctcaccctatggtttgcatccatggtcttgtttttgtcttctgagaatgacagaaaaagcctattttaccttgtagcccttcaaatatctgaagccagcctgaccctatatttaatttcttctcttaactactctcattagacttgtttcataacccataagcagtctaattgctgtactgtgatcccatgtaagctattctgctagtcacatcacactatgaaatctcactgagcttgaggtttctcatagttgttgctcatttttgcaggttgttgtgggagttcaagaatagaactgagtgtttaatttatattctgatccatcctattgatagaccttgttgaaattcaacattatagcagtcccttccagctttaggtttggtgagagagcctctagttttcttactcactttgtaatagaaatattaacaagaccagagctgaggttagaagttagtgctagaaacttttctctaggtcaatgcattaattaatgcctgttgtttcacatgagtgtaatattgggaaatgcttcatactttaatcctcttctagatggtcataatgcacatagtgcaatagtaaaggctccaaatgtcttacagtaaagacgtgtttagctttgtttaaccatagtctaaacttatttgacagaagaaccctctttttttttttttggtaacaccaaaagataaaaatgaaaataaccccccaaaatcccacactacgatatttccttatcttgtccaaaatgttttgagaaatttcgttaattttcttgctgctgtccagatactatgttttctttgatctaacagtcaattcagtcacgaaaagataacacataatttgacttgtcttattcttattgaacccatattggcctcctcctgatcactattctttttttgagatggagtctcacgctgtcacctaggctggagtgcaatggcacaatctcggctcactgcaatctccgtcttccgggttcaagtgattctcctgcctcagcctcccaagtagctgagatgacaggtgtatgccactatacctagctaatttttgtgtttttactacgcctggctaatttttgtagttttactagagacagagtctcaccatgttgactagtctggtcttgaactcctgacctcaaatgatccacccaccttggcttcccaaaatgctggggttacaggcatgagccatcgcgcttggccctgatcactatttttattgttagaagatcacaagtgtggaatttatcttctctttttattagaattgagataagatttgcttaattatatgtatgtcatttttgctctgaagatcatcctccttgatagagaagagagagataaaacagacatggggaactttgtactttactgtgccattaatataacattatcagctctaattggtggctttcttttttctttggcctttacagcaccaaatgagaattcaaagcatattttattcagttttatctttttaaaagtagtaaaaaaaaattttttttgcgtgttttacctcattactgtacttttttttgttttcctgacacgattatttaaattttctgttaaggaatttaaaaggcatacatatttcttatcaggatataactcttctaaaaacttttctgttttatcataaggaaagggaggaagatgaaatatcttatcatgccctggagggtgtgagttgtgtaaaattctctcagtctagcgtactggggtgtttgacagactcctagaggaattgtagtgttctcctgccttaaaaccaccatgtttcttgtttttgaaactgggttctacttattttaattagaatagatcagtttgaactgtttttatcttatgtgcctattagttgattcagttcgttaattaggcccacatttaattataaataaaaattttttgagggaacagtgctgaagtctttaatactgatgatatatatgaaagggaaaatatggagatatttagcagaacactgagtaccattgcaagatttgttaataagcagcggaaaaacattcacccactggtagatgtttgctttctttacaggaacaaaaattgaacactttgcaaaaattggatggaaaaatcataaacattcagttaataacccgtaagtatttcagagacatgaaataatgaaaatctgggttatcctactgtataatatgcaactttatacttgaaaagcaaatgccaagatctcaaatattttaactagaatgttttatttttttcttacaaaaggcttatacgcaagtaaacttttgacaacttttcagttccagtttttggccactttatatttagaatatcatttaggctaatgaccctttttcttttttttgagacagagcctcgctgtgtcatccaggctggagtgcagtggcgtgatctcggctgcctgcaacctctacctccctagtagctgggactacaggagccaccatgcccggctaattattattattattttttttagatggcatctcactctgtcacccaggctggaatgcagtggcatgatctcggctcactgcaacctctgtgccctgggttcaagcgattctcctgcctcagcctcccgagtagctgggattacaggcacctgccacagcacctggctaatttttgtatttttagtagagacagggtttcaccatcttggccaggctggtcttgaactttgacctcgtgatccacctgcctctgcctcccaaagtgctgggattacaggtgtgagccaccgcacccagcctgtatttttagttgagacgagcttttgccatgttggccaggctggtcttgaactcctgacctcaggtgatctgcctgccttggcctcccaaagtgctggggttacaggtgtgagccaccatgcctggctaattgtacatttatttaaaagctccattagccttaattaatgtacttgtataatattatcggctcaaaagttggctgaattgcaggtgatttgattttgcttttaaggaactagtattctttaatttgccaggaaacataaatatggtattctgttttaatccccaactggtctaacaccaactgggtatattgcaactcaattctggcatgaagcgcctaggagttaatgcaaactccatgaattaaggacccagtcctccacaagactgctcatacgtcagacattagctgcaagtgggatgcccatgccacccatattttgaccaactgaccacaaatccaggggctcccatgactccctcagattcaataattcactagaacaacttacagaactcaggaaagtacttaaaattacagttttattataaaggatataaatcagaaacagtcaaatgaagaggcatatagagtgaggtctgggagcatcccaagcaaagctttcttgccttttccctatggagtcagggcatgtcatcctccggatacatcaagacgttcaccaatcaggaagccccgctgaacaccatgtccagattttttactggggcttcattatgtcagcatgctagattaaatcactggccacataactgaactcaatctccagccttcctcttcttctcagaggttgagctggctcaaaagtctcaactctgtagtcacatggttggtcttttggtggtcagtctcccattttcaagataacaaggcccaccataagtgacctcattagcataacaaagacacttctatcattcaggaaattccaagggctttggaagctccaagccaggaacccaggacaaagaccaaattttaaaaaataaaacatactgtattttagagttaggattttttaaaaggtcaattcagatgacatttatggctattcataaaaatctgtcttctggttgtgaaaataatatttacatattattctgtttcttactctgcaacaaaaattacagttgctatctcacattctgtaactaatatttattttgtatttaggtattcccagttccaagatgaatacagtttagatgaagtgatggcatctaaagaagtttttgattttttgactatcttacaatgttggtaagaaaaatatattttaacatttaatgagggaagtaactgctgcccttcctgccacccccctgtggttaaaccttaggctctgcatctgggcggagctttcacagaactcctcccagtgccgtccccactctgggtcacttcactagagtaccctacttcttactcctgcctggagacagactgtctcttctcttggaaaatgatgtgttttacttcttcttgcaggacttctacctactttggtgattgcaattgtatttattcattaaactgtggcttgggggccagtggagcccaaagcattttgttttccctgctatgtacttctactacaggaaattctactctataatagtagctatgagtaaaagtaaaacaaggaaaaattcatagctctaatgatgataacagttgtttcttgcaaagtgcttgacagtatctgtctcctagaaaattgagtgagtactgcttagctcctgcctgtgtcctagttaacacctggctgtgccctgtagatacaggctgggatggaaagaaataagtcgggtcagcttttatttgttgtgatatgagggtctgcccatttagaaagtctaactgaactcccagaagacttcttgtgtttgctaccttccatcacagtttgctgtaagaaaaagatctgtttaagatctcgagagtcttaactaaagcagatggttttgtattcccaagctatcttttcccagtttccaaaaggatttcaggactgagttatttggagatagcaaagttggagctggggcggtctgtagtagaatctttattgtattaggataggaataaccttttggacttactcctcagaagatgccttatgcatctccagaggcaaattggtaattctttgcaataagaactttttggggctgggcgtggtagctcacgcctgtaatcccagcacattggaaggccgaggcgggcggatcacctgaggttgggagttcgagaccaacctgaccaacatggagaaactccgtctctactaaaaatacaaaattagccaggcgtggtagcgcatgcctgtaatctcagctactcaggaggctgaggcagaagaatcacttgaaccggggaggaggaggttgcagttgcaatgagccaagataacaccattatactccagcctaggcaacaagagcgaaactccatctcaaaaaaaaaaaaaagaactttttgggactcttagattccaagtagtgattgacaacatttaagttcttgatagaggttcagtcctcaggtgggaagcatgtgtgatttacaactgtagatatcacaaagaagacaatccactgaccagcaagcatatttggcctttcctttcacatagaagtaactcctagtctgaaatcctccgatcaggtgctactgggtgtggagaattatttttacttcctcttagtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggtatgtctgagattctatttgttatttttatttttaagatggagtctcatgattcttgtgatggagccatgcattattatataataacttttaattaactagacatgctatttgtcattattttaagttgactatgcctagaactccaatcttacagagttaagggaaaaatgattgttttgttttgttgttctttcttttcttttctttctttcaacagggtcttactctgtcactcaggctgcagtgcagtagtgcgatctcagcttactatagcttccacatcccaggctcaatcaatcctcccacttcagcctcccaagtggctgggactacaggcacatgccacgactgccggctaatgtttgtattttttgtagagacacagttttgccatgtttcccaggctggtcttgaattcctggctcaagtgatccacctgcctcagccttccaaaatgctgggattacaggcgtgaatcaccacacactgccacaaagatgattttaatgaactttcttgaccctcagcactttaaaaattctgaataaagattgagtacaaaatggaaaaagtaaaaaagatgaaaattcagacctagagttagttgaatatttgaagacatacacacaatacacaaaattgcatgctaaattatagtttacaaatgattttacaacaacactgtgaactggaaaatgtttttgtaactgcccaagatcacagttaggttgtggcagaggtggaatttatatttaggtttcctggttatagtacatttttcattataccacagttttatttctttttctttttctctttgagacaggatcttgctttgttgcccaggctggagcgtggtggtgcgatcatagctcactgcaacctctgcctcctagtctcaagcaatcctcccacttcagcctctcgagaaagtgggactacaggcatgtgccaccacatctggctaagtttttgtattttttttttttttgtaaagacacgattttgccatgttacccaggctggtcttgaactcctggactcaagcgattcacctgcctcggcctcccaaagtgccaaagtgctgggattacaggcatgagccaccacgcctggcctcaccgttttattccttgaagaaaagttattttattatttgaggagaaaaacatgttaagaacatggactttggaaaaatggtttgaatcctagatgatcttctaaaagaagattgtgtcattttatatagaaattctcccatatttttcagtgtatctgactcataatgatctggtaataaatgtcttcaacttgtttatcacaactatacattgtagtttgacagaagttttgtaacttagcacaagatatgctctgaggaattctaggtcctttttatatattttatttaaaaattctgtcattttttagtacaaaattgaatatgtacatccttctcctagatgttattttatttagactttctgtgtaatatagaatcaattgactgaccctccttccctccctccctcccttccttcctccctttctttccctttccctttcctctctttctttcttttcttcttttcttcttctcttctttttttgtttcttttttgagacaggatcttgctctttcatccaggctggaattcagtggggtgatcctggttccctgcagccttgacctcctgtgctcaaacgatcctcccagctcagcctcccaagtatctgggaccacaggcacatactaccacgccaggctaatttttaaattatttgtagagacaggatcttccattgttgcccaggctggtctcaaactcctgggctcaagcgatcctcctgcctcagcttcccaaagtgcttggattataggcatgagccaatgcacctgggcaaaaatttaatatatgtggtcaattatcagttgttaaggttatgcatctattaatctcttaaaatacttgtttaaaaggcccagttttggtgccctttatttatatatggttttggttttaggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggtaacatctttgaatagggcagattaattcagtaaatttcactgagaaaacttcactttgaccgttagataaaagaattcactattcacttttcccttaacgttggctctgccacactgtgggaaatgaatgtaagctgttttggtagtggacgttttagaacttgtggtattaggcagtaccaacactaagatgatggagtgtccagataatttgtattatgattatattatttgtctggaaggctcttttatctgaccaaaatagctactccatctttcttatgcttattctttgcatgagattttattcatttgctttcaacctatttatgttaatttatttaaagtgtatctcttataggcagcatgtaagcaataatttttttttgttttttcgtttttctgagacggagactctctctgtagcccaggctggagtgcagtggtgcaatctcagctcaatgcaacctccacctcctgggttcaagtgattctcctgcctcagcctcctgtgtagccgggattacaggcacctgccaacacgcccggctaatttttgtatttttagtagagacagggtttcaccatgttggccaggctcatctcaaactcctgacctcaggtgatccacccacctaggcttcctaaagtgctggaattataggcgtgagccactgcgcccagccgtgataatgtattttttaaaatctactttgttgatttctgccttttaactggagtgtcgaaacctgtgctgataatgacagccactagctatactttagtctttgaaatgtagctagtccaaattgacgtgtgctgtaagtgtgaagtacacatggagttttggagacttaatattgaaaaatagaatgtaaagtatttcattaataatttttttttttttttgagacagagtctcgctttgtcacccaggctggagtgcaatggtgtgatctcggctcattgcaacttctgcctcctgggttcaagcagttcttgtgcctcagcctcccgagtattacaggtgtgcatgctaccatgcccagctaatttttgtaattttagtagagacagggtttcaccatgttgcgcgggctgttctcaaactcctggcttcaagtgatccacccgcctcagcctcccaaagtgctggggttgcaagcatgagccacctggctcactgataatttttttatgttgattacatgttgaatgaaaatattttatatatatataaaatgtatatattaaataaaatatatactagaaaatttaaaagtattgtgtgggcattatatttctgttagacaatatttatttagataattaatgtaattattgatacagtaggatttaggttggtcatttaattatctgttttctatttgtcccctgtaatttttgttcctctgtgcccctcctcttgacttcttttgcattatttaaatatttttagtatgccatttcaacttatcgattgtttttttcaccatatctctttgttttttcttctttgtttatcccagtggttgctatagagcatggtttatcaaccttggcactattgacatttgagctctatcattcttgtgatacagcttgtgcatggtaggatattcagcaatatccctgcctcttacctactaaatgccagtagcaccaccccccacagttgtaacaaccataaaatgtcttcaaatattgtcaaatgtcttctggggggtaaaatctctcccagttggcagggcgcggtggctcaggcctataatcccagcactttgggaggccaaggcgggcagataacgaggtcaggagatcgagaccatcctggctaacacggtgaaaccccctctctactaaaaatacaaaaaattagccgggcatggtgttgggcacctgtagtcccaactacttgggaggctgaggcaggagaatggcgtgaacctgggaggcggagcttgcagggagctgatatcataccactgcactccagcctgggtgacagagcgagactccatctcaaaaaaacaaaaaaacaaaaaactcttccagttgagaaccactgcgataagaattatagtatgcctccttaagcgtctcctttgagttaatattgtaccacttcacataaaatgtagaagccttgcaaccatataggtccattcactgactcccctttgccgtacactgtcccttatgttataattgtcatatgtgttatatctatttacattgaaaaccccaatatataatattataagttttgctttcaacagtcatacacttagatgtctgttatatgtcatgggtaaaaatgtcacacataattttaaagatactaagagggaaaaagtattttatacttatccagatatttatcattttttgttgctcttcattcttgaacacccaagtttttctctgtaatcattttctttagcctaaggaactttttgtagcattttttataaagcagatcttttggagatgaattctcttagttttccttcaactgaaaatgtctttgcttaaccttaattcctaaaggaactctgggctgattatagaattctaggttgacaggtcttttagcacttaaaacatgttgtttcagtcttctgaccgccatagtttctaacgaggagtcatggtcattcaaattgttgtttctctgtatgtgatgggccatttttctctagctattctcaagatttttagcagtttgattgtgtaatgtctaggcatggttttcttttaatttattctctgttgtgttttctgagtttcttaagtctgaaaatgcaaaacttttaccaaatttggcaagttttcagccattatttctttaaatgtatgttctgtcccaattttttcctcctcttcttctggacttccaatgatgcatatattagacctttggatattgtcccataggtccctgaaactgttcactttgaatccccttttctctctgttcttcacatttgataatttatgttgatatatctttaaattcactgactcttccttcatgttctttctactcatgaaccattctaatgagttttctatttcaaatattgtattttcagttctaaaatttccatttggttcattttatagtttctatttctctgctgagagcttacatctttttgttcatttctagtgggctttctttaccttgtagttctaacagctgttttaaagtctttaataattccataatctgggctttcttgggttttgcatctgttgattgtcttttaccttgagagtattggttacattttctgattctttgtatagcaaacaattttggattgtatcctggacagggtgaatgtcctattatatagatcctttggagaatgttgatgtttttgttttagcaagcatttaagccagtatgttctgacaataagttctgtcttgccttctgagggtggtggttaaagtctttgctcagctctctaaatgtatgcctacgtcagagtaagcctgagacttgtacaggtctatacacagaattaggggatcctcttctctggctctctccactatagacttcttcccttactctccagcctgcagagatttcttttcctagttcctttggttaggaagatggggtttctgttagagttttagctacctttgctgtttctgctgccatgctgttccagggctgtgctcaaccttggggcaaagctgttgagagagagagagcctaaaaagaaaaaaagacaaccaggacctcacccttatgcagtggcttctccaagttttgacttgctctataatccccctgcttttatttacttttcagagtcctcaggcagttttttttatttttatttttatatccagtgttttcagttgtaatcaatgcaagagataaactgtagtgaacatattctgcctaatatggaacttaatctaaaagttaaatattttatgtagatacagatataaaatgattactttcttttttttttttttctttgagatggagtttctctcttgttgcccaggctggagtgcagtggcgctatctcagctcaccacaacctccgctacctgggttcaagtgattctcctgcctcagcctcccgagtagctgggattgcaggcatgcgccaccatgcccagctaattttgtatttttagtagagacggggtttcaccatgttggccaggctggtctcgaactcctgacctcaggtgatctgcccgccttggcctcccaaagtgctgggattataggtgtgagccaccacacccagcttttcttctttttttttttttccgagacagttttgctcttgctgcccaggctggagtacaatggtgagatctcagctcactgcaacctccccttctcaggttcaggcgattctcctgcctcagcctcccgagtagctgggattacaggggtacaccaccacgcccggctaatttttgcatattttttagtagagacgggatttcaccatgttggtcaggctggtctcgaactcctgacctcaggtgatccacccaccccagcctcccaaagtgctgggattacaggtgtgagccaccaggcctggccaaaatgattactttcaaacttatactccttgcttgaactgcttctccaacctctagactcaagaatccagctgcctactttttaggggtttctttggatgtctcataagcatctcaaacctaagtccaaaattgagctatggatatttttcaaactttctcctccctcagtcttccccatcctcctgttgcttaaactggaaaccatcaggcttgaattcttttctctctctcacaatcatcattaaatctatctctaagtcctgttggctatggactctaccttcaaaataaatccagaatatgaccacatctcaccacttttgtcactgccagcctagtgcagaacagcatcgtttctcatttatattattgttggagtcttatggctggtcccgtgcttctgccttgtctctccagactgaagctagaatgtgcagcaaatcagttcattaattcattcaaaacccagtagtttctcaactcactcagacgaacaagccaaatatgatctgtcctccttactccccactcccatctctgacttcctctgcttttctctgaatcttctactctgctgcagccacattggcttccttcttcaagcactggaagctcgctcctgtttcagggcctttgttccaaacatacatgatttgctctctcactcccttcaggtctttgactaatgtccttctcagtggaagccttctccgatcactttgtttgaaatataaaccactcacctccatcttccttgtctcaatgtgtcctataccctttccctgctttcttttttcccttggcatttatcaccactttacatatttctttacttattttatatattgtctgtcttttcctcacccctctccccacataacttaaactccatgatagtagggattttcgtttggttcactattgtatccataagttcctagtttagtttttggtacagaacaggtataataattgttttccaaaagcgtatgcatttgttttcctatctatgctaggggagagcgttcatttacagtactttaatctctgaatatttttagttgatgagttcaagataacttccctttggaatcttttaatactttacaagattgtatatattataggaaaagtgtagtgaattattcacttttaggggttagcttgtgtttagtttgctattacttgctacagaaacaatatttagcagtttgtaagtagcaatagtagatagatttatctcttatgactagagcctcagagcaatttccaaggtagaaacataccaaaaaataaaagagagaatgccttagccaatggttttatctataacctagatttaaagccaaattagaagtgtcagtcatctaaaatcctgtgattagtgtatttcattttaccaacagaggaacttttgtttttgaaggcaatataatatattagctgagaacacaggctgtggagccaggctccctgagtattaatcctagatctcttgctgttgccttggttgatttcttaatatctctgtctgttttctcatctaggaaatgagaatgatagcacctacttcataggattgaatattaaattttataaatagtcatcactcagtatctgtggggttttttttctaagacctcccacagataccaaaatccatggaagctgcttatataaaatggcataatttttgcatataacctatgcacaccctcctgtatattttaaataatctctagattacgtataataactacatatcacttcattcacatggattcaatgtagtactcagcacatacaaattgaagttttgctttttgtaatttttttcttctgtatatatatatatatatatatttttttttttttttttttgagacagagttttgctcttgtcgcccaggggtgcaccaccatgcctggctaatttttgtatttttagtagagatggggtttcaccatgttggccaggctggtctcgaactcctgacctcaggtgatctacctgcctcggcctcccaaagttctgggattacaggcatcagccatggtgccctgcctcttctgaatatttttgatttgtggatggttgaatccatgatgtggaacccatggatgctgactatatatacagaaaataattagaacaagagctgacccagagtgagtgctcaaagctattagctacctttgacagcattgccaccatcattactatcattatttggagcgtccacatcttattactttatcgtaaatagatgtggaagacaattttatacaatacatccatttttatttacttcttaagcatctggaagaatgaccaaatgaccaggaaattgacaggaacattgaagccaccaagcatgtgaagtaattttttctttaaccttacttttgtggctcaacagtgttttcagacatttctcttcattttatgaaagtgccttttttctcctgtttttccatatttattaaaaatacttatatagtatatagcagtacagatgaaaatagaaaagaacacattttggcaaaattatgcatttttaaagctgacagttattttagttatagcattatatccatttcagttctattctcctagttctctgaatctctaccatatttagagcaattttggaagtcagagagctctaaggaactaataggagcttttgtttcatacaggaaatgttctgaaaatgtaagtatttattacttttaaaagtgcttatgtcaaattattgttagtttgaactgttaagaaatatttgctccaagaaattcttggctatatggaaatcttataaaagcatatcatttgttctattgttactattaatatttgtgaatactattttttcttctataggacaaggtgcaacgctggttgatagaggagataatacatatggaggaaagtgggtcataaatcctagtggtggactgatttcaaagggacacccactaggcgctacaggtaatgctacatacagatttcatacattttaaaatcattttttccttaagtgtgaatgagttagtctttcatttgaatgaaagattatattctctgaacttggtagctggtgctttaaatgattgtttagcttcaatatttttgatgttccattaagtagagcacacttaaataatcttcattaattgatgagaatttgaattaattaaaactaaattcaggatgtttccaaatagagatcttactagacctgctaaataagaatcatttgaaatgagcatgttatttatatgtagttgtatacatggttgacattgcatggaaattattttctcttgagacaactggactagaatttataaagtaagaattttactatggctctgctgttgactggctggccgtgtgaaactatttttatcagtcaatcactttaacttttaattccttaattataaaatgacaaacttgtacaatgtggtttctgtttttttaaataaaaaattaagcccaaacctcaccatgcaattccttttttctttctttcttttctttttttttttttttgagatggagtctcgctctgttgcccaggctggaaagaagtggcacaatttcggctcattgcagcccctgcctcccgggttcaagccattctcctgccttagcctcctgagtagctgggactacaggcttgtgccaccatgcccagctaatttttgtatttttttttttagtagagatggagtttcaccatgttggccaggctggtcttgaactcctgacctcaagtgatccacctgcctcagcctcccagagtgctgggattaccggcatgggccacacacggccacaacatgcatttttaatatatcacagtctaccttcaaatagtgttatgccattttgtatataacgtaagatttttacagctgcctatctatttaccttctcctatcttttgtgttattgtttccatacacttattcctaagtatattataaccctcacaatatactattattattgttgctttaaacaatctaatatctttcaaagaaatctaagaattatggggatgatcagtgatgttatgggaagtggcaaaataacaacatccaaaaatcctgtcctttataaaagttcggagaactctggcaaaaattgtcaagatcaactttttccataactttaaaaattaaccagatttacaacaatctgttgggagtggaggtggggggtgcttaaaacaacaacaaagaacataatctctgtgagagcaacgagctttgtggcattttcacctgccttaacacctccctctttctgcagctccactgtagccttgaaaacctacagcttgcagtcatggtgaaaattagcagcctagctggcactgagcaagtcagaacagagttggagctctttcaaagccccttccttagagaactgtcattatatgacctgtctgacagtgtcctggtaaaccccacttgaaagctttgtctttatttcacctcactgaaaactcacccagtgcaaagagtattttccctagaggcaattgtcgagaaaaatcagccacaactgttcaacaaagtagctacctcaggtgccaattggggtaaacaacaaaataaccaaaaaaaaggaaaagttggggagtaggatgtccatagggggctttgaaaagatctgatatgttcctgagaatctagaagcctaatggcgtatataaggtcagagttgtgtgcatgctcaggaaagacctgagaaggtcctaagctcacctctggctaaacttggggctctgcacaagcaaaaggcaaaggctaaggtagaattgtaaactgcctggctgagtaccacattatgcaggtagaggtccagtaaagaccaggagactttttagttcagtcatttaaggacatctctgtccagtcagtagctgagggaagagaaaattcagtggccatgtgggacaaagattacagactttatagaattagcttggaaaagtcactaaataaacaaccacaacaataaacagcaacaacaacaacaacaaactgggaaagaggaggatttgatttttagagaagctacattatttaaaatgtccagttttcaacaaaaaaaaagaaagacatgcagataaacaataaagggtgacctatgtacctaggaaaaaaagcagtcaatagagactatccctgaggaagccaaaacattggacttactagacaaagactttaactagctattttaaatatattaaaggaaaccatatataaagaactaaaggaaagtatgagaacaatgtttctccaggtagagaatattaataaatagaaattataaaaaagacaaccaggcacggtgggtcaggagatcaagaccatcctggctaacgcagtgaaacaccgtctctactaaaaatacaaaaagttagccaggcgtggtggcgggcgcctgcagtcccagctacttgggaggctgaggcaggagaatggcgtgaacccgggaggcggagcctgcagtgagccgagatcatgccactgcactccagcctggacgacagagtgagactccgtctcaaaaaaaaaaaaaaaaaaaaaaaaaaattaaaggtataggtggagaagaagaaccatttaagaataatgagagggaatgctcagttagccaaggaaggagagtgtttcaaaagtaagagattaggccacaaaagttagatagataaagaatgaaaagtgtccttcagatttggctgttacaaagtcgttggcaatcttggagcaattttgaagaagtgttttgcatggaagcagatgagattcagaaagaattataagtgagaaagtggcaataatagtgcaggtacacttttagaaatagtggctatgaatggaaagtgatatatatgtaagggatgtacctgaattataggtacgtgttctgtatgaatgaagtcttgggtttgaacctagcctcttcactctctttagtatgtagcttagccagttaatcctagtttcttatctataaaatgggaatatagtacctaccttataaggctgttctgtggattaagtgaggaaatatatgtatgtaaagtatatagtagagtcccccaaaaagagtaggaacacaataacttccagaattcccttcccaactacaaaagggagccatgatggatctgcttaactggttcttgtttgtttgtttgccagtaataaacctcttgttttttttttcttttttcttttttttttccttgaaacggagtcttgctttgtcgcccaggctggagcgcagtagcgcgatcttggctcactgcaacctccgcctcccaggttcaagcgattcttctgcctcagcctcccaagtagccgggattatgggcatgtgccaccacgcccagctaatttttgtatttttagtggagacagggtttcaccaggttggtcaggctggtcttgaactcctgaccttgtgatctgcctgcctcggcctcccaaagtgctgggattacaggcatgaaccaccacgcccagcccaaacctcttgtttttatcacagtatgaaaaataatttttaaccatttttggaaaagaatgttctttaatttggtttttttttttgtgataacagatcaattttaattctagtacctgaagctatacaagggtatgctctataaacttcatgggactgttgtacacacttgataaagtgacaaccgtgcaataccacttagcatctcaaaatcaggaacatactattgaattgcttaaatacaatccacagaattaaaaacaaaatcagatgccatccacagttatactaattatccattaaaagcttacacttaatacttgaaataacaatcaatatctagcagggaatactgaaagtgatttcagagtctcatcctgttgtactctgttgggaaggtttcttgagtagatgtgtgactggccaaagatgggtacaaccaagaccagaccagcaagtaaaagttctaccacagtttctgtagtttccacttgtttttctttgtcagttaaaagtgaacagtgagaattaaatacttatctttacatatacacaaggtatgctatgaaagcgtatctgcttacaaacatataaaaatatttgttaactagtttgataagaaaataatgtataaaagtatatagcaaaaacattaatcatctctgaccccagaaagatcaattccatattttatattacaaacaaaaacagttttagttttttgaatcccttacccagaaatacttgaaaaggaagacagacagaaattattcctttttacccttagcgtggctgtgaaaaagagttaaattaaaaaaccaagtacactcaaatatctaagtcctaaatgagtccaaatatttgaccacgtagaatattaccatcttcaagagtaggagcagtaacacaggcttttatgagcagtttttaatccataaatacaataggcatttggtattttggccaccagaaaacaaaagttgtagtataagtaaaggtctgagatggttcacttttgtagattcaattcagtgtatttaaggttaacaaaggctgacattgaaatgtttaaagataggcaaaaattcacattaaaaaaaccctatatttctatttagagtaacagtaggcagtgtgattccaaaagttaaaaattatttcacaacctgtagcttcagcttggcaaacagcttagattccaaaactgattcatctctattaaaatgtaagcacttaaaaaaagagcatgtctgtgtatatagacatatattttaaaggaatcagataatctttgaagcagccttagtgtttcctttaagtttgtctggaaatgaccattgtattagcttcacagaaaggactagccagcttcttggtctaaggctaacatggtgatcatttgtctaaggctagaaaggtaccaacaagatgtaaactgaggagaggaagagaagatgagggcttttcctggcagttggtagctaaaactgaagggattctagaaaatgacacaatggcagcctttcttgtctttttctttccgtgttggttctggtgaaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaatttggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactgaagcctttaagagttatgctgtagtttgtgtgtaaagaagtgacttaaatcctcctttcagacagcttccttacgcatataggaaacctctgtttcattaggagatgaatatgatatttcattttagttgttcttgttgacatacaacttttttctcttctgaaatagcatgtttttattataatttgcttgattgccattattagatatttttgtcatgccatccactgaaatactcagaaatcatgctttatagtaacaatataatttttcatatctatatttgttattaaaatttagatctaatttttatacaataaaatgcacagttctgcctctcagaaccttcctgctgccacatttgcaccttgctgctctagcctctggggtgcattccatcctttcagcctgcaactagcagagaaaaaaagttacatattttcttgccccatgcataccttgaggcgagcaaaaaaattaaaataaattttaaccatgagggaaatcgtgcacatccaggcctgtcagtgtggcaaccggatgggtgccaagtgctgggatgtgatcagtgatgaacgtgaaatcgaccccaccagcacctaacatggggacagcgacctgcagctggactgtgtctccatgtactacagtgaagccatagatggcaaatatgttccttgtgctaacctggtggatctagaacctgggaccatggactctgctagctcaggcccttttggccaggtgcttaaaccagacaactttgtttttggtcaatctggggcaggcaacaactgggccaaaggccactacatagagggggccaagctggttgattcagttgtagatgtggtgcaggaggagtaagagagctgtgactgcctgcagggcttgcagctgacccactcaatgggctctggaatgggtactctctttatcagcaagatccgagaagagtgccctgattgcatcatgaacaccctcagtgtggtgcctccacccaaagtgtctgacaccgtggtcgagccctacaacatcaccctctccatccatcagtcggtagagaacactgatgagacctactgcattgacaatgaggccctctatgacatctgctcccgcactttgaagctgaccacaccaaactatggggacttgaaccaccttgtctcagccaccacaagcagtgttaccacctgtctccacttccctggccagctcaatgctgacctccgcaagttggcagtcaaactggtgcccttaccacatctccactacttcatggctggctttgccctctcaccagctgtggaagctagcagcatcgagctttcacagtgcccaaactcatcaggtaggatttcaatgccaagaacataatgagacccctgccacagcttatatctcaccgtggctgctgtctttgtggatggatgtccatgagcagttgctcaacgtgcagaaccagaacagcagctactttgtggagtggatccccaacaacatcaagacagctgtctgtgacatcccacctcatggcttcaagatggcggtcaccttaatcggcagcagcacggccatccaggagctcttcaggtgcatcttggagcagttcactgccatgttcccctggaaggccttcctccactggtacacagctgagggcatggatgagacgagagttcaacaaggctgagagcaacatgaacgacctcgtctctgagtatcagcagtaccaggatgccaccacagaagaggaggaggattttggtgaggaggctgaagaggaggcctaaggcagagcccccatcgcctcaggcttctcagttcccttagccatcttactcacctgccccttttctctacctcagaatttgtgtttgctgcctgaaacacaaatctagatctagaacagtgcttagcacgtagtaggcactcaataagtatttgtctgttgaatgtttcctttctctttccactctgggaagcctaggtttctgccactctgggtgaccctgtatttccttctggtgcccatcccttccatctgtccagttaatatttcctcctttttaaaatctccaagaagctgggtctcatccagatctcatttagaaccaactgggttttgaaagcccatgtggataatggccaccatcctaagcccaaagcgaaagatggtagaaggtggcaggtagaagtcactgcaaggaaggggatgggattttccatcctaaaagttttggagagggaaatccaggctattaaagtcataatttccaggtatttctattttccatttctcagcttcaagagaggtgttagcagtattttctccattttcagtctccctccaagctctgccctttggagaggtctgccccactctgtcaagtggaatctttccctctctggctctacctctctcatatattgaattcctccctttcccctgattagagaaggggatcaaggggggaaagagatcagccttggtccctaggcctccagaaatgccctcctaatctccaccttttcttaacccccaaaaaggattaacatccctgactttatgtgggatagtatatactgccacatcagtgtttgagtcattccccagagggaaggggaaccctcctccatcttttttgcaacatctcctatcttccttttgctgttgcttttttcccacttacacttggttttgttctatcctacactacagatttctattttgaacttgctgccttttttcatattgaaaatgtgacattgctccaagagccaaaaataaatgtgaattggaaaaaaaaatgcacagttctcacaaaaatgtgtacactgatgtttacagcagcattattcataatagtcaaaagctggaaacaagccagatgtctatcatcaactgatgagcaaaatgtggtatatttatttttatttttttagatttttttccagacagtctcactctgtccccgaggttagagtgcagtgatgcgatcttggctcattgcaacttctgcctccctggttcaagtgattctcctgcctcagcctcctgagtatgtgggattacaggcacctgccaccatgcccagctaatttttgtatttttagtagagacagggtttcattatgttggccaggctggtctcaaactcctgacctcaaatgatccaccctcctcggccttccagatgtgagccactgtgtccggccaaaatgtggtatatttatactatggaatattttttggccatgaaaggaatgaggtaccgaaatatgctacaatatagatgaaccttgaaaacatttttaaattccatttttatgacatgtccagaataggcaaatccatagagacagaaaatagattagtggttgcttaggactagggaacacaggagagagataactgaagggtatgtgtggagtttctttttgagatgatgaaaatgtcctaaaattgattgtggtgctagttgcacaactctgtgaatacactaaaaaccactgaattatatactttaaatcgataattgtttttgaaaattatatacatccaggtagcaaccagccaaaaccagatcaaaaacattttcattacccccaaaagttctagcctgtctatttccagtcaatcctctggcctccctgaaacatttctctctcactctccaccaccaccaggctgagatgtttgacttctctcgtgatagattagttttgctgatcctagaacttcatataaatggaatcatacagcacatgtatgtattcttttgtgtttggcttctttcactcagcagattataaaattaatacaagtttttctttttatcagtagttcttttttattgccaagtagtattctattgttgaaatatatcagtttgcttatccattgtcctgtggatggatatttgaattgtttcctgtttagggctgcatgaataaaattgctatgaatgtttgtatacaagtctatttggagacatatatttttatttatcttgggttgataacctggagcaaaatttctgggtcataggacagatctatatgagtaactgtcaaaaaggccaggtgcagtagctcacgcctgtaatcccagcactttgggaggctgaggtgggaggattgcttgaagccaggaatttgagaccggcctgggcagcaaagcaagactttgtctctacaaaatattaaaaaattaactgggagcaatagcatgcacctgtagtctcagctacccaagaggccgaggtagggggattgcttgagcccaggagtttgagaccggcctgggcaacatggtgaaaccccatctctacaaaaaatacaaaaattagtcaggcgtggtggcgcacgtctgtggtcccagctacctgtgtctgtccatacttttgcaggtatatccataggataaatttcaaacagtggaatcattgtgtcaaagggtagtatacatttaaaaatcagtgcagattgccaaattttcttcagaaaagattgttatcggcgtatatttccaacagcagagtatgagactgcctcttttccttcagtcttgttaatattggattttttcctcaaatgttaaaaattttgccagtcttgacaggtcatctgtttttcttccctgggtactgaacaggtaacctaaaacaccccaggaagatagaatttactcaatttttaaatattcaaagagagactcgcattcaaagagatacctcaggaaatctgcagtatcctttgataaccctttctaacatttgagtctacactgttggtaaatttttccttttatcattaatctttgagatattatgtctagtgatggtatagcattttttgggaaaaaaattatgaatcttgatgacttgagtggtagtctgaatagggatgaggaattattgaaaagtaaatgtttccttgctacatattgaggatttggatatacttcgaggaaatctggcacatggccattagctgtaatgtgccccaagacagaattcagacttattgaatttatatcacaatgacagttatgagtagcttaaacattttttctctagttacttggataacaaactgcaatagaattctaagagattcagaaaatggtcaagcgaagttccaaaatatgttaagactagtgatgagggtgtaagattctcttctgtaaatggtgttaatttaattgtaaggcagtgctactttggttgggaactcagtattggggaattagctttaaaaattaaagcttcatgatactggtttctgattttgtttagatctggatgaaagtttctacctgccataacagtatcaatagtaaaagaaaattgtagttttcagcatttgaattgagtattcttttgttcattgttagtttaaaaacattaattccttttagatttccattcaggaaaattacattaaacttgaactttttttgattactttgcagtgatcgtatgacaaaaaacacattagtgttcaggtaataatgtcatattttattccagttttcaaagtgcttttacatatactatccaacacttactgaacacttgtttttttttttttttttttgagacagagtcttactctgttgcccaggctggagtacagtggcatgatctcagctcattgcaacctctgcctcccaggttcaagtgattcttctgcctcaacctccggagtagctgggattacagggacctgtcaccatgcccggctaatttttgtatttttagtagagctggggtttcactatgttggccaggctggcctcgaactactgacctcaagtgatccaccttccaaagtgctgggattacaggcgtgagctgtcacacccggcctggtcacttgttttaaatgaataaatgttggacatggtggctcatgcccataatcccagcactttgtgaggccaaggcaggaggatagcttgaagccaggagtttgagaccagcctgggcaacaaagcgagaccctagtttctaccaaaaaaaaaaaaaaaaaagaaagaataagtaaaatttggctttagtttattcttagctatctctactttttaaaaaatccatattaatgtctgtaatctactgaaaggacatgaaagtgcctttgagataaagctcttgacaaaggattattgattgctttgaagctagaagtgggtttttttagtttggccttttgtcgtagttcagcctggccttttaggccttttagaaaggcctctgtgcctttccataggcttcaacctagtgttaggtcctgatcttctgttattcagtcaacatcagttcagtagtgacttattgtgcacccacctcatcattaggtactgtagggctgtgaaatacgaggtctactcatagaccaattcggagcctcctgaagcttttaaaagtatatgttcttgcctgagtgtggtggcttatgcctgtaatcccagcattttgggaggctgaggcgggcagatcgcttgagctcaggagttcgagaccaacctgggcaagatggtgaaaccctgtctctacaaaatgcaaaaattagccgggcctgatggtgcatacctgtagtcccagctactcgggagcctgaggtgggagggtagcttgagcccagtaggcagaggttgcagtgagctgagatcatgccactacactccaacctgtgtggtagagccagactttgtctccaaaaaaagaaaaaaattatatatatatattacatatgttctctctctctatatgtatgttcctgtcctacccttagacattttcttgggtctgggttggtcctaaacaatttatatttttttaaagttccgccagagcttctcatgcatagccagatttgagggctagggttaggatatacaaggtaactactagtctcaggaagtgtataagaggcagataatacaagaacacaaatacttatatatttaaataagtaattataatacaaggcagaatgtgctgtagaagaagtacaaagcagaagtatgaagaggagaaaaagggaaaggaggatggcagggtcatgaagatttgctaaatcccatcacatgcctggtgttttgccagcatttctatctacttgagttttggggaaggagatgcacaaagaggaagcatgtttaaaccaaactgtttgcttttaccaaacaggtttaattccttcttgcctatacaaactctacctttgttattttctcaataataatacactgttctaagtatacttcatgtacaagtgcattcaattttcatatcgatttttctcttttacaaaagaagaaaatagaggcatggagagtttaaatgatttgcatgaagtcatcaagctagagagtggcaaagctaagattcaaacacaggctatgtattcctagcgtccagggtcttaaccattatactgttcttcagtgtcctttcctcactggaaacgcccatcttcaagtgctctctcaaatgctatccaccttatgaagcttttcctgtttcactgattctttccatagattgaattaatctttcccttttctgaactcctatactttctcagtacttttcttttgacatttatgctcatagtatatattatcattatttataggctttaaaaaaatcttccctatttaggctgggtgcggtggctcatgcctgtaatcccagcactttgggaggccaagatgggtggatcatgaggtcaggagatcgagaccatcctggctaacatggtgaaaccccgtctctactaaaaattcaaaaaattagctgggtgtggtggcaggcgcctgtagtcccagctactcaggaggctgaggcaggagaatggcgtgagcctgggaggcggcggagcttgcagtgagccgagatcacgccactgcactccagcctgggtgacagagtgagactccgtctcaaaaaaaaaaaaaacaaagaaagaaaaaagaaaaaaatatcttccctatttaagagcctatgaagtcaggattcatatttcatttgtctctctaccttgaacagtgtgcaatacattgcatatttaaagggatagttgaatatattattgctcctttaacatctagaacgtggcatggagcaaagggaatacatttgtttaatgtgggaagaattaggatcattaggaagaattcattggaagttatattttggccggatacaagagaactttctaacatggcttctcaaaaatggaataggttgcctcctgagagcatgcatttacctgtcagagaggctgtgcacaaaaaatacatgtaacaacttgataggaatgttgtaaggagaattttgcccatctgttgggccttagatttgatgaattcatagatccttttcaattctattataagatgctctgatctcctgtgcgaagtaattatttctttttctgcattcacatagttcttgatgtttctaatgacacgtatattattattctatcctgtgatttttgtttacatgtttcagtacttttaaaggcattataaacttcttaggtcttaagaatttgggtgaaaatgatgtgagaagaagtggaattttaaccaagggaccgagcattttcaaatcaaaccatggcttatctcgtctactctgtaagaggttgccaaaataaatcctaggacgatgactggtaaggcctaaatccaatataaactcttaaaaagccagcaagtcagtaagagctaattagcttttcaccaaaatttcttttttacctttcatcatatcctccaggccacccatccttgtttccattgcccagagttttgcatttttaccactgcaatgtgaggagaggtaaattttatcattaaactctatctgtgccaggacaaatggagcccaggagatggtgtctactctagatacctgttgctagctagagataactaggagaaagccctgaatttctgtttctatttcttttctttttttatttttgaaaccaggatttcgctctgttgctctggctggagtgcagtggcatgatcatggctcattgtagcctcgatttcttgggctcaaatgattctactatctcagtctcccaagtagttgggactgcaggcacgcaccttcatacctggctaattttttacatttttggtagagacgggctttcgccatgttgcttaggctggtctcgaactcctgggataaagcaatctgcccatgttggctttccaaagtgctgagattataggcatgagccatcatgccttctttttctttttttgagatagagtcttcctctgttgcccaggctgaagtgcagtgcaaacatggtgcaaacatgcttactgcagtctctacttcctgggctcaagtgatcctcccgcctcagtctcccaagtagctgggaccacaggtgcacaccatcatgcccagctaattttattttattttttcttttgtagagatggggtctccctatgcttcccaggctggtctcaaactcctgggctcaagtggtcctctctccttggcctccccaaaagctgggattacaggcgtgagtcaccacacccagcccctttttctttcttcacaatttcacggatagaaaattcattgttactgtagatcttagcaacctcagcatgccatttttttcccttaaagttgggaacttccaccttttcatttaaaggaagcacttgtatgcacatctgaatcgccacttcactcctcttgcgctttggggccatcattaagtaaactaaggatgacttgaacacgagcagtacccatcacagtacccatcacagtcattctaataacaaagatagctactaactgactaacgggtgggtgggatgtaccacttggatatgctgggcaaagggatgattcacatcccaggtggggtggagctgaatggtgcgagattttatcatgctactcagaacagcatgcaacttaaaacttatgaattgtttatttctggcattttctattcaatatttttagactgtaatcgactgagggtaactgaaactgtggaaagtgaaaccatggatgtgagggcactactgtattttacttttttttgaaatatattttacatgtgatagataattttgtcaggcctctgagcccaagctaagccatcatatcccctgtgacctgcacgtatacatccagatggcctgaagcaactgaagatccacaaaagaagtgaaaatagtcagttcctgccttaactgatgacatgccaccattgtgatctgttcctgccccactctaactgatcaattgactttgtgacaatacatcctccccacccttgcgataatgtattttgtgatattcaccgcccttgtgaatgtactttgtagggtataccctccctgcctttaagaaggttccaagatggccaaataggagcagctccagtctacagctcccagcgtgagtgacgcagaagatgggtgatttctgcatttccaactgaggtaccaggttcatctcactggggcttgtcggacagtgggtgcagtccacggagtatgagctgaagcagggcagggcattgcctcacccgggaagtgcaagaggttggggaattccctttcctagccaagggaagccgtgacagatggtacctggaaaattgggacactcccaccctaatactgcgcttttccaatggtcttagcaaatggcacaccaggagattatatcccatgcctggcttggagggtcccacacccatggagcctcgcttgctgctagcacagcagtctgagattaaactgcaaggtgacagcgaggcttggggaggggcatccgcctttgctgaggcttgagtaggtaaacaaagtggctgggaagcttgaactgggtggagcccatcgcagctcaacgaggcccgcctgcctctgtagactccacttcttggggcagggcatagctgaacaaaaggcagcagaaacttctgcagacttaaacgtccctgtctgacagctttgaagagagtaatggttctcccagcatggagtttgagatctgagaatgaacagattgccttaagtgggtccctgacccccgagtagcctaactgggagacacctcccagtaggggctgaccaacacctcatacagccgggtgtccctctgagatgaagcatccaagggaaggatcaggcagcaacatttgctgttctgcaatatttggtgttctgcagtctccgctggtgatacccaggcaaacagggtctggagtggacctccagcaaactccaacagacctgcagctgagggtcctgactgttagaaggaaaattaacaaacagaaaggacattcacaccaaaaccccatctgtacgtcaccatcatcaaagaccaaaggtagataaatccacaaagatgaggagaaactagagcagaaaagctgaaaattctaaaaatcagagtgcctcttccctccaaaggagcacagctcctcaccagcaatggaacaaatttggacgcagagtgactttgatgagttgagagaagaaggcttcagatgatcggtaataacaaacttctctgagctaaaggaggatgttcaaacccatcgcaaagaagctaaaaaccttgaaaaaaagattagacgaatggctaattagaataaacagcatagagaagaccttaaatgacctgatggagctgaaaaccatggcacaagaactatgtgacacatgccaaagcttcagtagccgatttgatcaagtggaagaaagggtatcagtgattgaagatcaaatgaatgaaatgaagtgagaagagaagttcagagaaaaaagaataaaaagaaatgaacaaagcctccaagaaatatgggactatgtgaaaagaccaaatctacgtctgactggtgtacctgaaagtgagggggagaatggaaccaagttggaaaacactcttcaggatattatccaggagaacttccccaacctagcaaggcaggccaacattcaaattcaggaaatacatagaacgccacaaagatactcctcgagaagagcaactccaagacacgtaattgtcagattcactaaagttgaaatgaaggaaaaaatattaagggcagccacagagaaaggtcgggttacccacaaagggaagcccaacagactaacagcggatctctcggcagaaactctacaagccagaagagagtgggggccaatattcaacattcttaaagaaaagaattttcaacccaaaatttcatatccagccaaactaagcttcataagtgaaggagaaataaaatcctttacacacaggcaaatgctgagagattttgtcaccaccaggcctgccttacaagagctcctgaaggaagtactaaacatggaaaggaacaactggtaccagccactgaaaaaacatgccaaattgtaaagatcattgatgctaggaagaaactgcatcaactaatgagcaaaataaccagctaacatcataatgaccaggatcaaattcacacataacaatattaaccttaaatgtaaatgggctaaatgctccaattaaaagacacagactggcaaattggataaagagtcaagacccatcagtgtgctgtattcaggagacccatctcacgtgcagagacacacataggctcaaaataaagggatggaggaagatctaccaagcaaatggaaaacaaaaaaaagcaggggttgcaatcctagtctctgataaaacagactttaaaccgacaaagatcaaaagagacaaagaaggccattacataatgataaagggatcaattcaacaagaagagataactatcctaaatatatattcacccaatacaggagcacccggattcataaagcaagtccttagagacctacaaagagaattagactcccacacaataataatgggagactttaataccccactgtcaacattagatcaacgagagagaaagttaacaaggatatccaggacttgaactcagctctgcaccaagtggccttaatagacatctacagaactctccaccccaaatcaacagaatatatattcttctcagcaccacatcacacttattccaaaattgaccatgtagttggaagtaaagcactcctcagcaaatgtaaaagaacagaaattataacaaactgtctctcagaccatagtgcaatcaaactagaactcaggattaagaaactcactcaaaaccgctcaactacatggaaactgaacagcctgctcctgaatgactactgggtacataatgaaatgaaggaagaaataaagatgttctttgaagccaatgagaacaaagacacaacataccagaatctctgggaaacatttaaagcagtgtgtagagggaaatttatagcactaaatgtacacaagagaaagcaggaaagatctaaaattgacaccctaacatcacaattaaaagaactagagaagcaagagcaaacacattcaaaagctagcagaaggcaagaaataactaagatcagagcagaactgaaggggatagagacacaaaaaaacccttcaaaaaatcaatgaatccaggagctggttttttgaagcgatcaacaaaattgatagaccgctagcaagactaatacagaagaaaagagagaagaatcaaatagatgcaataaaaaatgataaaggggatatcaccaccgataccacagaaatacaaactaccatcagataatactataaacacctctactcaaataaactagaaaatctagaagaaatggataaattcctggacacatacaccctcctaagactaaacgaggaagaagttgaatccctgaatagaccaataacaggctttgaaattgaggcaataattaatagcctaccaaccaaaaaaagtccaggaccagacggattcacagccgaattctaccagaggcacaaagaggagctggtaccattccttctgaaactattccaatcaatagaaaaagagggaatcctccctaactcaatttatgaggccagcatcatcctgataccaaagcctggcagagacataacaaaaaaagagaattttagaccaatatccctgatgaacattgatgcaaaagtcctcaataaaatactggcaaaccaaatccagcaacacatcaaaaagcttatccaccacgatcaagttggcttcatccctgggattcaaggctggttcaacatatgcaaattaataaatgtaatccatcatataaacagaaccaaacacaaaaaccacatgattatctcaatagatgcagaaaaggcctttgacaaaattcaacagcccatcatgctaaaaactctcaataaactaggtattgattggacatatctcaaaataataagagctatttatgacaaacccacagccaatatcatactgaatgggccaaaactggaagcattccctttgcaaactggcacaagacaggaatgccctctctcaccactcctattcaacatagtgttggaaattctggccaaggcaatcaggcaggagaaagaaataaagggtattcaattcggaaaagaggaagtcaaattgtctctgtttgcagatgacatgattgtatatttagcaaaccccatcgtcttagcccaaaatctccttaagctgataagcaacttcagcaaagtctcagggtacaaaatcaatgtgcaaaaatcacaagcattcctatacaccaataacagacaaacagccaaatcatgagtgaactcccattcacaattgcttcaaagagaataaaatacctaggaatccaacttacaagggatgtgaaggaccccttcaaggagaactacaaaccactgctcaacgaaataaaagaggacacaaacaaatggaagaacattccatgctcatgggtaggaagaatgaatatcgtgaaaatggccgtactgcccaaggtaatttatagattcagtgccatccccatcaagttaccaatgaccttcttcacagaattggaaaaaactactttaaagttaatatgaaaccaaaaaagaggccgcattgccaagacaatcctaagccaaaagaacaaagctggaggcatcacgctacctgacttcaaactatactacaaggctacagtaaccaaaacagcatggtactggtatcaaaacagagatatagaccaatggaacagaacagagccctgagaaataataccacacatctacaaccatctgatctttgacaaacctgacaaaaacaagaaatgggggaaggattccctatttagtaaacggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggccataggcatgggcaaggacttcatgactaaaacaccaaaagcaatggcaacaaaagccaaaattgacaaatgggatctaattaaactgaagagcttctgcacagcaaaagaaactaccatcagagtacacaggcaacctacagaatgggagaaaatttttgcaacctacctatctgagaaagggctaatatccagaatctacaaagaacttaaacaaatttacaagaaaaaatcaaacaaccccatcaaaaagcgggagaaggatatgaacagacactcctcaaaagaagatatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaactaggaacacttttacactgttggtgggactgtaaactagttcaaccattgtggaagacagtgtggcaattcctcagggatctagaactagaaatagcatttgacccagccatcccattactgggtatatacccaaaggattataaatcatgctgctataaagacacatgcacacgtatgtttattgtggcactattcacaatagcaaagacttggaaccaacccaaatgtccatcaatgatatagtggattaagaaaatgtggcacatatacaccacggaatactatgcagccataaaaaaggatgagttcatgtcctttgtagggacatggatgaagctggaaaccatcattctgagcaaactgtcggaaggacagaaaaccaaacaccacatgttctcactcataggtgggaattgaacaatgagaacacttggacacatggtggggaacatcacacactggggtctgtcgttgggtgggggaagggggaagggatagcattaggagatatacctaatataaatgacgagttaatgggtgcagcacaccaacatggcacatgtatatatatgtaacaaagctgcacattgtgcacatggaccctagaacttaaagtataacaataaaaaaaggtactttgtagtattctccctgcccttgagaatgtactttgtgagattcaccccctgcccacaaaaaattgctcctaactccaccatctctcccaaaacctataagaactaatgataatcccaccaccttttgctgactcctttttcagactcagcccgcctgcacccaggtgaaataaacagccttgttgctcacacaaagcctgttgggtggtctcttcacatggacgtgcgtgacaaattttatatcttttggagagaaaaactgctctattataaatatacattcttcagtgtatgctgagtctatgaaaactttttgctgtttgaagctcaacaagccttttcttcctcaaaaattcaggctctgatagtagaaaaccatgctttttaatgttgtttttggaaaagcatttaaatgtctaatttgaaactaaagccggattatgactttattgtacttggctgtcttgatagtataggaaggtttatacgttcaaggagaaggaggaaaagacctcagagaataactcaaaatgttatctcctatagcttttccattctgtgtctattcatagcacttaacgtccttatctttgttagcactttgcatttacattacactgtgaatcctctgttatctttaacatttggtagagtgtttgatacatgttcgaatggtttatttttagaagcaaccagattgtatacccttatgtatgtagctgagtcctaggtcagttactttcatgtaaaaaggttgaccaacatcttgttaggaaatgtttgcagcaagatgatgttttgtaaccagttggttggaagtacaggtggcttggacttgcatttggcatctgaagtatgaacagcctggtgggactcagccctcaacccatgggatctgacactatctccaggtaaatagtgttagaattgaaatgaattacagaatacctcatcggtatctgtaaaagaatcgatttgctatttgggggaagccctcacctttccgacatctagtcacagaagtgtgctgtgagtatgttgagtagaaaggaaaaacagcttgctttttctatttacatctagcttttaatttacatcaccgttagggcttagaaaacaatacaccaaaataaaagcctcagaagcaaaaatttttctctggccttctcctggcctcctgtctctcagtcccattctccccaccaaggccagccgtagaaactagaatccctcttcctcaaggcagatcatgaaagccataaccccttttccccaaagccagtcataaaacctagaatactactataacttcccttcacctttctgtgtaaaaactagccataaagaaattatctgacctatcttgtttgactgggggtcataagacccccattccagaaagggacctgccccacgcccagaaggaaggaatgcgtgctcagagaggccaagaagaacctagatggacaggcctggctgggtttccccactcagtctattagcattagatcatatgctttttgtccaatcatatttctatagggctgttccatactttgttgaacttaagcataaaatggacaacttcccctgtatctttgggtctttattctgaatgctcctatgtatacatgttaaataaatttgtataccctttctctaattaatctgacttttacaagttgatttttcaggaaaccttcagagggccaaggagcatttgctccctttgcccctctctacgtaaccattccccagttacttcacttctagattatctagtttttcactgttataacagtatgatgaacagatagctttgtgtgtaaaactttccctacatttgattatttccatggaatggttttgaaggcattttaaagactcttcataactttgtacattgctttccaaaaaggttgtcctggtttaaactttgaccagttctgtatagaggtggctatcttgccatagtttcccctgcattgattattcccatttttacatattcttaccaatttgattggtgtaaaatggtatctatttgatttttatcaatggtgagattgagtattttctcaaatagttgtaaattgcatctgttcttttgtgaagacaactagcagcgtatctaagaccagtttgaatattttttgtcttttttgtcttacatattcatttataaaggcagatttccagtaaaactgattgcccccaagtttgggtataatagagtcatttcactttgaccttcctcattaatttctaaattgttcacaattcaaaaagttattaccagttgtggagctacctttttttttttttttttttttttgagacagggtctccccctataatcttgccctgctggagtgcagtggcatgattataactcactgcagccttgacttcctgggctcaggccatcctccttcctcagcctcttgagtagctagggctacagacatgtgtccccatgcctggctgatttaaaaaaattttatttttaggccgggtgcggtggctcatgcctgtaatcccagcacttggggaggccaaggtgggcagatcacgaggtcaggagttcaagaccagcctggcgaatatagtgaaaccccgtctctactaaaaaaaaaaaaaaaaaaaaaaaaatagctgggagtggtggcgcatgcctggagtcccagctacttgggaggctgaggcaggagaatcgctggaacctgggaggtggaggttgcagtgagccaagatcgtgccactgcactctatcctgggcaacagagcaagactctgtctcaaacataataaataaaataaatttatttttagtagagatgaggtcttgctatgttgtccacactgggagctacctatttttaaatagtgtttaagatacatggtctgtaaatatatagacactgcttagaaatgaaaagcagcagttaaatttcttggggaagttggggtttatacaggaaattgtcacaggtactcaggaattggaagttgtggctggggatgtgtatggaagaataggcactgtaagtagtagacctgcagaccagtctgccctgatagaacattctttttttttttttttttttttttttttttttgagacggagtcttgctctgtcgcccaggctggagtgcagtggcccgatctcagctcactgcaagctctgcctcccgggttcacgccattctcctgcctcagcctccctagtagctgggactagaggcgcctgccaccacgcccggctaattttttttttttttttgtatttttagtagagacggggtttcaccgtgttagccaggatggtcttgatctcctgacctcgtgatctgccctcctcggcctcccaaagtgctgggattacaggcgtgagccaccgcgcccggccctgatagaacattcttaacccagctctccttcaatagctggtccgatagaaaggcaaacaaatatacatctggagtcatgggttctaaccttacctctgaaattagcctgctttgtaaccattcacagattaacctttctgtttctcagtgtttacatcagtaagttcctttcagctctaaacatctttgattttattattcaggggacagaatgttatccttttgaatccagaacctttcttgtgaatatctgtgaataggtctggaaaacaactcattgttgttgggaactacttggaggaaaataataggaaaaatttcccataccagctaaacttttagggaatgtgaacttccaaatccttgtttattttcttttaatacattaaaaatggtaaaattaaattatttttatgccattttccctggactagagaattgtagattcggtgttttctctttcaacatgccagaaaacgacaggttaagttgaaagagtgcaggaaagaaatttagagagaaaataactagctgcaaaacccttcggtgttttaagagaagttactatttacacaaacgtggcctcggcttaatcaaatgctttaatttaaagtcacaaacatcccttttctggcttgagaaagctggtggaagcagctcagtgctctgtgttcgatttgttaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccaggtgagtgacattcagagttttgtgtgtcagttaatccttctgacttttcacagttgatgatgttttacatgtaaaaatttcttattttattgtcttagtatttaaggaaaagtatctcattacattgttttaagaacatggctttaaaagtggccatcaggttttaaatttaaccaactttaggtgaattctgttgaaaaaggacccaggatagtcacgagagtactgaactagaagcctgagctagctgggtatgggtctcggccctagcaacctaagttatttaggcaggtctcctcatggccttccaggcttctgaggtggtttagggagtcactaaatgtgctgattggatctttgcaaatttgtatttccgagtccagctaataagccctcgttgatgctagaattctttttgtctcttgctgactttcttcctctccttcaactgcccatgctcctcaatttgcaggcactttctttcgcatcccactcaggatccctcaactcccttgcttatctctcaaagaaatgttcctccccagaggaaaaaagcgcccctcctgtcaaaggctcagctttccttgttccatgcttttgtttccagtcactttctgtaacttggttatctttccattgactcctttccctctgtcagcatacatgttcaggtcttcccttagatctctttttctccttgccttaattgttgttgttcatgatgagccttttatgttgagccacctttatttttccaagccggaatacctcacagtctaatttttacctcaccactgaggtcagtgtcaggtaaggccaccaggatctaaatgaaattgaataactttgtctttattttccctatttactctctttaacccggctgtagcttttgacattaattggctcccttttttcttttgaaattcttggtaattatttaatcatttattcacacttttttgtttctccaacaaaggatatgagacacacttctttttttttattattatactttaagttgtagggttcatgtgcacaacctgcaggtttgttgcatatgtatacatggagacacacttcttttattgagtctatgttattcttctgtaagctcttggatctcttctcttgtcctctcctctttctctgcccagaatataatttctgttgtaaaacttataatttaaagcccgtctcaaataccatctctttttgaatatccacagcactttgtatgtttttgggtactatctagttggtttggttgcactgtatccggtttttaattccctttattatatgaaatccttgaggcctaagactgtgacttacatctcttgttcctggagtctctcatatgtttattgaatgggagtaaaaagtattgaatcttaagtttttgtggggtttttttcttttttgagacagagtcttgtatggtcctctaaatatatggggaaggcaacatacttttttcaaaatgctgtagaagctcagaggaagaaattattatgaagaaagtaaatttgaactgagatgactaggattgcccaacagaagtataggggaagggcattccaagtctgtacaataggtatagaaatttgaaaatacaaggaggtttgacaagtggttgtgctgtgtgggtacagagtagattattttgtgtgtgcctgggtagagggacaaagtgggattatggttttgaaatgattcagatgcaatgctcaggagtttggaatttatcctatagaatatggaaagatattctttagcaaaagatcatgtgactatattacacattaggtagatcagtctgacattactttgagctggtggtggagagaccagaggccaggaatgcttaggaagctgttgtaggagtgtggaggagaaatgtttagtgttgcaacacaggctgtgaacaatgaagaggagaggtcacatttaagggctgtgaacaactacatttaattcacaattaaactttaatttagaccagttttgaacatgaatatcaactttgtattataacatcctattcattttacgtaagagaggagcttttgtgctacagactgagaataggtatgtattctatattctgttaaataaaacccccttttaaagcccaactttgttttgtatttctttttttaaaattaaggtataatttacatacagtaaaattcattctttgtattatatttccacaagttttgataaacatacagtcgtattactaccaccataatcaaaatataaaatagttttattgcccaaaaatgttccttgtgcacccatgtagtcaacccttctccttctcttctagcctctggcaaccactgatctgttttccacccatgtagtactcctttttgcagagtgtcatgtgaatggaatcaaaaagcctttgagtctggcttctttcacttagtattacacattttaaaattcatccacgttattgtgtgtatcagtaatttgtccccttttattgctcaataatattccattgtatggaagtgttagttgcttacccattctttggttgaggcatatttggattattcccattttctttttaatggaaaactaagttagcttgaaagtttaacccagtgggtactatttgaagatcctaagtcatataagaagttaaattagaagtaaaaattgtttctatataatgattacaactgtatgcatgcctataaataaagacaacaagaagcaatacagaaaaatggatagagaaaaattgttggagtagtagcattgcaggtgattaacttgttcgtattttcttttttcttttcttttttgagacagagtttggctcttgtcacccaggctgcagtgcaatggcacaatctcggctcactgcaacctccgcctcccaggtgcaagtgattctcttgcctcagcctcccaagtagctgggattacaggtgctcactaccacgcccggcttatttttctatttgtagtaaagacagggtttcaccatgttggccaggctggtcttgaactcctgacctcaggtaatccacctgcctctgcctcccaaagtgctgagattacaggcatggaccattgcgcctggcctgaatttctttttcaattagaacctgttaggtagttacaaacaaacaggaaaaaattctaagaataatacaaggaactcccttataccttctacctagatttaccaattgttgacattttgcccatttgctttatcatttttcctctacatatatttatatctgtatacattttttcttaactatctgagagaaaggtggagttgttatgcttctttatccctaaatatttcagtgtgtaattgtagaaacaatgatattcttttgcttaaccacagtagttataaaactcaagaaacttaacagggttgggcgtggtatctcatgcctgtaatcccagcactttgggaggctgaggcgagtggatggcttgcggtcaggagtttgagaccagcctggacaacatggcgaaaccccctctctactaaaaatcaaaaattagccaggcgtggtagcacatgcctgtagtcccagctactcaggaggctgtggcatgagaatcgcttgagcctgggaggcagaggttggggtgagctgagatcatgccactgaactccagcctgggcaacagagcaagactctgtttcaaaaaaaaaaaaagaaaaaagaaagacatggatacaatactatgaactcattcaaataacatagtcacagttcaacaactgtcccaataatatatttataaaatatactctaaactttattttttctccctgtcaggagaaatccctaaaaatgcatttagctgtcatgtctctttagtttcctttaatgtgaaatgatccctcagactttctttgtatttcttgaccatgatttttttgaagagtgcaagtatattctttaatagtagaatgcttctcagtttgcaattgcctaatgtttccccaaattagattcagattatacattttttgcagcatgaaattatgttgtgtccttctaggtgcatcatatctggaggtgcatgaggttgtttaacccatattggtgttgttagctttaatcacttaatgtggcatctaccatgttttcctctgaaaagttgctgttcttttctttgtaattaataagtaatttgtagcaagatgctttgagatgataccattttttctatacttattaactggcattattctgtaaagaagagctttcccttgtcttccatttcaaaatttattcatatatttatatatgtatgcatacaaactcatgaattcttattgtattcactgggttatagtaaagtggtatcaattattttgattttcaaaatgcccctgatttggccagtgggaacctgatcaagttgattcatttttccctatgattccttttagtagttccttactttctggcgcaagaagatattccaggctcgtcctgtgctttccatgcctcagccctaggatcagtcatttctctgagtcctggttccttttagtagagaatggtatatggaaaccacaaatggctgttagctgtgtgcttgttattattacttctaggccttttcagcaagcgcagtagcacacacaagcattactttagttttgttttaagacagatatttaaggaatgcacgcaataatcttaatgtgatgtatatctgtttccatactcatgtagccaccagtttgttagcagttagaatgaggaatttataaaactagttaaatgtcacttgtatgtgacaactttttaaattttatagactagagttaccggagacagatttttgtttttttgagacagagtctccctctgtcatctaggctggagcgcagtagcacattctcagctcactgcaacttccacctcctgggttcatgcaattcttgtgcctaagcctcctgagtagctgggattacaggtgcatgccaccatgcctggctaatttttgtatttttagtagagacggagttttgccatgttgtccaggctggtcttgaactcctgaactcaagtgatctgcctgcctcggcctcccaaagtgctgggattacagacatgagccaccatgccatgccatcagagacagttttgatcagtgggaagagtaccttaatcaactttttgatcacactactggctttgagcatattaatttagccttttccttatttagaaaatactgaaaatatgtactttagggatcagaaaataacaaattaaaaatatctgccacacattgtagttgctcaataaacttttggttttttatttcccagtgcattttcctttcttctttcctatttctctagttgtgtcactggttaaaggtcaaaaatagttttatcttagtttaatttaattcaattttatagagacagggttttgctatgttgcccaggctggtctcagactcctggagtcaagcagtctgcccacctcagcctccagtagtgctgggattacaggtgtgagccactgtgcccagcctgaaaatggttttatttattaattataaatattacttaggggtataggaaaaaaatgaacttaaatttttagtacagtatggggaacatatccaactcattgaagcctacagcttggccaaagaggatcttatcatatctcccaccatacctctatgaggtttctttgtttgtcttccaactctcaactctgtgggctgtatttctatgtgtgatggacccatgtgcctgctctgaggtcatggggagtagctgattacaaatgaacttgatattccctgaaacttacgcgtactgtacgaccgtctccagtcagaacaaactgattactggttaaattttcgttttagggatgaaggtttgattacaatgcaggactttataatcttcccaaacactaagaataacagcaaccacttttttttttagacagagtctcactctgtcatccaggctggattgcagtggtgttatcttgggttactgcagcctcgacctccccaggctcagataatcttcccacctcagcctcctgagtagtttggaccacaggcacacaccgtcatgcccagctaatttttgtattttttttgtagaggtagggtttcaccatgtcgcccaggttggtcttgaactcttgggctcaagtgatccacctgccttggcctcccaaagtgctgagatgacaggcatgagccaccatgcctggccgtcaaccactttttttttttttttttgagatggagtcttgctctgtcgcccaggctggagtgcagttgcgcaatcttggctcactgcagcctttgcctcccgggttcaagcaattctcctgcctcagcctcttgagtagctgggactacaggcacgcaccaccaggcctagctggctaatttttgtatttttagtagagatggggtttcccatgttggccaggctagtcttgaactcctgacctcaagtaatcctcccaccttggcctcccaaagtgctgggattacaggcatgagccaccgagctcgggctttttctttccttttctttttctttctttttttttttttttttgggacagagtcttgccttgtcacccaggctggagtgcagcagtatgatctcatctcactacaatctctgcctcctgggttcaagcgattcttgtgcctcagactcccgagtagctgggactacagtcataggccaccaggcccagctaatttttgtatttttagaagagacggtgttttgccattttttccaggctggtcttgaactcctggcctcatgtgatccacctgccttggactcccaaagtgctgggattacaggcatgagccaccatgcccggcctcatcaaccattttttaaaaattatttcagataactttattaagacctaattcacatgcccacaattcacgcattttaagtgtacgttcagtggtttttagcatatcacaaagttgtgcagtcattactgcaattaatcttagaacgttttcgtcacctcaagagaaagtgtgtacccattagtaatccctccttcttgcagtctctggcaaacactaacctactttctgtctctatggatttgcctgttatggacgttgtatgtaaatgaaatcatacattgtatggcctttggtgactggcttctttcatttagcataatgttgtcaagattcatccatgttgtggcatatatcagtacttgattcctttatatggctgaaggttcccatttctccacattctgtcattacttcttgttacctatctttttagtgttagccatcctagtggttgtgtagtggtatttcattgttctttgcatttccctgatggctattgatgatcagcatcttttcatgtttattggctatatgcatatcttctttggagaaaagcctattcagatcctttggcatttgaaaactggggtctttgtattttaattattgagttgtgagagctctttcacaatcactttttgagggcctggtatgtgccaggaccacactaggcgtttcacatgtacttctttgtttaatcctcataaaagtcccacacattaggtatttctgtttatagatgagattgatgatcagagttaaaataacttatctaaggagagagagccttgagtggtaggaatcaaggttctagctgagtgcggtgcttctgttttcctggctactctgtgctctcagtctttgacattgttgtagcagagcctgttttaggccttagaatgaaaattttcaagaatcatggagggaattcatatgctgagtaggttatttgctggtttttatcttcaagtttcctttcaatgtttatatactagatttattccaggaaacatatataaaccaaattaaaaaaataaaaccaattggaatttagtttctgataaaagaactttttatgtaaagaaatcatgaggaacatccttttgtgaatgtgaatactctctgagtttaagttgatatattcagttttcttagagcagggcacatatataaattttaaggaatgaggggttttcagaaaacattgataaaactttacatattaacttttaatctggatgaaaagttggttcatcactaacttcatgagcttttcaaaacaagcaagataaaagacacacctgtgacctttgggaacatgcaagatgtggcaagtttggaaaagggcacaatgatgattaaaagtaactgaaaaattggaccaatgaaatgaaattggcttgtggagaactagctgtggctacttgattttaggtcacatattcagacttttgaccaagacgatatactgtaccatagataattctgctctgaatggaacaggaaggaattaggagttaggcaagggagaattcagggtaacttcagttccattcagtcactattcactaaatgcttatgatttgctgggaactggcaatacagagattttttttaaagaaaaggtatggtatctgctcttaagccgttgacatttagtagggtttcacagaaaagtagtttcctgaaagggctgggtctcgaagggagaaatggagtttgctaagatggaggtattctggacccagggagcagcagtggcaaaggcatagaagtgtgaggtggcattctgtgcaacgaggactgcacagagtctgcttgctggagatgaggttccattccctgttcatatattaatatgattcctctagtaggctctcttttcaatttagactctccacacccttcctttcaccctcactctctgctgattactttgccttatactttgttgagaaatagaagccattaaacccaaacttcctcaacttccatccaagacctacagacccactacacgagaattacacccatctgatcctctttcttcgcttgagtctcctcgtcctgtcacaggccacaagatttttctccttccatctcctttttccaggttccttaccatcatcaggcatacctgttctgatttgttcatcttaaaatgaaacccagcctttttgaaaatcctgacatgctgcaagatggatgatccttgagaacattatgccaagtgatatgtcagtcacaaaaagacaaatactatatgattccacttagaatcatagtacctagaggtacctagagtattcaaaattatagagacagaaagtagaatggtggttgccaggggttggaagcaggggggagtgaggagttactctttaatgggtagagtttcagttttgcaagatgaaaagagttatggagatgaaaggtgatgatggttgcacaacattatgactgtatttaatactactaaactgaacacttaaatatggttaggatggtaaattttatgtgtattttaacataataaaaaattggaaaataaaatattttttaaaagttataggactctcatatgcccacatccagaaggaaatgctacatttctttctttctttttttttctttttttttttgagatggagtcttgctctgttgcccaggctggagtgcagtggcatgatctctgctcactgcaacctttgtctcctgggttcaagcgaattctcctgcctcagactcccgagtagctgagtttacaggcgcacaccacaatgcccggctaatttttgtatttttagtagagacggggtttcactatgttggccaggctggtctcgaactcctgacctcaggtgatccacctgcctcggcgtcccaaagtgctgggattacaggtgtgagctaccacgcctgcccagaaatgctacatttctttaagagattagtgaaaataaagatgtcatctttatcccccccaccaaaaaaatcccacaactcttccttgataccaccacattcctctccagagaccacctcattttactgttccactaagactaatgtctcaaaagagccacgctgtgtctatttccctcttctattcactcttcaattcactataatctgacttccaccctccactgaaaactgcttttgtcaaggtcaggtcatctgtactctccatgtgcacatctagtggatacttgaccttgtggcagcatttgacagtttgcccctccctcctggaatcttgctcccggctcctatgacaccatgctggttttcctcttgcatcactggctgctgctttcccttctgtccctgactctgagtaatggaggtctaaagggcattgtgctggactctcttgtttctctataattctgttacagtccctgcccagggatttaaatgctttcactatgctgatgatttctccattttatctctagctggccctctccactgagctccagactctcatatccatggctttcttgttttataaaatagtatacttactgtgccttaaacagaacttggatcccctctattcccactacattcctccttgtcctcgtaatggcctctccatcacccagttattcaggccaaatgcctggataatccttgccctttcctctttgtatctccctcacccccacagcaaggcttgtggattctatttctattttgaatctattcccactctctatctactggcagactgcctctgtagtccaggccaccatcacctcctatctggattattccaacagcctcctaactagtgcccactcctcttgctcctctctccatcgtcattcgttcagcacactgttgtaagaataatcacaaatcaaacaatttcacttccatgttatcatttctatggatttccaaattccctactttggcctgcctgcatcatcatttggcctgcctagttctccaatttcatttcatgtcactctccccacacctactgtattatagagactctggtcttatttgactttcttttaacatactcctttctccctcaggatctttgcagtttcctctttgaatggctagctccttttcttcctttaataaggtcttagaggtcattccttgactgtccttcctaaagtaggttccttttttttaaatttaaaattattttttattgatgcataactgatgtacatagtctcagggtacaagtactaatttaatacattcatgtaatttgtgaaaatcaaatcagtatacttgggatatccatcaccttaaatatttgtcttttctttattctaggaacatttgaattattctcttttgattattctctttttgctatttagaaatgtaaatgtatagtaaactatagtcaccctactcctgtttcaaagtacttggtacagtttgcagttattttgtgtttacttctttttctcctccactggaagaatataaactaagtgagtgcaaggactgggtctgatctgttcactatcatatccccagtgttttgaaatgtcttgcttggcatgtagcaagaagtcattaaatatttatgaaacgaggccaggcacagtggctcacatctgtaatctcagcaccttgggaggccaatgtgggaggatcgattgagcccaggagtttgagaccagcctgggcaacataacaaggcccctgtctctacaaaaaatttgaaaaattagctgggcatggtggcatgcgcctatagtcccagcttacttgggaggctgaggcaagattgcctgagaccaggagttcgaggttacagtaagctgtgacaggaccactgcaccccagcctgggcgacagagtccctgtgggaaagagagagagaaaaagtatgaaataatagaaggaaaagggaaagaggaaggagaaatggatttgaggactgcagggagacatacatgagaggagaggggtagaaaaagacagatgcttattgaacaactgctgcactttttttttttttttttgacaggttctcactctgtcacccaggatggggtgcagtggtgtgatcatagctcactgcagcctctatctcccaggctcaggtgatccttccactttagcctcctgagtagctaggactacagacacatgccaccataataggttaataaataacttatttatttagaaatggtctggttccatcacccaggctcaagcaatccttccatctcagcctcctgagtagctgggactacaggcacgcaccaccacaccaggccaatttttgtgttttttatagagacggggtttcaacatgttgcccaggctggtctcgaactcctgagctcaagcgatctgtccgccttggcctcccaaagtgtaggattacaggtgtgagccactgtgcctggctaactatattatttatttttttgtttctaaattgtctcctccactaggatgtaagattcatgagggtagcttctttggtttactgtattttcaagaaaaacttctagctcctaatgagctgattatgtgttgaaaaaatgagaagaagagcttaattgtttctttgtttatgacggagtttcgctcttgttgcccagcatggagtgcaatggtgccatctcggctcactgcaacctccgcctcctaggttcaagcgattctcctacctcagcctcctgagttgctgggattacaggcatgcgccatcatgcccagctaatttttgtatttttagtagatacggggtttctccatggtggccaggctggtctcgaactcccgactacaggtgatccactcgcctcggcctcccaaagtgcagggactataggcattgagccatcgcgcccggccaagcttaattattttatatgcttactaaagatttcctttggataagatttgcaacatctctgttcttagggtttttgaaaattttgaaaattactattttataaatgttgaaaaacctagtacctatgtgactccatgaattgaaacagtttcttttccccagttcttttagaactcatcaaattgaagctgttccaaccagctctgcaagtgatggatttaaggcaaatcttgtttttaaggagattgagaagaaacttgaagaggtaagatttatgtaaaatattgccaggaaggaccttgaggctagaggaagcagacacaggtttcaggtgttgccacgaggtggtacaattgaaaatttatatcatgttgtcaagtattgagtgtagttagatttctgagtgtctattaaggcttccttgtaattctaaaaggaatgcatttcagaaatgtatgaatctccagatttgagctaaagaactataataaatactgttaaaattgtcactcttttctaggtcctctttgtcagagggtcattcagtcatgggcaaagttcaaatataaagggattctaatttattttgctgtaatttcctttgaattaaaacggtcttacttaaaatcatttcaaagaataatatttaaaatgagccttttttgtatatatatcaaaattctttgtaaaaagaaattgtgttttgatttcttaaagtagttaaaaaatttttttgttttaaaaatgatgttaatttaaaaaatactatacagaaatatatgtttatgaatagtataaattttatactatacttttgttttaaccttttaaacaaaagtttaaaatctccccaaattctgccactcagagtttactgaaatgttaacagtggttaacattctttcagacatctttctctgtgtatattaacttacagttttaacctagggtcaaaaaaacctattgttttttgttttgttttgttctgagacagtgtcttgctctgtcacccaggctggagtgcagtggtatgatcttgggtcactgcaaccttcacctcccgggttcaagtgattcttgttcctctgcctcctgagtagctgggattacaggcacccaccaccacgccaggctaatttttgtatttttagtagagacagggtttcaccatgttggtcaggctggtcttgaactcctgacctcaagtgatccacccgccttggcctcccaaagtgctaggattacaggggtgagccaccgtgcccaccacaacacctgttgttttttattatactatatatgcggatctatttttatatacaataattagttcttgataggtaataatcatactaaggcaatctaaaaataactctccagaaagaaagttattctcttcacgcaaaattgatatttatttcattgttttaaacttagaagaatcttgggatctctttctgtttttttttttttttgaaacagagtctcactttgtcgcccagaatggagtgcagtggcatgatcacggctcactgcagccttgagcccctgggctcaagtgatcctttcaccttggccccccaaagtgttgggattacaggcgtgagcctctgcctggatgtatttcattatggattttagatctgagaccgtataaggcatggttacagccataatcacaatgcaaattacacatctattaaggtgatcaaagtgggctggaataaatagaatgtttaaactgtatttcactcacgttagagccatggtgtgaaaggcaaacattgtgcttatctcataacccttattgtaggccagaggactacttaatatctgagatgattgcactgtggatgggaatacaggtgatataactgatgtgtcttgtgaaagaacccagtattcccaggactttcattataatctacaaccgtcctgagggagagcagggccaggcattggcctagaagctgcagacctgtcctgcaaccatcttgggatgcatccacatggggctacctgttttataacctatgtttttcttttgacattatgttccatggccataaatctaaatctttaccccctgtttttttttttgaaacaaagtctcgctctgtcacccaggctggagtgcagtggcgcgatcttggctcactgcaacctccacctcccgggttcaagcgattctcgtgcctcagcctcccgagtagctggcattacaggcacgtgccaccacacccagctaatttttgtatttttagtagagatggggtttcaccatatttgccagggtggtctcttatctcctgacctcgtcatcttcccaccttggcctcccaaagtgctgggattacaggcatgagccatcgtgcccggccgtttaccctcatttttaatacatagtatgtattcatatgtatttgtcaaaatttaagtagcttcctgtgatgaatatcaggttgtatttaacattttcaagtaaaacagtgctgtaataaatttcctgttgcactcatatttaagtatttaagctatgatcaatttaatataaataaaggaggaaaattgttgggtggttggctacgtgcattttgtatgctgatacatattgccaaactacccaccagaaagagagtactaacttacaaacattaccaattcatgagagtgactattttttccttttaaaacatttatttatttttatttttgtaaagatggggtcttgctatgttggagactaactatttttacttcacacctctgatactatgttggctggtttttaaaaaaatctctgggctgggcacagtggcacacccctgtaatcccagcattatggaaggctgaggcgggtggatcacttgatgtcaggagttcaagaccaacctggccaacatagcaaaaccctgtctctactaaaaatataaaaattagccaggcatgatggcgcagtcccagatagctgtagtcccagctactagagaggctgaggcaggagaatcgcttgaacctggaaggcggaggttgcagtgagccaagatcacgccactgtactccagcctgggtgacagagcgagactccacctcaaaaaaattaaaaaaaaaaaaaaaaaaaaaggctttgccaacctagtaggaaaaaatatctcattgtttcttgaacttctttcattacaagtgttcctataaaatgaagttgcactctataaagtctcggcttaaaagttttggtttttaaaaatgctgccaatatattcctgcagaggaacacataggatagtggcgtctgacaagttgcttcatttatttcaaccctattccatctaaaaaaaaaatcaactaaattaatgtagagattatctactatgaagtatgagatatggcagtatatcagtcattgaatacttcattactgggatttacaaattagtgtggtttttattttacagtattcttttagctttgcaaatgtatgcctcttgctccattttaattcttttctctataacctccctaccaaccttgttcccttgtttctttctccttcccacgattgtcagtttcctaagtgtttgcagcactagaaagtaaaagtcttggaatcttttgtcaattcatgcattttctgcattagcaaaggcagcctggcaaaagattttatttccacttttgtctttgttagcaattctccattgcccttctttgaattctgtcttaattttttgtccctattaagtttgccacaggacctactccttaaccttttgcctactcagaaagaagtacttttcttcaagcaaggaggcactcagaactttctcagtactaatgatctccaatttcacaactgtattttattttccctttaaactctttctcctcatcagtttccttaccctctctcactcccacttcaattgaaaatgttttattgtcgaagggatgtgattttataagaggatcagttgtttctgaaaagtagcagcaagtgcagattattctctatctattttaaggaggtgggaggagaagtagtaaggttataggaatttctcttcaagtatgcaggtagaatttctaaatgtttgctggtgttttcctgctgtaacttgttggtgtctgcacatagctgtattcctgaggcactgtgcaagcagatggcatggatgcacctggaaatagtcattcatgggccactggctctagagaaagctttcctctcaggtggcctagcacactattaaccccctctcctatattatttctacagaaccttgagagataaaagattttaaggaatgtgaagaagactttgaactttcttcattttatggtgccagatacagctctgctgtcatcggctaaagtttagaaatgttgatgtgacctacagtttcagtgtggtatggtcaaatggaagtagcattgaatttgggattaaagcaacctgggattgagttctggttgtactacccactagccatatgtccctgcctctcagggaacacagagtttagtgggaagagagacatggaaaaatatttccagaaaaaagcaacatgggtttatgtgcagagggccatcaaaatatctggtggagatagagactccttcccaaaagagttagcatgtgagctgagatttgaatgatgaggtcaggggtgggagtagaggctaggaagaagtgagtgtcctgggatggggtatgagtaagggcatggaggcatacaagcacttggcacgtaagttcatggaattcaacatgttcatggaattcagagatgaagaggaagagaaagtggctggagataagaacagacaaatatccttcggatcatgaagactctaggataatatgtaaagacagacttcatcctgttggctgtggggagccactaagaagttcaagcctgagagtgtcagatggatatgttagtgttagatggactacttggcagcagtatagaggagaagcattcttaatctttataagcctcaattgctttttctgcttaatgagctaatactaatgtctgcccaactatttgtatggttttgtgaagattaaagaaattatatatacaaaatatatttaatacaaaagtattaaaaacttgaagggccctcaaaatattagtattgttagtagtttttttctacagttaacttaaaataatttaagtgagctcttttaagggaagccaacataagagaatttctttttcacttaaaagaaaaacctgacagtcattttggtttcttggtttaagtagaaaatattggtagttaatttcaggatactcacatgtaagagatgctgccatgactattcagataagtagtccctgactaaatattttaggactacttattaaaactaaacattttaggactacttattaaaactaaatattttaggataaaacaaaatatttagtcctaagacccatgtctaagattccaggtggctctcagggaatgtacctatatgtaagaaaaaggttgacataccgggcacagtggctcacgcctgtaatcccagcactttggaaggccgaggtgggtggatcacttgaggccaggagttcaagaccagcctggccaacatggtgaaaccccatctctaccaaaaatacaaaaaaattagctgtgtgtggtagcgtgtgcctgtaatcccagctacttgggaggctgaggcaggagaatcacttgaaccgaggaggcagacgttgcagtgagctgagattgcaccacagcactccagcctgggagacagagcaaaactccatttcaaaaaaaaaaaaaaaaaaaaaggttgacacacccagtaggatgactaaaataaaaaagacaataacaattgtttgtgaggatgtggagaaattggaaaccctcattaattgctggtagcattgtgacatgatgtagccactttgggagtgccttaaaaaattaaacatcaccttatgacccagcaattacacttctagatatgtaaccaaaagaaattaggagcctatgttcacatgaaaacttgtacacaaatgtctatagcagtattattcataataggaaaaaatgaaaacaaccatcagctgctgaatacataaacaaaacatgttacatccatacaatggaatattatttagctgtagaaaggattgaaggaggccgggcatggtggctcatgcctgtaatcccagcactttgggaggccgaggtgggtggatcactcgaggtcaggagtttgagaccagccaggccaacatggtaaaaccccatctctactaaaaacaccaaaatttttagtacttttttttggcacgtggtggtgcgcgcctgtagtctcagctacttaggaggcagaggcaggagaatcacttgaacccgggaggaggaggttgcagtgagttgaaacatgccactgcactccagcctgggtgacagagtgactccatttaaaaaaaaaaaagattgaaagactgatcgatgtatgcatcaatgtggataaaccttgaaaacgtcatgcttaagtgaaagaagcagtcacaaatatatgatttcatttatatgaaatgtccagaataagcaaatctatagagacaggaagtagatttgtggttgccggggactgaggggtggaggagacagggaatgactgctaatgggtatgagtttcttttggggttaatgagaatgctctaaaattagatagtggttttggttgtacaaccttgaatatactaaaacaaccactgaattgaatattttaaaagagtgaattttataggatataaattatatctcaatgctgttgtaaaacaaaacacaacaaaaagaaatagtgaacttaggccaggctctctgcatacttagaaacagaggttagtatctaatgtcagtttatgtaaattcctcaggggcagtaattatttgagtatttcaggtacttatcagagtgcctgaacattgtaaacacttaagtctttcttaaaataattaatattatgaggccaggcacggtggctcacgcctgtaatctcagcactttgggaggccgaggcaggcggatcatgaggtcaggagattgagaccatcttggctaacacggtgaaaccccgtctctactaaaaatacaaaaaattagccaggtgtggtggcgggcacctgtagtcccagctacttgggaggctgaggcaggagaatggcatgaacctgggaggcggagcttgcagtaagctgagatcacgccactgcactcccagcctgggtgacagagtgagactctgtctcaaagaaaaaaaaaaaaattaatatgataccaaaaggaagaattttgtgtataaattattgcagatatgtaaggctgaaataaagaagataggaaataaaagctattagaaattaaagagaactcaacaggttgccagttccaaaataaacattaaaagattagtatattttctatatatttgcaataacctggccataaaatttaatgcaaagatgtgctattaacaaaaacaatataaaatacctaagaataaacttatcaagaaatgtacagaagtctatgttggcaaaaaaaagacaacattttcccaaaggacattaaagaaaaggtgaagatttactatattcgtggatgggaagacttaatattgtgaagatactacctctctcctaaacagatctatatattttatgtaaccccatccaactccaacaacattttgggagaagaactaagtgattataaagtacatataaaggaaaatgtgtccaaaaaaaaatccaaaatagccaagaatatttggaagagaagaattataattgagatttgctgtgtcagagtaaagtgtattataaagctataatattggcacagaaatagctagatcatagaataaaacaacaacaacaagatgctaacattcattgagtactctgtgtgttgtgggtatttacataattctcttacagctctgtgagggtagttactgttttattcccatttaacagataagataaccgagattcatacaaaaatgcaaaaaattagccgggcgtggtagcgggcgcctgtagtcccagctactcgggaggctgaggcaggagaatggcgtgaacccgggaggcggagcttgcagtgagccgagatcaggccactgcactccagcctgggcgacagagcgagactccgtctcaaaaaaaaaaaaaaaaaaaaagaaaactgagattcagaaagtaacttggctaacttgttgataacaatcaacaggatattggttaaataaatatggtatacttttacaattaaagactatatgtgaccatttaaaattatgtagaatattattagtgacacagtaattaggataattatattaaacaaaaaaagtagattataaaacaatatgatcccatttaagatatatatataaaagctttatatataacatatatatactatattttatttaatcaataccctgttaattgttattcaggctcgtgctaacttctggctcttaaaacaatgctgtgaataacattctcatatctaaatatttttacagagcctcatttatttaagggtaaatccctagaattaaactttgctaattaagaacaccaaatctaggaatcaaaataggtttgaattcttgctcttccttgtacttctacaaacctagccaagttattagaccttcttgaatatatatataataatatatatgtagcatatataaatcttatatatatatatcttaagtgggatcatattgttttgtaatctactttttctgtttaatataattaaacagatcccatttaagatacatatatatataatcttttctgtttaatataattaaacagattccatttaaaagatatatatcttaaatgagatcatattttgtaatctactttttctgtttacagaaagattttcttgtttttggtacaaaacccattttttttctctgcatatatatgtaccaaaaatgattttctttgagtgataaagttatgaatgattttggccgtgtgcagtagctcacacctgtaatcctagcattttgggaggctgaggcagtggatcacttgaggtcaggagttcgagaccagcctggccaacatagtgaaaccccgtctctactaaaaatacaaaaaattagcatggtggcgtgtgctgtagtcccagctactcagaaggctgaggcaagagaatcgctcgaacccaggaggcagaggttgcagtgaggcaagatcatgctactgcactccagcctgggtgagagagcaagactctgtctcaaaaaataataataataataaatgatgaatgatttatattttcttcttcttgcttactgatattttctaatttttccacagtgaaataaatgttccttctctaaaaattttttttcaataaaattattaggttgctcttgtttcttttaaacaaggtgtgtgagtttgttgtcctccttttgttattcaccctgccagctggcttagctgctcctctgtgctcctgcagtcccctgtgtttcccttgatcgcagcgtattgtcatagtgatcatagcgtattgacattacttacttttctgactcctatctctatatccttggtgcctgtaacaatatttggctcaataaatgcttcaggaaggaaaggctgggaatgaagggaaaaaaaagaggacgggagggagaagggaaacccccttgcagagatataggtctgagttttttttctgtatttaggccagcttctttccccgatgtccaaaagcaagtggtggatggtatattactcctataattctttatactgatagagaaaatgagttgaacaacaacaaaaaaggccttgatttcagaaccacttgtctttaagttctgattgcaaggaaccaaaaatatacataaggctagctgtggtggctaacccctgtatcccagcactttgagaggctgaggcaggaggattgcttgagcccaggagtttgagaccagcctgggcaacatagggagatcctgtctctacatacacacacacacacacacacacacacacacacacacacacacacacacacagatccagatcctgtctctatacacacacacacacacacacacacacacacacacacacattcaattaaccagttgtggtggcacatgcttgtagtcccaactacttgggggaggctgaagtataaggattgcttgagcactggagatcgaccctgcagtgagccctgattgtgccactgcactccagcctgggtgacagagtgagaccttgtctcaaaaaaaaagaaaaaaaacctatatgtgtatatatatataatttatatgtgtttatatatataccatttatacgcttatatatatatgtcatttatatatgtgtgtgtacacacacacacacggagaagggcaggttgggatctctacattaaagatgccagagtgaatctttcccaacttattgaaacatacgagggctattttggcagaaaatgctgccctgtccctccttcccttccaccagttgtatctaaaaagccctttttgttcttttttgagacaaggtcttgctttgttgcccaggctggagtgcagtggcatgatcatagctcaccataacctcaaactcctgggctcaagtgatcctcccatttcagcctcctgagtaggtgggaccacaggcatgcaccaccatgcctggctaatttttttatttttagtagagaccaggtctcactatgttgcccaggctggcctccaactcttgggctcaagtgatccccccacctctgcctcccaaagtgctgagattacaggaatgagccaccatggctggcttaaaaagccatttttaataaaagacttggcagatgtgggagttgttgcctgcttgcctttcagacttttctgggtaaaagatcataagggaccttggggaccgctccctggcccgtatactcatatcatgtatctatttaaacatgaatttgcttgaggagaaagccagagaaatggacttaatgtaaccccagtgttatttttctttccaggaaggggaacagtttgtgaagaaaatcggtggtatttttgccttcaaggtgaaagatggccctgggggtaaagaggccacctgggtggtggatgtgaagaatggcaaaggatcagtgcttcctaactcaggttagtttgggaatgacttcattctaggagcactgacgagtttacgaaggctgtcagctgggaaaatgggggtctgctttactgttcccaaaaaggactggcttttaatgttaaagaaccagtaaattccagggaacaggaacaggtcaaagccacctcctcccaaggatttggaggctccatcacagagttgccaatcttaggctttggaattaggcaaacttgggttggagtcccatccatgccattcacataatgtgaccttgaacaagttatttaactttctgagactcagttttctcttctgtaaatgggcttaataaatggccccttttcataaggttggtatgaagattaagaggattctttcttaattaaccgtaaggcacacggtccagtgcatggctggtggccttggaagacctgtccatactcacaatcgccagttattcttatccaaatcttttttgaccccactctagtcagcttttgtcctcatcactatccccagactgttcctgtcaagatcaccagtgactaccacattgctaaattcagtggtaaattcccagccctcatgatattacacttacacgttttccttacctactgactgttcctccttggcctctcttgatggtttctttttgtcttcaaatttctaagcattggagtgttccaaggctcagttctatttgccttaattccttggggatcttaactagtcccatgctttgaaacagtttctacactgatgactttgtctttagtatggacccagccactgaactacaaggtatacatccagctgcttaactgacaagtttacttggacacctaataggtatcgcaaagctaacgtgtgaaactgaactacagatatttcttctcccctctaagtatgtactcctcctgctgttgcaattggtaaattgctcctgtgtcctactggttccttggtctaaaagccttgaagtcatctttggccactttttttctcttatactccacagtttaacccatcaacacatcttgtcctcctctgtaaccaccaccaccctggtctaagccagcatcattgttttatccggtctccccgattctgttcttgcccactactctgcacacctgccagagtgatcattgaaaaacttgtcgaattgttaccttcctctgctcaaaagcatccaatagctttgtctcactgcaggtaaagttcttaaaattgcactgtatgatctggcctcagttttcactgtcttactatgtatgtccttgctcacttggctccagtaacactgacttttttgctgttgcatgaatgtgggattctcttggttgggggctttctgctctctgttccctgtccggaattaccttctcccagatatccttgtggcctgttccctcctttcctttggatctttgctcaaatttcaccttctcagtgagccactccctaaccaccctttttaaaatcttaaccccacggtgaaaccccatctctactaaaaatacaaaaaaattagccaggcgtagtggcgggcacgtgtagccccagctactcaggaggctgaggcaggagaatggtgtgaacccaggaggcggagcttgcagtgagccaagatcacgccactgcactccagcctgggcgacagagcgagactccgtctaaaaaaaaacaaaaatcttacccccattactattccctattgcctttttctgccttatttttctccatagcacttattaccatctcatataccatgtaatattttacttattttcttattgtccatctctctcacttgaattgtaagttccttgaagacagagctttttgtctgaggtacactgctgcattcccagtgcttagaatgtacccgagacatggaaggccttcaaaaatgaataatttaaaaatggacaacagaatgaatggcatcgagtaagcattcagtaagtggtagctgtactgtactgttatgcttctcttgttggagagagcctagggtaatttagaaacactgtggattgggaccagctctttggagggcttaaaatgccatgataggggctgggcacggtggctcacgcctgtaatcctagcactttgggaggccgaggcgggcggattacgagatcaggagttcgagaccagcatggccaacatggtgaaaccctgtctctactaaaaatacaaaaaattagctgggtgtgtggtgcgtgcctgtaatcccagctacttgggaggctgaggcaggaaaattgcttgaacccaggaggcggaggttgcagtgagccgagatggcaccattgcactccagcctgggcggcagagcaagactctgtcttgagaaaaaaaaaaaaaatgacatgataggaactttgaaagtcgttttgtatataactagtataccaaagcttttaaatatacattagagcttcctaagtagaaaagtgaagtcagagctgtgttttagaggatgaagctggtacattagacctgatgaattgaaaggggtgagagatcagaaacagagagagccatcaggaggatagatgttgccactgtctaagtgagcggagaggatgaccagccttagtgtaggcagtgggaaaagtaagtgttctgagagtagatgccagagatactggaggtgaaggtaatgggacctgggaattgtatagaagaagcgtgtctatcaaagatggtgaaatttcgttactggcacatttttgagggaggtcctgtaggaaaggatgacatcgggagcacaggtggaagcaaggttacctctagtaagaaggggtggatggaaacttctttctctgcaagggtagttaaatattcaggggcattttgagaggagaggaggttggcaagctcctggaatagagtgtagagcttggagtccggagaaaaagtgaagagcactgttaacgtgcacggttgaataagggattgatgagagatgaatgaaagaaaaattgagcagtagttagggcatccgtctagtgtgggcagcatggctttgttgtggaagtttcctgaattatacagagtccctttttttccttccaaaatgaatgggaaaaaaatggccatagctttgcattctatgagctgccactctaaggtggtgtacaaagaaaagctaaaggctttatctggattccagcttttagaaatagaacttcaggaattatagtagtgatcttttttttttttaatgactgaaggttaatggttacttttatatttagatatgcccatactgatattaaggttgttttttttttaatttctccttttcctcctattttgttgttggttgatagcgttggtttgtcatcaaagatcaaatgctgatggaaagctgttgaatgattttggaaaagctgtgttccctccagatacgttcttgccatgttcttcccacattaggtgctgtaccccagaccccaagggatcttaccctggggaaggatagtttctgctgaaactgacacttattggcagccaagagtggtgttgaaatacagacttaccaagaaaagccatcactggaaattgccagctccttttacatcaaccaacaaatggctatttgttagagattagctacattaaagcattaataacctgtcctagtttgaaccggcatcttaaggagaattgctagttcatttggcatgtacataatgttagggggtttgtttattgttaacaaagtaagatttacttaaatgtattttgtaagagcttggtaatgattactgagatgattatattatggatttttagattttgtgcattttccatcatctctttttgcttcctgggtgccttttagtatcttctccatgagttctgcctttccctcatctcctttgaaacgactcatatagcatatctccaggaggccatctttgattaatctaacataacatattattccttcattcctttattctgacccttcagcaccttgagttctcaactctgtccctttatgggcagcatgatacagaaagcttcagggtctcctatccccaaggtaaactagaaagagcatagccaaaagaaacagccaaacctgggttcagatctaggctctgtcactcagagggtatataccttccctgagagtccaatggtcttatctaaatatgatgagaataatttctatccatagaactgttgtggggattaaatgagataaggaagatagagcacctagtgtagtaagtgctcagtaaatcattgtttcctccccagaccatatgttaaacattaattttgcttagacacataggtttgtctcagcccctcaaaagggctttgaaaacttggaaaccatctgggattcatcaaatgctatgaatcagtgaaggtgcagttaaaactgagctgttgaatgtttacatacttcctaaaacaaaaggaagctgtagagcataggaattgggagtatgagctttggcaacaggaatctgcattcagatgtagctcagctacttactagctatgtggtcttgggcaagttatttggtccctctgacccttataggattgttataaagatcagatgagaccagatatgttgaagtgttcagcatagtgagagctcaataaatgctgatattatagcagcagcagtagcagattttacttcctgaagccccctttcaatgaccgagagtcctttcttggactgttaggaccaggtccaactatctcagtttgttttttacctcgtgctctttgatgttatatatctgcaatagaactggattttctaggctgtaaatttgtttattttttaaggatttagaccttttttcgagtattaagagaagattttctcagcagctaagttaggatgaccattgaatctcagtctttttaggggcgatccctgagttgtaagacacataataaaacctttttttctatcttgtttcagtgatttaatactataggcatactatgctttaacagtttattccatctctttttttttttgagatggagtctcactcttgtcacccaggttggagtgcaatggcacgaacttggctcactgcaacctctgctcctgggttcaagcgattctcctgcctcagcctgccgagtagctggaattacaggcacctgccaccatgctcggctaatttttgtatttttagtagagatggggtttcaccatgttggccaggctagtcttgaactcctgacctcaggtgatccgcccacctcagcctcccaaagtgttgggattacaggtgtgagccagcgcacccggcttctattccgtctcttttattaaggcacagattatctgattagctattatgacataatttgatcatcttttgaaattcacataatctattaatttattcaacaagtatttattgatttcctatgtgtcaagtactcttcaaggacctgtgcatatagcagtgatcaacactgacaagggctctgcccccttgaagttttcattctattggacaaatacagacagaaaacacatacacatataagtagtttcagatcagtgcactgtgaataaaatgtgacttcattttagggagaggccagctttaatttgagctaattcttaatgagaggaggagccaactgttagaatcctattgttatattaattgattgcctaaaacgttgactgctgaaaatgttgatttcttggtgaatttttccttttgcacttgaaacctctcatttggacaaggtagacatggctgatttagcaatgagatattagtctttgttgtccagtcttttttccactattttactttgataataaaattaatattttaaaagctttgtattattaaaattgcatacacttgattttaaaaaattagaaaagatagacaaacgaaacgaagaactaccctaccaaaattccactgtccaggttaggagttggcaaattatggcctgcagaccaaatctagcccatcacctgtttttttgttttgcgttttgtaaaatttttgttgaagtctagcctgtagtaaagggcgtaattccagagtgtaccacgtgatgaatgtttacaaatgagtacacctccaaggtcaagacacagaatgttgccagtactccagaagcctccctcctgcccccctgctatcactattcactcccaaaaggaaccattatttcaaatcctatcaccatagcttgattttatttattttagaaattcatacaaatggaaccatagaacaataacatttactcttttttaggtctggcttttttttgttcaacagcataagattcattcatatggttgcgtgtggcaatagtttgtgtttactaggcgaataccccagaatttattccttgtgcatttgatgtatctttgcattgtttcaatctgggagcctgatgaataaagttgttatgaatattcttatagatgtcttttagtggacatttccatcgtacttacttctactggacacgcacccagggctaggtgataaagtgcaggttttgggtatggatgtactattttacatttccttccatattacatgagagttttagttcctccacatttttgacagtacttggtacttgccaggtttttttaaaaatcaggttaattgatgtacaattaacaataaacaataaaatcaaccctttttagatgtataattctgtgaatttagacaaatgcatacagttgtgtaactatcaccagaaatcaagatacagacagtttccattaccccagaaagtgtcctcatgtccctctatagtcagccccctcaggcccttttagccactagtttgatttctctccctgtagttttgctttccttaggaagtcatacacatgaaatgatacagtatgtagctttttgagcctccttctttcactgaaatttattcatgctgttgcatggatcatgaagtattttattcttttttgctgctgaatggttaccccttcaccagttgatgcacatttgggttttttccagcttttggcaagtatgaatcttaaagccactataagcattcacatacaggtttttgtgtggacgtaagttttcatttttcttcggtaaatacctaggaataggattgctagttcatatagtatgtgtatgtttagctttatgtgaaacttccagactgttttctgaaagtggctgcatcattttacagtctttctggtattatgttgacctttcatttgtttcccatcctcactaacactgggtattgtctttttttttttttttttaaatttcagccatttgttctagtaggtatgtggcactcatcatgattttaatgtgaattttctgatgattaatgaagtgaagcactgtttcatgtgtttcttggccatttggagatcttcttttatataatgcctacatgtgtcatttgctcatttttatattggatcgtctaaccttttctagttgagcagtaggagttcttttttttatcttttcctgtaatccactgtaccttagaaaggagttcttcatatagtctgtatatgagttgtttgtcagagatatatgagttgcaaatatcttctcctccctctgtctgccacctgtttaaaataattttattggaacatagccaacatttgtttatatattatctatgactgcttttgcactacaggggcagaattgggtagttgtgatagagacctactgacctgcaaagcctaaaatatttagtgtctgatctgttacagaaagtttgttaacccttgatctagagaaccgtattcattttctattactgcataacaaattgccacaaatttagtagcttaaaacaatgcccacatttattagcccacagtttccatggataagtaggctgaggacagcttagctgggtcctctgcatagagtcacacaaggctacagttaagcttttggccagggctgggctctcatctggaggcttcaatggggaaggatccatgtccaagttcattcaggttgctggcagaattcatttccctgtggccttgggaatgatagcttccctcttttactggctataggccagagctggccctcagctcctaacggccagttccctgccacgtggccctctccataggaagtccacaacatagcagtgagctcattcagagccagcaggagagcaagaatgagtctgctagcaaggtagaatcatttaatgtaacaaaatgacaagagtgacatctcattatctttgccatattctgttagctagaagcaagtcacaggttctactcacactggaaggaaggggatgtacaccaggagggtcaccttagagtctgtcacagttactattagtaatatattggtgtcttaagtttacagatgtttttctatgtttatatagttgaattctgttttaagcaaaaatggcatcatacagtttcttttgtaactggcttatataataatatcatgaataatgtaacatgaacattttttcatgtcagtaaatccagatccatatcatttcttattgtggcttgtatcatacctcactatttgaatataccataatttatttaatcaattccgtcttgttaaatatcaggattgcttgtggtttatgtcacattttaccaggctgccatagaagtatatgtgagtgcccatttccccacactgcctcagtgctggttataattctgttgcagtcagtggctcttgacaaaaatgtatatgtgaaactgaacacctcctattctccttccttctcctgtgtatctgttttagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 35839 - DNA, 13283 bp, Homo sapiens
gcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtaagtttcccccactgccccggacctgttgcaggcgctgcgggcttcaggggctgcttcggctgcaggggtgtgttcgcgaggggtgagcgtgctccgagcactcgggagcttcgactagagggcaaggggagctcttctcggtgcggagatcacggtgcccgccgctgccctcccacagcaggcagaagccgggcatcgccggagaggtcgaccggcctcccctccgcggtgcaatgtctggggcgagccgctggggaagcgaggagccgagctaaggatacagtcagcctctctcctctgcggaaagcagcgctttcctgggggtgaatgtcgcgctgcgtcgctccccgcagcctccagggccgagcgcgcgggatggttggcccacgttgcatcctccccggcttggaggaaagttggggccatgcacagacaccctgagtgcgggcatgttcactgcggcggaaatgtctatagagaatgaatgaaaactgctttctgaaaaactagtttcttgatctgtcgtgttaacattattagttacaaaggataggaattggtgggcctggagatgaaacactgaatttatccacatgcggtttggtgtcacacaggcatggccagcttgttaaatagcgttgcaagtgttaataaaaagactctggcaagaagctacttttgttaacaagatctttataatgttctattgttaccggtaatgtaaatgcccagaaaaaaatctgcttagtttctcttttgattggattgagatcaggttcaaaacctggagaagggtgcgggacgctaagcattggaggcagagagcctgagttaggagcatgaagtgaactgaagttactgtaactgaagcccttttgatgttcacagtaatagcagccctttctctgtcttctttgcagacgtaggttaagtacatgtgtgcattttcttggccacttacttggtatgcaaatgtgatttctctgggggcttaaaaatgctcgaaagatgattcattttatgttgaaggtgtgttcagtgacttgtatacatggtttctgctgatattttgaggtttgcacagttttaaaccagaaagcaagtatttcctcttgggtttccaagtttactttttattttaatcaaacattgttgcaagaatgttgattgtgattttgactgtgacgtgcttttccatctgggtggtatccaagatgacaggctaggctcttccttctggcttgttgggccaacctggaacatacaggagcataaacacaggatgcggagagatgtagatcctatatcctaaggtcttctaagcaaattgttttcttaggtgtaagtctggttgtgaatgttgttttgcaccatcctgaatttaatgttcaaggaaatgtgttctgggcctagcatgattccagctcaatgtgtaagcattttggtgcctgtgcacctagtttcagggagcctcattcttccttcactcagggcagcatttgctctgagagaggcggcagattcacaagagtaagtagacagtctattgaggtttaggtttaaagtcttcctccagatactccagattgaatgtactaattaaaatagcaactacagtggtggagcattgagaatgctaatgaatgttttaaccctttggaaacctgatgcattcccataggttcatatggtcattctccaaaacactgggcattggttagaatggagtagacagtagatgcttagcttgaggtgggagtgaagctggctcctcaccattttttatatctcaagtcactgtggaaattactgggtgctttgtaaagtcttcctaacactggagctctaggactttgttgcttcctttcttccactcagccatgtttactcatcataaaaaattatattccaaaaaggaaagaaaactagttgcatcacctaatggtatgaggtatatgtgtcatgcccctgcctttgtggttttctgtgcagtcttatagtggggctcacatctggttggggaggtgcaggttagtattttagcccatgaatctgtggcaaatcattcatttgcatttattaataattcttagaatatgcatttaaaaatgtctgaatggttaaaggaaacagagtttcagctgcgcttttgggactggctgttatgtgtctggaacagatactgcaaccagccacacagtttaccctctggggataaacagcgggataaacagcttccttaggaatccttggacaggcaggttcttgaggacttcattcctttgaagtaacagagggatggtgtaaaagaaaaggatgaaggcatgtgattcagtttttgaagatgggtgacaagcatttcctatgtctctaccctactgttttcttactgaagaaaaccaaaagatagcattagattctactataatttcaatgtagataccaaggaaagcactgtagtcagcaaataaattctggggtggccctaaattaacaacagctggcaaaatacacacacacacacacacacacacacacacacacacacgtattttttgatttaaataaagcagtgtttgcattttgaactccttctatgcaggtgtcagcatttgcaggtatacaggaacagtcctagtgatgcactatttaatcaaaagacggatggatcttttgttcttgcagctggttttccaagaattgatataaagcgggaagaacagaaaacagcagtcataagtatgctactcaaaatattcttctttttatgtgccaaatcctcacattggaagctgtcccgagcaagacaggtagttggtgattatggccagaatttattctgtgctttgactaaaggcttgctgatcaatatatggttaatgttgaaattggggtgcttttaggactcttcagtggtagagctgtctggttagaaattaatctttaagttgggatgccgaggtgggaggatcaggtgaggccaggagtttgagacccggtctctacaaaaaatacaaaaaattatctgggtttggtggtgcacacctttagtgccagctactcggaaggccaaggcaggaggatcacttaagtccaggagttcgaggctgcagtgaactgtgattgcaccactgcactcaagccagggtgacagagcgagacttggtctcaaaagtatatataaaatgaaatacattatctgtaacatttaaataaaggtctgatcattgcagaagttggccttacatttcccatttactgtatgtgctgggagattggatcttaccaaaggaattcttaatggaattaattattaggtgtttgttttacgcatggctttatgttgcatggggcatgaaagccagtgcccatcctggcattataagagcaggagacctggcattttaagtggcccgcagtgaatgagctggactaggacagggagctgtgggaatgagactcactcctcttggcttttgctgacttatattctaaaagacttcgatggcctgaaagttggcaatcaggttttccaagatgaacctgctttttatgcagtgattttttttttttttttaaacagtgcagagttcaaatagctcaacagtattagcagtgaatatccttccttccgggtagttgtctctggctttgtcctggaatggccatacactattctagaatagtaggtggcatggtcaacaacaaagtgttctgttttttgtgcaaaaccattgttgctttcgttctgctgttctgaacatcaggagcatcattttcaatttattattattattatttttaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgaggtaagaagtttagctatagatgtaagtatgcatataattaggctattgtgtaagttcagtacatggggtgagatctgatccacagagactgtactgcagaagtactaccaaagctgtaaaaataagagagctggtgcccctagaacttatccacttgtgttgaccacagcctcagcccccaccatggcattagccagtggttctcagcttttactgagcctcagaatctcctgaagagctttttatttattttattattattattattatttgagacagagtctcgctctgtcacccaggctagagtgcagtggcatgatcttggctcactgcaagctccgcctcctgggttcacaccattctcctgcctcagcctcccgaatagctgggatacaggcgcccaccaccaggcctagctaattttttgtatttttagtagagacggggtttcaccatgttggccaggatggtcttgatctcctgacctcatgatccgcccgcctcggcctcacaaagtgctgggattacaggcataagccaccgcacccggccctgaagagcttttttaaaaactgcccatcccagagacttagtttcatttggtctggggtggggtccaagcatcagtatttttaaaaagtttccggatgattccaatgaacaaccaagttgagaacccctgacctctgttaagtatgccagctaatgtttattgagccctcactgtgtgcttgcagcggtgccacgtgtttcccacggatcatctcattctatcctcacaacaaccccgtggggaattattactagcttcattttatagatgaaaaaaccttcatgcattacggaggctaagctgcccgagttagcagagcttagtaagaggtggagctggttaggaagtcaatgcagggggtctggctctagggcatcagcactggagcatcgtgttgcactgccaccgaataaacttgagcttcacatccatgacaccaatgtcatcccaggtgatacttcatttatattcaaattttgcttcctcaaaccctttgtagaatgattagggtttaaaaatgtattgctcaaattcattcctagtttattctctccaaaattattagcttattttaaatgttttacttaaaaagtagccccctttaaggcgtttattacctttaaagataaatctatatctgtctttgtaaaaggttgcatgtacatagcagaaatttgtgcagataacacagagccacctaaacttcccaaactatggcctttcagagttaatcagtcaggccgaccctattgtcaaggctaacaaaagttgtgtttctgagtcatatatctgagtacataatagttgtctgtgtatttaagagtatagaatactcttggctcaaataattaataggcctacacagttcagagttcgcaaagctcacggctgctttgctgctaagcattcttaggattggccccaggaatcgcttaggcatgtgtaagtatagcccagcgcacacaggatgtgttgacttgttttggtgattcatgggcttattactaataataagagaagaaagtaactgctttggaggaactacaatgaaaacaaactcatttacttgggaacttttggctctgttttccctagtatgtttcacacctttgaaggggacttcaaagggagaaaaggagatctaggcctagtggcaagctaagcacagaggggtttcatctcattggtcttttctttccctgtcccttacagctcatttagaaacatcattaaacttggcctcactctcacatttcagcttgccattttattttctttttgagacagagtcttattctatttcccaggctggggtgcaatggtgctatctcagctcgctgcaacctccgcctcctgggttcaagggattctcctgcctcagccttccaagtagctgggattacagtgcccgccaccacgtcgggcttttttgtatttttagtagagatggggtttcaccatgttggtaaagctggtcttgaactcctgacctcaagtgatccacccatctcagcctcccaaagtgctgggattacaggcgtgagccaccgcacttggcctccagcttgctattttttttacttcttcagttatctcttccagccttcgtacagttatcagagttctgagttatgtcatgctttcctggaatgaaactccttcaaagcagcaggaacaatcagacacctcctctggggagcaactgggctaatagtgtctcacaccaaactggttttttgtagccttgctggcatctcagtaatcttgaataaacaaatgctctgaaagtggttatttcatttgagatatgaatgcatgactcacctctaaagcaggtttaaagaacctcctaggcgaaagcatcaattaacagcacacttagttgggtgttagtccagaactgactatatttgcacagaagagccataaaaattgctaccagggtggtggtacataaaaaatgacaatgggcaggctggctggaatccttggaacaaggtaaggaaattgaggcagaaagaggagagaagccacatgtgtattctggccctagttttaagttctagaccttcctgagttttaggttgcttctctgtcaaatgagtggtttgatctttaatctcctgtgatctgtcccaactcagacttgggtcaattgataggggagttaaaagaggcgaaaatacctagcccagtgcttgacgtgtagtaacttactgtgagataatggcagtggaattagctttctgtgtggtaggaaaatgaggtttctttgactattatctgcttgttatctttagacttcacttttggttcctcctttttcagcccagagtgaacatgttggcaaacacttgacttcaccctaccctgggtgtttgaactgaatcatacccttccggtcgctgggaaacagagcaagtaaagtgttaagttatatgtgaaataacatcctcttcacccttggcgctaccagtgagagagtcaagcacatgaaaactaaatttgacagggccaagtttgctgcttttaaagggcagcgtaagcgcctgatcaaagccactctttgaatttccgacagggagaatgttggttaaaatttctaaagtttactacacaagatagtgctaaaacatttaagagggggttggagtgccttaaagtgctgggtaggtgggtctcagtcccaaactgcaaattcctctgccctccaaatgtaggtgctaacggaattaatagagtgtttaacagaaagtttccctaggtcttaaagctcatccacctaggaggttttatctgcctcctgctgctctgccagtgggtgggaagggcagaaaggaaattactttgattatcctctgttttcatggtgccgtgtggcctcaacctaacttaggctttgatttgctttgtttcttctctagattttgttgttgttgttgttgttgtgtgtcctttttttttttattatcgttcctgtttgaatatgcaattttttggggggagggtgtgtgtattccttttttcctgtttgaatatgcattgtcttgaaattttatattattataagatacattcttttggcctaatgttgacatataggttacaaggaggtggaggtggggcaatgacaccgtagtctaaggcatgccttgaaagcttgaatcactgttaggaaacagccaaaagaaacaactcatgaaatgaatcaggcttctgaacacacaaaagcaaagaattcagtgcaaggtcatgagtggctcctccagaattccctttgtctgtacttagacttacagcaatagggatacaaaagccctctgcacaatttccccagatgaaatgagaaataaataaatgggaagagtaagcagtgtgaggaaatgcaagctctatgaaatgtgcaggctttgtggttacggcactttgaattgatattcacacttgatgtacgtagattctgtagcactggcatgccgtagctgctggcacctacgtgtggactgacgaactttgagaataaactccaaacttgggctgttgaggcctgatacattgtcatgtgaaaggaagcgagactgatttctgccataatggataacagagatgcatttaaataagaggattagtatgtctgcctcctagatggtaaagttaatttggaatctttcatggtacatgggccaaggagggtttgcacaggaatctcccttcttttcaccccttagtgatcactttacagtcgctctgtttaaccacagaaagaaattttatgaatgttggaagcagaagatggcaactcctaatagcatctagacatataggtttggatttgaaagtgtgtatgcttaggaaagaagtgaaggtccttctttagacaccactgtttttgtcaggccagccatctgcatggatgtgtacgtgcacacgtgtgtgcatttaaggcaagtactttaaatatctttgcacagttcctactgaacatgtaagacctttggaagcaatattgtccagctccataccaagtttaatttaaaaaaaaattttgtggctaataagaaaaatttaaaaactatggcatcacacaaatccttcatgcttttttgttttgttttttttccttttccttctatttcagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttc

SEQ ID NO: 35840 - DNA, 67266 bp, Homo sapiens
gcttcgcagcgtcacgccctccggggccgtggcggcgacggcggtgcgtagcttactcacaggggcggcccgtatccctccgccgccggcgcggctcggccctccctcccctggcccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggtaagcggccggaggtcggctgcgctgctggccagctgagcaggctgcggcctgcacttcccgccgtagtctccgtcgggctcgcggcctccttggatcttgctgccggtgctggcccctcggggcggcctccataccccactcccagtgatggcgcccgtggaggccccggcgcgcagcccgcgcttaggccggaggtgctctcgcggcctcagcgttcctccccggctgcccttccaggcccgcatggtgtggactcttagggcttctctccagtctgggactgccgctgcacttgagggccattgtcgggccaggatggcggggttggggccgaggggggcgctggggcgttgggcggccccttcgacagaggtcgaaagggcttctcgccccatttctgttccctcctcccacacctgccctagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggtgacttaatgagggaggagggaagtagagggagaatcattttattccttgaggttgctgtatgtagttagaaactaacacttccgttttgcaggattggatctaatagaaaagctgtacattggcaaaggtagaggtagaaacctgaacattgaaaaccaccagagaaattatacaaaagttcctttcacagcctcttcgcaaaatggacttgacgctattaggtgatatgtttaccgagactcttaactgggaaggggttttactagattttgtattaaaaaggatttctttgctctttaaagtgaagggttatttagttatcaataaggaggttttcctaataatacatctagactataagattggcttaaaatttattttttttccctttctgatgttgtaacctcttagtgccactttcatgttttttttcttagaagtagggaggcaccactattaatttctgtttggtgtttcacttggctactcagattggctatattaaaccggtagctacttttttcttcaatacatctttttccttttagtggagaacggggtcttgccgtgttgtccaggctggtgtggaactcctgggctcaagctagcctcctgtctctgcctcccttaagtgttggaattacaggcatcaatcagccactgcacacggcctatacctgtagctacttagaagtaggtactggggttatccattctgaatgatgggatggggatgcaagaggaagagaaccagtttttagcttgtcttaaactaagtcagaatacagattgatgatttaaacacctcagctcagcggttggtcctcatttcatttttgctcaaagacagtgtggaatcagtcccattggttactataattaggttagctccttaacttcttttgactctgatttctaacaaatgaagaagggcagattttagacaataaatcttgtactaaaatgaaatggtatttgttaaataccataaagaagcttgaaccttaagcaaagatgtcttaaagaaccgtttaaggggcaggggagcacactgaggagtagtcatccaaaaaaaatatatacatatgtattttaaaggcttttaggaattgctaggtccttatagaatctaactgggaagttatcaaatacctgtagaagcttgtcctcttattttataacctgagaaagagcaagtgggtataatgtgtaataatttacagataaagaaatgtagacctgccgggcgcggtggctcacgcctgtaatcccagcactttgggaggctgaggtgggtggatcacgagatcaggagatcgaggccatcctggctaacacggtgaaaccccgtctctgctaaaatatacaaaaaaaactagccgggcttggtggcgggttcctgtagtcccagctactctggaggctgaggcaggagaatgacgtgaaccggggaggcggagcttgcagtgagccgagatcgcgccactgcactccagcctgggccacaggcgagactccctttcaaaaaaaaaagaaatgtagactttaatctctacattgaattatatgtgtaacggactttttcagagagggaactatctctttgacacaaaacatacgttttaattaataatacttgctctggtaatatagtttcttatgagttgctacatattttctagaatagattttccttaaaatatgcctttgtaagatttttttaataaaatcaagtttagaaataatttgaacttttttgggggatagagtttcagtcttgtcgcccaggctggaatgcaatggcacgatctcagctcaccgcaacctccacctcctgggttcaagtgatttttctgcttcagcctcccgagtagctgggattacaggcacgcaccaccacacctgtctaatttttgtgtttttagtagaaacggggtttcaccatgttggccaggctgatttctagttcctgacctccggtgatccacctgcctcagcctcccaaagtgttgggattataggcgtgagctaccgtgcccggcctgaacttttttttttttggagacggagtctccctctgtcgcccaggctggagtgcagtggtgctatcctggctcactgcaacttccgcttcctgggttcaagcgattctcctgcctcagcctccggagtagctgggattacaggcactccgccgccatgcccagctaatttttgtatttttagtagagacgggatttcaccatgttggccaggctggtcttgaactcctgacctcaagtgttctgccaccttggcctcccaaagtgctgggattgcagatgtgagccacgtcatctggcctggcctgaacttttagaattcaatattaaccattttcccctagtttattccctagagctcttcacaaagtatggcttgacttctctgagacagctagtgataagaaaaatgaagtttattttggtataccactcaaaaagattgtgaaaacaaaatggagattaattttttttttccaaactctttgtaccacaattttaagttgaatagctgacttcctaggcatggataagatcagttctatcttatcttctgtcctagtaatgtgtctgcagtggaatccccattgcttggcttctataattgatcttgaaccttcccaattatcattccctgaaaaaataattctacttaaataccttcttgacttaaatgtcatgagttgctacatctgggttctgataagatttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtcttgctcaggctggagtgcagtgtcatgatcttggctcactacaaactctggctcccagggtcaagcagttctcttgcctcagactcccaagtagctgggattacaggcactcaccaccatgcccagctaatttttgtatttttaatagagacagggtttctccctgttggccaggctggtcttgaactcctgacgtcaggagatccgtccgtctcggcctcccaaagtgttgggattacaggtgtaagccactgtgcccggcctatggctagcttcttttaaggcgtctcaagacaaagttctcaatgaaataaagatttcaggtcatgcacagtgggtcatgcacagtgggtcacgcctgtaatcccagcactttgggaggcccaggtgggcagatcgcttgagctcaggagttcgagaccagcctgagcaacatgacgaaacatggtctttacaaaaaatacaaaaaattagctgggtatggtggtggatggctgtagtcccagctaggtgggaggctgaggtgggaggatctcgggagcctgggaggtagaggctgcagtgaaccgtgatcaagccgctacactccagcctatgcaacagagtgagaccctgtctcaaacaaacaaacaaacaaaaagatttcaaactctgatgtctataaaagccaggcaggtaccaaagtgagcagagagaacttgagggagctagaaaatgcatgtgctatcagatgagggcaactgctaaccagctccctgcaaatgttgctattgctaaaatctgtgggcccagtgttgcaatatcttccattcaaaaaaaaaagagaagccacaaatccagattttttggcaaccgattcaacttaaaaaaaaaaagaacaacaaaatacgcatttttggtcgacatcagtttagtatgtggattaaagtaaccagggattggggttcattaagtaatcaggagtgtaaaaagattaagtcatttaaacaatactttctgtatttttaaaagtttgaaagtaatgctttatgtaagattaagttttcttgtttgtttgtttttgagatggagtcttgctctgtcgcccaggctggagtgcagtggcatgatctcggctcactgcaacctccgcctcccaggttcaagcaattctcctgcgtcagcctcccgagcagctgagactacaagctcgcaccaccacgcccagctaatttttgtatttttggtagagacggggtttcaccatattggccaggctggtctcgaactcctgaccttgtgatccacctgcttcggcctcccaaagtgctgggaatacaagcatgagacaccgtgcccggccttaagtagtttttaaatacaattctaattaacttgctttttttttttgagacctcaggtgatttgcccgccttggcctcccagagtgctgggattacagggatgagccactgcacccagccaatttgctaagttttttttttttttttttttttgagatagagtctcgctctgttgcccaggctggagtgcagtggcacaatctcggctcactgcaagctctgcctcctgggttcacgccattctcctgcctcagtctcccgagtagctgggactacaggcatgcacccccatgcccagctactttttgtattttcagtagagacggggtttcaccatgttggccaagctggtctcaaactcctgacctccagtgatccacccgcctcgacctcccaaagtgctgggattacaggcgtgagccactgtgccccgccttttgtatggttttgtgtgaggtcttgggaaaaccagttttgtaaatacattgatcccgtagaagtttatgtattactcttccattatgatctgtttcatgttttgagtttctctgtagactgacaatacactttgaaaatgtctgagattgggaagttaccgaagcatgatcttaaagaaagtagttgtaacgctgaacagtactgtattttaaaaaattgcttaggctgggtgcggtggcttatgcctgtaatcccccagtactttgggaggctgaggcgggccgaccacctgaggtcaggagttcgagaccagcctgcccaatatggtgaaaccctgtctctactaaaaatacaaaaattagccaggtgtggtggcactcacctgtaatcccagctactcaggaggctgaggcaggagagttgcttgaacctgggaggcagaggttgcagtgagccaagatctcgccactgcactccagcctttgcaacagcgagactccatctcaaaaaaaaaaaaattgcttaaaaatactgtaggccgggctgggcgctgtggctcatgcctgtaatcccagcactttgggaggccaagacaggtggatcacaaggtcaggaaatcgagaccatcctggctaacacggtgaaaccccatctctactaaaaatacaaaaaattagtcagtgtggtggcaggtgcctgtagtcccagctattcgggagactgaggcaggagaatggcgtgaaccgggaggcagagcttgcagtaagtggagatcgcgccgctgcattctagcctgggcgacagagcgaaactctgtctagaaaaagaaaaaaatgaaaataaaaaatactgtaggccgggcgcggtgactcacgcctgtaatcccagcattttgggatgccgaggtgagtggatcacgaggtcaggagttcaataccagcctagtcaagatggtgaaaccctgtctctactaaaaatataaaaattagccgggcatggtggtgagcacctgtgatcccagttactggggaggctaaggcagagagttgcttgaacccgggaggtggaggttgtggtgagctgagatcgcaccactgcagtccagcttgggcaacagagcaagactccgtctcaaaaaagaaaaaaaaatactgtactagaggtgtggtaccatatattagattaatattagaggtaaggactgattgaattcctatcaaaatgatgaattaacaggtagtcctgtggagtattgggaactttaataaatggttgtctgaatatggctatttaaattagttctatcttggatagttctatcttggataccttcttactccaaaaggtgagcttcttcacataagttctgggaatttttttttccccactaaaaaagtattttttatttcctttacaaaagatcattgaattaaggcactttctttggctctactagattgttatttaaatataattcaaacagccatcgaggataactgttaataaatctaggttttctctgaagtctcccagtgtatattactgtactgatgactgacaaggaagaggttttgacaaggtccaattctgtatatttctcttaaaatatcctaggcagttcccaggataggagtatctgactcatgcctcatgctaccaggaacctttgcagcctcatcccagaaatgcagaaacacacttgttttgtctgtagaaataaagttttgatggttagatttccaggcaaaccttcaaaatcatgttaaactataatatagggaaataaagtagtgtttgttcttctgtctgcagagtcaagtgagattttgggtaatagaatcataaaatgttagcactgcagcacatctcagggctgctgtctggaaaggccgtgtgacctaccaggtaagagtaggtctgaattgagaacctggatttctggactgtccagtgtattttctggcaagccatgtgttatccttacatagctgttaggtatataaatccagaggatgcagccttttttcttttgttcaaacaattggatatttaaactgtgtcctggaacctgaagatcttcctcaacttccctttatatgattggcaaggttgctcatactgcttgaaactgcaaatttaggcttgacacagtggctcatgcctgtaatcccaacactgggaggccaaggtgggaggattgcttgtacctaggagttcaagaccagcttggtctgtaatgggagaccctgtctctacaaaagcgaaacaaagtgaaacaaaattagctgggcatggtgatgtgtgcctgtagtcctagctactcaggaggctgagacaggaggatcacttgagcctggatgaaaggttaaggctacggtgagctgtgatcataccactgcactccagcctgggcagcagagccagattctgtgtcaaaacaacaacaacaacaacaaaacaactattgcaaatttggtgttctattctcaccaccaccaccaccccgcctttttttcccccgaaacggagtctctacctctgtcgcccaggctgaagtgcagttgtgcaatctcggctcaccgcaacctctgcctcccaggttcaagagattctcctgcctcagcctcccaagttgctgggaccacaggtgcatgccaccacgcccggctaatttttgttttttgtttttatttgagatggagtctagctctgacgcccaggctggagtgcagttgtgtgatctcggctcactgcaacctctgcctcctgagttcaagcaattctccagcttcagcctccagagtagctgagactacaggcgcgtgccatgatgcccagctaattttttgtatttttagtagagatggggtctcactatgttagccaggatggtctcgatctcctgacctcgtgatccacccacctcggctggtttggaactcctgacctcaagtgatccacctgccttggcctcccaaagtgttgggattacaggcatgagccaccacccccggctttctgcatatatctttcatcagagtcaaatggattttgttttttaagtgaaagcaagtttattaggaaagtaaaggaataaagaatggctactccctaggcagagcagcctcaaatgggtttttaatctctaaaaagactaaaaaccactgtccttccaccttaaacattattttaatctcagcagatgaacagagtacctgttctgcagagaaaatataaatcttacgtgtgagttgttagggatttccttcaaggtattaaaacaacagatcggctgggcgcggtggctcatgcctgtaatcccagcactttgggaggccgaggcgggtggatcgtgaggtcaggagatcgagaccatcctggccaacatggtgaaaccccatctctactaaaaatacaaaaattagccaggcacagtggtgggcacctgtaatcccagctacttgggaggctgaggcaggagaatcacttgaacccaagaggcggaggttgcagtgtgccgaggtcgtgccactgtactctagtctgggcgacagagcaagactccctctcaaaaaaaaaaaaaaaaacaaacacagatttcagctatccactttagagtactcactgtgcatcaggaattacttgatcttttcaataatctttcaataattctgttctccccaggttagataaggaaacagtgggagaaataaacttgcctaacattatatggttatggtaggaagaactaggattcagatacaggcgatcttgactgtagagctattgtgtctccagatttacttgttttagtcatagcccttctcccctctaatctctagagaagctttacttttccctttgccaaacttaacttttgctttccatccttttctctctctctctttccctctttccttccttctctccctccctccctcacttcctccttccctcactcacttcctccctccttccttcctttttccttttcttgtttttgctctccggtaattgtctttgttttcatacttccaatctcttctccactaactcctcttagcatccaaacttatcgaaggttttcccctataaaaaaaaaaaaagcagtaaaataactttttaaacttccctcttccataagagctacttccttcctcatctttatccttcccatctctgacatttcagtcccagaattcttgaaagaatagtctattcactgttctggaactatttagtaaggtcactaatgattacttaattgccacattcagtggatacctaagtttttatttaactttcgtaatagttgacatgattttcattcagttcctttggcttctgataaactgctttcttcttcctcatatctggtgtttcccaactttattagaatgcttatcaaagtagtattgttgatggagtacaagccaaagtgtatgaaatcatgcatacttgtattaaaattgagagcactggctggatatggtggctcatgcctgtaatcccagcactttgggaagccaaggcaggaggatcacttgagctcaggagttcaataccagcctgtgcaatatagcaagaccctgtgtctacaaaaaattaaattagctaggtgcagtggcatgtgcctgtaatccctgctactcaaaaggccaagacaggaggatcgcttgagcccaggagtttaaggctgcagtgagctgtgatcatgccagtgcactccagcttgggccacagagcgagatctgtctcttaaaaaaaaaaattgacagcacaaattacctcagataaattaattattattcttttttttttttttttgagacagagacttgctctgttgcccaggctgtagtgcaatggcgtgatctcagctcactgcaacctccgcctctcaggcccaagcaattctcctgcctcagcctcccaagaaaagaagctgggattacaggcatgcaccaccgtgcctggctgatttttgtatttttagcaggtttcaccatgttgaccaggctggtcttgaactcctggcctcaagtgatccacccgcctaagcctttcaatgtgctgggattgcaggtgtgagccaccatgccccacctgatctcagataaattaattaaaatatataatcaaaataatgtcacaaacagaattattaagaattatcaagatgaggctgggcgcggtggctcatgcctgtaatcccagctctttgggaggccgagacgggcagatcatgaggtcaggagatcgagaccatcctggctaacatggtgaaaccccatctccactaaaaatacaaaaaaattagccagacgtggtggtgggcacctgtagtcccagctactcaggaggctgaggcaggacaatggcgtgaacctgggaggcggaacttgcagtgagccgagatcgcaccactgtactccagcctggacgacagagcgaaactccatctcaaaaaaaaaaagaaaaaaaaaaaagtactatcaagatgaaacatctgtcattcttattttgctatcagttttaagaatagtatttttcttacataataaaagtcatcctcatcaggtactcctttaaatgtcttactgtatattgttttcattgcagtataatatgaaaatttgtttccaacagatacattgtagcaaaagaaagaatacagactgcatattttgcagttaggctgctgctgacattattaattatcccatcatggataggtcaccctaatttttctgaaaaatgcctgttctttgcttgtgtttattttgaaataatacgactacttgggcttaggaatcaaaggactctgctttccatttaaaatgtctttctcggccgggcgcagtggctcaagcttgtaatcccagcactttgggaggctgaggcgggcgaatcacgaggtcaagagatcgagaccatcctggctaacacggggaaaccccatctccactaaaaatacaaaaaaaattagccaggtgtggtggcgggtgcctgtaatcccagctacttgagaggctgaggcaggagaatggcttgaactcgggaagcggagcttgcagtgagctgagatcacgccactgcgctccagcctgggcgacagagcgagactgtctctaaataaataaataaataaataataaaaaatgtctctctcctagatataagtcaattgggaatgagtacacttgaaatatttaatatataataagcttcgattaaataacttctctcttttttttttttgagacgaagtttcgttcttgttgcccaggctggagtgctatggcgtggtggtgggggcctgtaatcccagccactcaggaggctgagtcaggagaattgcttgaacctgggaggcggaggttgcagtgagctgagattgcacactgcactccagcctgggcaacgagagtgaaactctgtctcaaaaaaaaaaaaaaaagtaaaatttagaagaaaaatattactgtctttattactataatacatattagtaattagtatctcctggggaatgctgctgtagttgtaacgcttgtagttggtccttcctagaatcatgttctccggtctttgttcagtgcctttgcttatacagagaatctcttctcaccccatcccctacctcctaaattctttattcatacttggggacccagcagaaatggcttctctaggaagcatgcatgaggcatacaggcagtcagagttcaactgtagaatcgtttcttagtgtgtagacatgattgattattcccctatttagactgaactctcctgggcaaagttcttgtcttattcttcgtattcctagtacctaaagcatggtattctgtgtttgccaacaacattcagtgaatgccaatatcaggtggggtggcaaaaaaaaaaaaaaaaaagaaaagaaaaggtggaattttggagcatttgtggccttaggcaagtcactttgcgaattttcctgagcctcagcttccttgtctgtagaatgggaattgtaccctgcaagcctgtggggaagattagatagaagagggtttagcattttggactacataaaagataattttgttgttattttttacaaatgtgcttggcagttttattcacagtacccgatacttagaaacaactcagatatccatcattagctgaatatgtaaacaaaatgtagaaaatccatatactggatggagcattacccaccaataaaaaggaacaaatagtgaaacaaccctgccacttagcagtttattagttggctccaagttcaccctcccgtacttgctctgctttgactaaataacttctgaagtatgtatttcagctggtgaagagctggactctttcacctttgcagtgaacaacatgttgggctttgtcaatagagggcactagagggacattacagaggaaaggggcttcttagatttggtggacttttctttttttaagtttttaaatattatcatggtgtcttaacatgccaataatgttgacctacggaattggtataatctcaaaatcttaggtgtcagtgttaaatatatgtttcacttttacttcatcgtcaccccaagcaaaaaaagaaaaacctgaatgtgaaaagaatgaagtcttataatatttctaaactaaaaaagggattgaatcccagtattcttcagcaaacttcaaaatactgtcaccttaatatgtttttaatacatgtgatatttttgtaggtctagaattgtgaaatcaattctcttaaacatcttattatagaagtgtctgctgctatcctttgagcactaaccccaccacctgtaatgcatcatgccaatataagtgatagaattgctttgctaaattcttaagggcttatgtcagggaaaaactttgaaattagctgggtacagtggctcatgcctataatctcagtgctttgggaggccaaggtgggagaatcacttggctgggagaccagcctgagcaattcagcaagaccccttctctacaaaaactgcaaaacttagccaggtttggtggcacacgcctgtagtcatagctactgggaagactgaggtggaagaggaggatctcttgaggcccagagttcaaggcggcagtgagctataatctgcactgcactccagcctaggtgacagagcgagatcctgactcaaaacaagacaagccttgaaatcaaagttgatttttacaaaagcctcaatggtaggagttttagatttcttaaaataatagcacactaatggagtgcgtgattttctttagattaaatgtttacatatttataccatctgtattagtttcctagggttgccataataaattaccacaaaccgggtggcttaaagtaacagaactatattctctcacagttctggaggccagcagtctaaagtcagtctgtcttcaggtccatactctggatgttctaggggagaatccttccttgcctcttccaactttggtggatgtcagcattccttggctcctttggtttgtggctacatcactccagcatctgcctccatctttgtatcaccttctctgtgtgtgtcttctcttttgtgtcttatatggccacttgtcattaaacttgcccatccacgtaacccaaagatgatttttttttttgagacggactacagacacgtgccaccacgcccggcaaattttttgttttttagtagagatggggtttcacgttgttagccaggatggtctcaatctcctgacctcgtgatctgcccgcctcagccttccaaagtgctgggattacaggtatgagccactgcgcccagccagtaaattctttttattactgtagtagatgatacttgattaaatgccatctcgggtgctttcattgtcaacaaaggtgctcccatctctaagcttacataaaatgtaattttaaaaagacatttctttagatgtacctgttcacatttttgttaatagtctctcatgtctagttttggaggctggaatgttcaagggagccacaaaaatctctgtcagttggtgttttgaataattgttctgaaatatactcccaggcttgaaacttggatctggccttttttttttttttttaacttgaatttttttttttttttttgctcttatgttattcatatgaattttgcaaatagagagccagtcttgtagcatagtaaaatttaacagtttatgtgactattgatctacccatcttatagagattgtctgtctgtaggaagacggtggtaaccgtggtcagactcatcattttgaacactctaggttagtgttggagaatttgtaaaacagaaacttaaccacctgtgctttgaaagagtaaagtccatgaaaagtattacttttaagtttcaaggatttacagttttaggttaacagtttttacatattgtatttcaaaacatcagagtactgaaacttacctgtatgcttcttactaaaaatagttcatgcaggttcttttgggtgatcatagttttacagagtatagtagaaaacaggatgccagttagcatctctctttttttttttttttttttttttttgagatgggagtttcactcttgttgcccaggctggagtgcaatggggtgatctcggctcactgcaatctccgcctcccgggttcaagcaattctcctctcacatcctctcgagtagctaggattacaggtgcatgccaccacgtctggctaattattgtatttttagtaaagatggggtttcattatattggtcaggctggtctcgaactcctgacctcaggtgatctacctgccttggcctcccaaagtgctgggattacaggcatgagccactgcactggctcctggccagccagttggcatctctttaaggtctccactatccacctatattaagtagcacagaaacacaccaagttaatgatactagcattcatctccccccaccaccacattttctcaagcttcgtactgcggtacatgtgtgattagtgttacagaagagggtgtcagtaacccagcaaataagttctttaggtttctggtttgctatgtagttactaaggagggattcagctggtggaggagatccttgcgcaaatgccaggaaggaagcccttttcctcgcatttcagtgtttcctttgaagcctagtgagggtgaagtcttttggcataggtgctccaccatctgtctattcacatagactcttcccatctacctggctatgtgccacccttgttgtggacatagagtgggtagagagcagagaccactgcttcagtaactaaaaatagatggaatttcagatcctgacagagattctctgtggagtcgctaccactgctcctcatctcctggagttagttgcaaggaacagctgtttgtctgatctgcttttggtactatgtatacttcctaatacttttgttcccctacttgctatagaagtagaagtagttttactggaatacctacgattttcctgtcctgtctctctcattcacttagttattttctgccttggctctggttgccaaaattctaaacttctgttttgtgttttgtgtgtgtgtgtgtgtgtgtgtgtgtgtgtgtgttttgacagggtcttgctctgttgtccaggctagactgcagtggcacaatcacggctcactgcagccttgaccctctgggcttaagtgatcctcccacctcagcctttccagtagctgggacagcaggtgtgtgctaccatacctggctttttaaaaaaatttttgtagagatagggtcttgctgtgtggcccaggctgctctcaaactcctgtattcaagtgatcctcctgccccagcttcctaaagtgctggaattacagacagccaccccactctgctaaacttctgttttgttaggtatatgatcccatggctgcagtatcagagaatgaggttattgcctttccatgtaccttatttcgttgactctgaaacacatcaattgaaagatgtaccattattctactaagaaggaaagtatatttagtgccaattaagctgacatgccattgattatatgcagcttgatttcagctatgttttatttttgtttatttatttatttatttatttttgagacgaagtctcactctgttgcccaggctggagtgtagtggcacaatctcagctcactgcaacctctgcctcccaggttcaagtgattctcctgcctcagcctcctgggtagcttgaattacaggtgtgtgccaccacacccagctaatttttgtattttaattttttaaatttttttgagatggagttacgcttttgttgcccaggctggagtgcaatggtgcgatcttggctcgctgcaacctctgcctccccggttcaagcaattctcctgcctcagcatcttgagaagctgggattacaggcatgcgccaccacacccggtttattttgtatttttagtagagatggggtttctccatgttggtcaggctggtctcgaactcccgacctcaggtgatccacctgccttggcctcccaaagtgctgtgattacaggcgtgaaccactgtgcctggcctaatttttgtatttttagtagagatggggttttgtcttgctagcaaggctaggctggtttgggaactcctgacctcaagatgatccgcccaccttggcctcccaaagtgctgggattacaggcatgaacaactgtgtccagcctcagctatgttttttttaaaaagtcttacaatcagtgacagtcactgtaattgtaactatctggttcttcaacagatatttactgggcagttttcatggaccaggcactgtgcaaaaagctggaagtcaggtccctatttgttactgggtcaagagacattaaataatcacatagatgttgggcgcggtggctcacatctgtaatcccagcactttggaaggccgcggtgggcagatcacgaggtcaggagttcgagaccagcctggccaacatggtgaaaccctgtctctactaaagatacaaaaaattagccgggcatggtggcacgcgcctgtaatcccagctactcgggaggctgaggcaggagaattgcttgaacctgggaggcagagttgcagtgagctgagatcatgccgttgcacacctgcctgggcaacagagcgagactccctctcaaaaaaaaaaaaaaaagttgttcccatagataaggctcatgtctgtaatcttagtacttttttttgagacagagtctcactcttgtcacccagcattgagtgcaatggagcaaccatagcttactgcagcctcaacttcctgggctcaggtgattctccaggcatgtaccatcatgcccagctaattttttgtatttttattagaggtggggttacatcatgttgcccaggctggtctcgaactcccgggctcaagtgttacgcccacctcagccttccaaagtgctgagattacagtcgtgagtcaccctgcctggccaatcctatcattttgaatggctgaggagagtggatggcttgagtccaggagtataaggccagctgggacagcgtaacagagtgagaccctgtttctacaaatttttttcttttttgaaacggagtctcgctgcgtgacccaggctggagtgcagtggcgcgatctcggcttactgcaacctccgcctcccgggtttaagcaattctcctgcctctgggaccacaggcatgtgccaccacacccggctaatttcttgtatttttagtagagacggagtttcaccatgttagccagatgatctcgatctcctgacgtcatgatccacccatctcagcctcccaaagtgctgggattacaggcgtgagccaccgtgcccagccactacaaaatattttttaaaataagcaacacccaggtgtggtggcatgtgctggtagtctcagctcactcgggatgctaaggcagtattgcatgagcgtagtttaaggtttcagtgagctatgattcacaccactgttctccagcctgagcgacagagtgagactctgtctcaaataataataatcacacagacaaataggaactgtataaagttgttaaagcaacctgggctttaccgtagtacttaataagaaataaattgaaatggcggaaaagggcttctgggaaggtctctaagggcaatatttaagtgaagcctgaaggtggatgtgggggaggagaggatgggaagaatattctaggcagagtgttcctatagtcctggagtggttgaaatttaaaagttaattaagaaaaagtagactgggcgtggtggctcacgcctgtaatcccagcactttgggaggccgaggcgggtggatcatgaggtcaggagtttgagaccagcctggccaagatggtgaaaccccatctctactaaaaataacaaaaaattagccgggtgcggtggtgagcgcctgtaatcccagctactgaggaggctgaggcaggataatcgcttgaacccaagaggcggaggttgcagtgagccgagatcacgccactgcactctagcctgggtgacagagcaagactccgtctcaaaaaaaaaaagtagaggttgagcattccttatccaaaatgcttaggacgctaagtgtttcagattttgaattttttcggattttggaatatttgcatatacataatgaaatgagatatcttggggatgggacccaagtctaaacacagaattgatttatgtttcatataggccttgcacaattttttggagcctgaacataattttatgtagtttgtttgtttgtttgtttgtttttgagatggagtctcgatccgtcacccacgctggagtgcagtggtgcagtcttggctcactgcaacctctgcctcccgagttcaagctattctcctgcctcagcctcccgagtagctgggattacaggcgcgcgccaccatgcctgggtagtttttgtatttttagtagagacggagtttcactatgttggtcaggctggtttcaaactcctgaccttgtgatctggccgccatggcctcccaaagtgctgggattgcaggcgtgagctactgtgccagctgtttttttggggtttttttttgtttttgtttttttttgaagatagagtctcactttgttgcccaggctggagtgcgatgcaatagtgtgatcatggctgatggcagtcttaaactccagtgctcaagccatcctcccaaggactgtaggcactgtggtgtacaggtgtataggcactgccgcccagctaattttgtagagacaaggcctcactatgttgtctaggctggtgttgaactcctggactcaagtcatccttctgccttggcctccaaagtgctaggattataggccttacacaattttttttttttttgagatggagttttgctctgttgcccaggccggagtgcagtggtatgatcttagctcactgcagcctctgcttcctggtttcaggtgacgtccagctaattttgtatttttagtagagacggggtttcacaatgttggccaggctggtcttggactcctgacctcaagtgatcctcccacttcggcctcccagagtgctgagattacaggcgtgagccactgtgcctggcctttacacaatattttaaataattttgttcatgaaataaaatttaacagtgttttaactgctgcctaccacatgcgaccaggtgtggaattttctacttgtggcattatgtcagcactcagaaaaactttcagatttcgaagcgatttagattcgaattttttttttttttttttttttgagacagagtcttgctctgtcgcccaggctggagtgcagtggctcaatctcggctcactgcaaactccacctcctgggttcactccattctccagcctcagcctcccaagtaggtgggactgcaggcatccgccgccacgcccagctaattttttgtagttttagtagagatggggtttcaccgtgttagccaggatggtcttgatctcctgacctcatgatctgcccgcctcggcctcccaaagtgctgggattacaggcgtgagccactgcgcccggcttttttttcttttttttttttttgaagacggcgtctcgctttgtcgcccgggctggagtgcaatggcacgatcttggctcactccatcttccgcctcttgggttccagtgattctcccgcttcagcctccctagtagctgggattacaggcatgtgccaccacacccgggtaatttttgtatttttagtagagacggggtttcaccatgttggccagactggtctcaaactcctgacctcaggtgatccacctgcctaagcctctcagagtgttgggattacaggcatgaaccattgcatccggccaataacaatgtattcttaaaaattgctgagagtagattttttaagtgttttcactaccaaaagaagtaagtatgtgaagtaaataagtatgtgaggtaatacatacgttaattagctcaatttagccattctacaatgtattcatatttccgaacaacatgttgtgcatgacaaatatatacaattttgtcaatttaaagaagttggccaggtgcagtggcttacgcctgtaatcccagaactttgggaggctgaggtgggtggatcacctgaggacaggagttcgagaccaacctggccaacaaggtgaaaccctgtctctattaaaaatacaaaaattagctgggcgtggtgtcaggtgcctgtagtctcagctactcgggaggctgagacaggagaattgcttgaacccaggaagtggaggttgcagtgagctgagatcatgccactgcactctagcctgggcgacggagcgagactccatctcgaaagaaaaagaagttgtgaaatgaacaaaggatagttaaaggtaaaataggaaaggttcttgaatgaatagagaatatggtcatatgccacataatgacattttggtcaatgacagatgatattatgacagtggtcccataagataatggagccagaaaattcctgttgcctagtgacatagctcttgtagcgcaattccttttttgaaaaagtaaattaaaaaaataataagtttattatagcctgagtgtacagtgtttataaagtctgcagtagtgtacaataatcagtaatgtcctaggccctcacattcattcattacggactcatccagagcaacttccagtcttgcagactttgttcatgatgagtgccctatagaggtgtgccatttttttacctttttttcctcatgtttttaccataccttttctgtttagatatatttaggatacacagatactattgtgttatagttgcctgcagtattcagcacagtaatatgctgtataggtttctagcctaggagcaataaggctgtataccatgtggcctaggttataccatctcggtttgtgtaagtacactttgatgttcctacagctacacatttctcagaatgtatgcctttcgttaagtttagcatgactatattctcttcataacacatttccatctcagtggttgctaaagtactcaaagaaactccttgttctctcgtgttttacacatttaccccaaaacacctttttcttttttcttttcttttctttttttttttttttgagacaagagtttcgctcttgttgcccagtctggagtgcagtggcgcgatctcggctcactgcatcctctgcctcctgggttccagcgattctcctgcctcagcctccctagtagctgggattacaggcatgtgccaccatacccggctaatttttgtatttttagcagagaccgggtttcaccatgttggtcaggctggtctcgaacgcctgacctcaggtgatccacctgcctcggcctcccaaagtgttgggattacaggcgtgagccaccgtgcctagcccaaaacacctttttcattcaagttcagtaattacatcataatatattgtgtatgtcactataaactaacttttttttttttttttgagacacaggttcgctcttgttgcccaggctggagtgcagtggcgcgatctcggctgactgcaacctccatctcttgggttcaagtgattatcttgcctcagcctcccatgtagctgggattacaggcatgcaccaccacgcccagctaattttgtatttttagtagagacagggcttctccatgttggttaggctggtctcgaactccgcacctcacatgatccacccacctcagcctcccaaagtgctgggattacaggtgtgagccacggtgcccggctgcgtgcaggtcttttttttttttttttgagacagagttttaccccatcccccaagatggttggagtacagtggtgagattatagctcactgcagccccaaacttctgggctcaagtaatcttactgcctcagcctcctgagtagctagtactacaggaatgtgctaccacatccccgctaatttttgttgttgttgttgttaattttttgtagagacagggtctcactttgttgaccaaactgatctcgagctcctgggctgaagcagtcctccagcctcagcctctcaaagtgctgggattatagccatgagtccctgtgcctggcctatagactttctgtttcctgccgctattggtgattgggctgaatggactagacttccttttggaaattttttatgtgcctttgtaagtatttgagcactaattctggttggtaccctactaagcattaatccactcagacatttgagtgcctctaatgttccagtctctacagaatgcagtgaagaatatgatataccttgtctctcattcaaggagtcataattaaacattaaaggggtagagaagagtttgtgcagaggttaacttttggtagttgtggataaattaaaaatgaaacatagggaggctgagggaggggaatcacttgaacccgggaggtggagattgcagtgagtcgagattgtgccactgcactccagcctggcaacagagcgagactctgtctcaaaaaaaaaaaaaaaaaaaaaaaaaagaagaaagaaatacagctatatagtaccatatatgatactagatttgtatagtacagttaataaaatagcttcctaggaaaaggaggcccatagagaataaagagttaagatctttttcatcctaagaaagataagtctattctttttaattgcaaatgtttaatgttgatgttttaaaaccataactgctgttgtgaagataaagattatctggggtctagcttagaatttttttttttttttaaatctcagaatttcatattggtttctcctttgtgaaactttaaacgtggtaggcaaattttaatgtgtaaactgcaatttattggatataaataacttataagatggaactcactgactttaaaactgcttttcccatagctgacttttcttacttaacagtgatagaccttattctctgacttcctgattctaactaacaccctccaccccctcttcaagtgtagatctggttttgtatttaaggtcaatgatgagtctaaaaaagaattttcttaggctggacacagtggcttacgcctgtaatccccacactttgggaggccgaggcgggcggatcacgaggtcaggagatggagaccatcctggctaacatagtgaaaccctgtctctactaaaaatacaaaaaattagccgggcgtggtggtgggtgcctgtagtcccagctactcaggaggctgaggcaggagaatggcatgaacccgggaggtggagcttgcagtgagccaagatctcgccactgcactccagcctgggcgacagagcgagactccgtctcaaaaaaaaaaagaattttctttaaaatgtctatagttttttgaattatttgttttatgttagggtaatcagcatcttcttttgttaaacagaattttagtccgtttactttatcagcataaatacaatatagtgccttgtttagtttttataaaaaaatctttttagagacagagtctgttgcctaggctgaagtacagtggcactatcatagtgttaacaggggtccttgctcccagagctctcaagatggtggtgggccacttccacgatgttggcaagcctcgtgttctctgacctggggttgttggcctcatggattccaaggaatggaatcttcggccatgctgtgagtgttatatctctattagaagctgtgggtcacggaagagaaccgtagaacccagtgactagtgttccagctggataggatgaacccaggcacttagccatgcaggaacaatggcaagcctttagcccaatcgggagtggcaatgggtgcctcactggatcaggagcacagtggacaccctgctccatccggagggatggaagtcagcagcggctctgcgacagcagcaaacagtagtggtggaaagcgagcgaaagctcagctcaagccataacaaacatggatgaggccgtggtggctcacgcctgtattcccagcactttgggaggccgagatgggcagatcacgaggtcaggagattgagaccatcctggctaagatggcgaaaccccgtctctactaaaaataaaaaaaatagccgggcgtggtggcgggcaccaccagcaacttgggaggctgaggcaggagaatggcatgaacttgggaggcggagcttgcagtgagccaaggtcgcgccactgcactccagcctggccgacagagcaagaccccatctcaaaaaaaaaaaaaaaaaaaaaacggaccagaagagtgcggttgcaagatttaatagagtgaaatagagtgaaaacagagctcccatacaaagggaggggacccaaagagggtagccattgccagctcaaatgcctgggtttatatccagatcattgtccctcctgctgtgctctcaggcagtagatgattagctatttctttacctcctgtttttgcctaattagcattttagtgagctctctgattggtcgggtattagctaagttgcgagccccgtatttaaaggtggacgcggtcaccttcccagctaggcttagggattcttggtctaggaaatccagctagtcctgtctctccatagctcactgcagtctccaactcctgggcacaagtgatcccccagcctcagcctcccaagtggctgggattacagatgtgtgccaccatgcctggctaaatgtttctattttgtagagatggagtcttgctgtgttgcctaggctggtcttgaactcctggcctcaagcagtcttactgcctcagcctccactgcacctgccttgccttgtttagcgtttttttttttgttttgttttgttttgttttgagacagagggagttttgctgtgtcgcccaggctggagtggagtggagtgcagtggcgcgatctcagctcactgcaacctccgcctcccaggttcaagctattctcctgcctcagcctcccaagtagctggggctacaggaatgtgccaccatatctggctaatttttgtattgttagtggagatgggttttaccatgttggccaggctgggccttgtttagctttactttctgggttgtgatagtgtaagcttttaatttttatctaaatatagtagtacaacaaattagattatataaatgacaaattttgctaatatctttatataacatatcattaaaagggataggcttcatgagaaaaatcttttttacctagagaaaatattgtaatccaaaaattaagtattagctgtatatttgatcactactggaagctgtcaacattgtcacacagatcgtatttttaaaggatttcctggaacctgatgtaacttcttttgttttttgagatagggtcttgccctgtcacccagggtgaagtgcagtggctactcattgcagcctcgacctcctgggctcaagtgatcctcccagttgtagatcctcctgcttgtagttccagcgactcagcctcctgaatagctgggactacaggtgcacaccaccatgcccagctgatttttaaatgttttgtagagacaaggtctccctatgttgcccaggctggtctcaaactcctgggctgaagctatcctcccttggcctcccaaagtgctgacattacaggcatgagccaccacagtcagcctcccttgctttaatcttcttagcagagcgtctttggtttgcacctgtaatcccagctacttgggaggctgaagtggtagaattacttgagcccaggaattcaaggatacagtgagctatgatcaggccactgcattcctgcctgggtgacagagcaagactctgtctcttaaagaaaaaaaaaatagcccgggcacggtggctcgtgcttgtattcccagcactttgggaggccaaggtgggcggatcacttgaagtcaggagttcgagactagcctgaccaatatagtgaaaccctgtttctaacaaacagtacaaaaatttgccaggcatgttggtgtgtgcctgtagtcctagctacttgggaggctgaggtgggagaattgcttaaacctgggaggtggaggttgcagtgagccgagatcctccagcctgtgcgacagtgagaccctgtctcaaaaaaatagccaaaaaacaacagttgcatacagtgtttgttttgatggaaacaattattgaaatgaaggctgtctagagtttttaaaatacacttagaaagtagtgatttatttagaagaaaatggctttaatagttgaaacatctcaataaatagcaaaattaaatagcaaatcatttgttgtatgaaacattaactatagggttgacaaggaaattataatttaaagtgggggttggtactttgtttttttttgagacggagtcttgctccgtcgcccaggctggagtgcagtggcgcaatcttggctcactgcaaactccgcctcctgggttcacaccattctcctgcctcagcctcccgagtagctgggactacaggtgcccgccaccacacccggctaattttttgtgtttttagtagagacggggtttcactgtgttagtcaggatggtcttgatctcctgaccttgtggtccgtcctccttggcctcccaaagtgctgggattacaggcgtgagccattgcacctggccaggggttggtactttctagttaaaatgtttacctaatactcgtgtataaaaatatttaccaaatcgttgtgatagtgaaaaataggaaataaaggatctgttgtggtttagacatagagtagcagaataaacagtagtagaaaaaggaacaagccagcctggccaacatgatgaaaccccgtctctactaacaatacaaaaaatagctgggcgtggtggtggatgcctgtaatcccagctacctgggaggcggctgcaggagaatcgcttgaacccaggaggcggaggttgcagtgagctgagatcacaccactgcacttcagcctgggcaatagagcaagactctgtctcaaaaaaaataaaaaaaaaaaaaagaaagaaaaaggaacaaactagatctacctttgtatctttgtggaaaaatatctcaatattttgagggaaagcaaagtacagaagagtacatgccatgtaacgctatctaaataaaagtttaaaaacatgtaaacagtactgtcttgtttatggactcttagaaaaaagtataaaagaatgcatgggaatgataaacactgtatatttagggtattaatcagttctgggagggtacacaggggacgtagatcctaagatagtatggcgatgttaagactgggccaagctgggttgtaagttcatggtgggtattttctcttcttcttttttttttttttttttttttttttttttgagatgtagtcttgctctgtcgcccaggctggagtgcagtggcgcgatcttggctcattgcaatgtccgcctcccgggttccagtgattcttctgcctcagcctcctgaatagctgggattataggcatgtgccaccatgcccagctaattatgcatttttagtagagaggggggcgtttctccatgctggtcaggctggtctcgaactcctgacctcaggtgatccgcctgcctcaacatcccaaagtgctgggattacaggtgtgagccactgtgcccaacctatggtgggtattttctttttctctctctcttttttttttttaagacggagtttcgctgttgttgcccaggctggagtgcatggtgcaatctcggctcaccataacctgcacttcctgggttcaagcaattctcctgcctcagcctcccaagtagctggtattacaggcatgcaccaccacgcccagctaactttgtgtttttagtagagacagggtttctccatgctggtcaggctggtctcaagctcccgacctcaggtgatccacccacctcagcctcccaaagtgctgggattacaggcatgagccaccgcacctgacccatggtgggtattttctatacttttagttgctttgaatctttttagagggaatacacagtttaatctcagataagcttaccatgtctgcttatagttagttcagggagagattgatattgatacatgtttccatcggtttgtctgtctttatactagaaggcaacaatattaagagagaaatagaaaatgagaaaatgagagtgctaagggattaagtctatcagctgcagatgatttgatttgtcaaattatgtctttcaaactcatgtaagttaatgagttactaatatttcctgagttttaaaaactcataattttaaaatatgtaagcagttgtttttaaatattagcttaagtgttatgctgggaacataagcaagtagtaaaaattaaattgtttctgttgcaaccctagttaagataggagtgaggcagggagaatgcaggtactatagtaatgacagactgctccccttcaatctgtcttgaaaacctggggccgggcgcggtggctcatgcctgtaattccagcactttgggaggccgaggcgggcggatcccttgaggtcaggagttctcaagaccggcctggacaacgtggtgaaacgccatctctactaaaagtacaaaaattagccgggcctggtggcgggcgcctgtaatcccagctactcgggaggctgaggcaggagaattgcttgaacttgggaaagacaggttgcagtgaaccaagattgctccactgcagtctagcctgggcgacaaagcaagactctgtcttacaaaaaaagaaaaaggaaaaaaatgaaaacctggaacacaccttggccttctaagtctcatctctttttccagtttgtgccattttgccctttgccctcccgtgctttcccctcaaatcttcttggtagtgagttttctagtatcaccttttatctctgatgctttttaactcatcagacataaaagtaatgagctctggtgtgcattataattccttgaggccttgttagaacagtttggctccacctcagagtttctgacctggtagttgtggggtagagcctgtgaatttgcatttctaataagcttccttgtgatggtgatcctgctgtgtcagtatctcagttttgagaactactggtttaactgttgtttctttgcagttcagtaatcttttttttttttttttttttttgagagatggagtcttgctctgttgcccagattggagtgcagtggcacgacctcggctcactgcaacctctgcctcctgggtttaagcgattctcctgcctcagcctcccgagtagctgggactacaggcacgtgccacgatgcccggctaattttttgtatttttagtagagatggcgtttcactgtgttagccaggatgggtctcgatctcctgacctcgtgatctacccaccttggcctcccaaagtgctgggattacaggcatgagccaccacgcttggctgcatttcagtaatcttaaaagagtttcagtaatcttaaaagaggttcagcttaatttcccaaattaacatgattctcagacatttcttttttcctttttttttttttttttgaggcagagtctcgctctgttacccaggctggagtgcagtggtgtgatctcggctcactgcaacctccgcctcccgggttcaagtatttctcctccctcagcctcctgagtagctgggactacaggcaagcgccaccacgcccagctaacttttatatttttagtagagacagggtttcaccacgttgggcaggctggtctctatctcttgaccttgtgatccgtccacctcggcctcccaaagtgctgggattataggcatgagccactgcacctggccgattctcagacatttctaacttgtacatttctaatattttagatccagatttaaagaaccatggtacagcagaacactcaagtccttacccttgggttagatactttgtattttgttttcttataaaattgggaataggtctaaatgatctcttatgaccctgaaattttatatatacatacatattttaatatatgttttaatatgtaaaatatgtaacaatgtatacattgttatatatacattgttatatataacacacaaataggtattgatgtatgtaataaacacatatgtaacatgtaacattaaaagatatattaaaatatgtacttttttttagagatggggtctcactttgttacctaggctggggtatagtggcacgatccactgcagccttgaactcctgggctcaagcaatcctcctacctcagcctcccaggtagctaggactacaggctctctccaccatgctgggctaattaaaaaaaattttttttgtggagatagagtcttactgtgttgaccaggctggtctggagctcctggcctcaagccatcctcccaccttagcctcccaaagtgtggagattacagacatgagccaccgtgcctagccctgaaattacaatgctatgaatcataatctttgtttaaatattttcatagtgtgattttaaccaccaaagagcctcgatttgtatagcaatattcagactactaaaacttgactttagagccatttttctacaaagttaattataacctctctcagtttcccatcttgttcctttcaccttacaccatagggtgaggaccaacagggtaaacaaatctttcccatgctatttttattttgtttcataattgttatgattggggaaggagggtggtttaaaaatagcttgtaaagaagcgttaatttttaccaactaatagcttaagttgcctactcaaggatatagtgaaagggaaatctgcacatcccttgaaggatgccttcccctcaaggaatttagagggtttctttttgctatagtgttgtgatatatatatatgtcttaggctttcaaagtttcagtgttctactttaattatctgttttttttctttttttccttaaaaaattttgtttttttgagacacagtctctattgcccaggctggagtgcagtggcatgatctctgctcactgtggcctctgcctcacgggttctagcgattctcctgcctcagcctcctgggtagctggaattagaggcacacaccaccacacccgactaatttttgtatttttagtacagtccaggtttcaccatgttggccaggctggtcttgaactgctgacctcaggtgatccacccacctcgacctcccaaagtgctgggattacaggtgtgagccaccgcacccggtcaataatctttttataaattgagaatgttctactttaactgtcaaagttccttaccccatcacttttttctaaacataattatatatacattcctgcctcagtatccatgaaaggttggtcccaggtccttccatggataccaaaatctacagatgctcaagtccctgatataaaatggcatagtatttgcgtataacctgtacacatcttcctgtatactttaagtcatctctagattacttataaaacctaatacagtgtaagtgctctgtaaatagttgttatgctgtggtgtttagggaataatgaccaaagaagtctgcacatgttcagtacagacatcattttttccccagtgtatttgacccacaattggtggaactcatagacacagagggctggctgtactttatttccctattgttctttctcataaaatagaaagttgaaattaatgtatacgtttaaagccaactgttaaaacacagccttatatatttgggtattatttttttctgcccacatgttccgactagatcgatgcctttattaaattttaagattcaacttcagttttcatcatgatgtagagatatcagttttatagattgtatgtttatttgccataattgggttttcactatttagattacaccccaaatgacagtttttttttttccttgagtcggagtctcgctcttgttacccaagctggagtgcagtagcacgatgttgtctcactacaacctctgcctcctgggttcaagcgattctcctgcctcaggctcctgagtagctgggattataggagcccccaccacgcctggctaatttttgtacttttagtaaagatggggtttcgccatgttggccaggctggtctcgaactcctgacctcaggtgagccactgtgcccagccatgatgacaatttttaacagctattttaatccacacttacagtcaggataattcttgcacagacccagttggttaaaaaaagaaaaagaaaattttaaagggtaatttatttttcaaatgggcaatatacacacttttataaaattcaaaatgtgtaaaagcaatatatatagttctcattctcacccctaagctttccttcctaaaggcaattatttattaactagtttcttgtgggttttttttttgttttttgttgtttttttttttttttttttgagacagagtctcactctatcacccaggctggagtgcagcggtgagatctgggctcactgcaacctccgcctccctcgttcaggcaattctcctgcctcagcctcccgagtagctgggactacaggcgcgcgccaccatgcccggctaatttttgtatttttagtagagatggggtttcagcatgttggccaggctggtctcgaactcctgacctcatgatccgcccacctcagcctcccaaagtgctgggattacaggtatgagcccctgtgcctggcgtttcttgtgtattcttgggagatattttatgcacatgtaaagatggatagttacgtgctttttcttttttaaaaaagatctgtttctgaatctgaatgtcctgtgtgtgtgtatgtgtgtgtgacagagtctcgctctgtcacccaggctggagtgcagtgtcacaatctcagctcactgcaacctccgcctcctgggttcaagcgattctcctgcctcagcctccccggtaaatgggattacaggtgtgcgccaccacacccagctaatttttgtattttttttagagatggggtttcaccatgttggtcatgctggtctcgaagtcctgaccttgtgatccacccgccttggcctcccaaagtgctgggattacaggtgtgagctaccgtgcccagcccaaatgtacttttaagaataaaaaactggccaggcactgtggctcacacctgtaattccagcactttgggaggctgaggcggaaggatcgcttgagtctaggcattagacaccagcctgggaaacatagtgagaccttgtctctgcattaaaataataataataataataataggccaggtgcggtggctcactcctgtaatcccagcactttgggaggccgaggtgggcagatcacgaggtcaggagatcgagaccatcctgctaacacggtgaaaccccatctcttctaaaaatacaaaaaaaattagcccggcgtggtggtgggcacctgtagtcccagctgctcaggaggctgaggcaggagaatggcgtgaacccgggaggcggagcttgcagtgagccaagatcgtgccactgcatccagcctgagcaacagagcaagactccatctaaaaaaaaaattacattaaaaaaaataataaacaactttgagatagggtattacagtaacatttagtgtacaatttgagttttgacaaatatagttgtccaatctctaccaaaataatgattttgaacatttctatcactcctcaaattttcttcatgtctcttttatagttattcccccctccaactccctccagccactggaaccatggatctgctttctgtcactatagttttgcctgttctagaatgtcatataaatggaatcatacatcatgtagccttatgtctggcttctttcacttagcagtatgcttttgagattcagctgtatcagtgccatcagccaaggaagtgttgaatgagtgtgttaaatgtctattagcctaagtttggcttagggttttaaaattatattggctcctgaaatggactgatggatcttgtattctgcttagataaatcttagctcttgagttaaaaaccttgatgttattcagcatggaaaaaagtaactcagtttgaaaggggcaaaagattaaagcgaaatcaaaagtaaaattccacttaatgaacatggcaggacttcagaattgttcaattgttaaattgttaaattcaagttatattttaattaacaacctgttgctatagcaatgtcttaaataaagccaggtgttcttagttataccaacctgtgctgtcagtaatatttgagaatgggaactatacagtaggctattactttttttcttgagatgggcagaaaatctctattttagagacataaaatctaaaatttgagatatttgagtaagttaatcgttatctcaatccagagccttctttttattcaaactttatttctttttttttgagacgaagtctcgctctgtcgcccaggctggagtgcagtggcgtgatcttggctcactgccagctccacctcccgggttcacaccattcttctgcctcagcctcccgagtagctgggactacaggcacccgccaccatgcctggctaattttttatatttttagtagagatggggtttcaccatgttagccaggatggtctcgatctcctgacctcgtgatctgcctgcctcagcctcgtgctgggattacaggcatgagtcactgtgcctggccctttttcaaactttatttctgtactttatgctttgtgtactccaagcttacagacaggatgaaacgacataagagtctaaatggttttggatttaaaaaatcttagactttactgtttttactcttgtagttttaaagtataatcaaaactagttcttcttgagaactttctttttgtctcaaaaaccaagctgaggggaaatggaatatagtatgatttcctgccttgtgatttttcaggcatcctcacccaataacaagtctcaagtttctgggcttttatgtttaaaaagctgagaagctggtaactggttgtaaagcattattccaggtagaccaatctctgactacaaagccttttttttttttttttttttttttttgagatggagtctccctctgtcacccaggctggagtgcagtggcatgatctcggctcactgcaacctccctttcctgggttcaagcattacttctgcctgagcctctcaagtagctgggattacaggcgtgtgccaccactcccagctaattttgtgtttttttagtacagatggggtcttgctatgttggccaggctggtttcaagctcctggcctcaagtgattggcgccaccttggcctcccaaagtgttgggattacaggtgtgagccatcgctcctgggaactacaaagctctatggtggcttttattacttcagtcagccttttaaaatatattccttttttttttttttttttttttttttgagacaaagtctcgttctgttgtcccaggctggagtgtagtggcatgatcttggctcactgcaacctctgcctcctgggttcaagcaatactcctgctgtagcctcccgagtagctgggactatagacatgcacccactacgctcggctaatttttgtatttttagtagaaatggggttttaccatgttcaccaggctaggctggtctcgaactcctgacgtcaggtgatcctcccacctcggccccacaaagtgctgggattacaagcatgagccactgtgcccagcctaaaatatattccttcaaagttttttctacttttagaaccctggtagtggacttccactgaaagcatatcaacttgtcagatggtccagtataattttggaacatttatgactttaggagcttgtcccaagtgtaacctaatagttttgaggtacaaaaattggccttaaattttttttttgaaaaataataaatgaaatgtttacattaaaacaattttggccaggcgcggtggctcacgcctgtaatcccagcactttgggaggccaaggtgggcggatcaccaggtcaggagattgagatcatcctggctaacacggtgaaaccctgtctctactaaaaatacaaaaagttagccgggcgtttgggtcgggcacctgtagtcccagctactcgggaggctgaggcaggagaatggcgtgaaccctggaggcggagcttgcagtcagctgagattgcgccactgcactccagcctgggcgacagagcaagactccgtctcaaaaaacaaacaacaaacaaacaaaaaaaacagtatttttggctctttaatacataatacatgttttttgtttgtttgtttttttgaaatggagtctcgctctatcacccaggctggagtgcagtggtgcaatcttggcttactgcaacctccgcctccctggttcaagggattctcctgcctcagcctcctgagtagctggtatgacaggcatgtatcaccatgcccagctaattttttctatcttcagtagagacaggcttgttggccaggctggtctcgaactcctgacctcaagtgatctgcccgcctcagcctcccaaagtgctgggattacaggtgtgagccatcacgcccggcccataatacatgacacatgttttaccttcctgattgtatttatttgctaagctctgaacaaagcaaaaatgacccactttaaaaaaatacacattgccttgaagaatccaaaataccttaaagattcaccaatctactcatctcttactctgaaggaatgctcttaagagagtttcaccagcaggacagagaatattggtaacaatataaactttagtaatggataaaaggtacatttatgttgaatatatttcttttctttcttttttctgtaggaattgaatgatctggcacgggaccctccagcacagtgttcagcaggtcctgttggagatgatagtaagtatttaaaaggaataatggagtaatagcataacagtggttattttgtgtgaagaaacaattatggtatagggaagaggcagtgtttaacccttagtggcccatgaagggagcaactctatgttcatcccattatcatctgtgttgttcattacattttgaatcttctgccaggtattggctatgtagttgttctagtcctctcctaccttaccttcatcccttctgggtattttcctggagtgaaatatttaagcttttacctacaactagctattattcttgagtaagataatactaaggatgatagtatgtgtgtctgtgtctgactttctactgactcatacttgcgaaatcaggtctttatttatttttttcttgagacagggtctcgctctgtcaagcccgggctggagtgcagtggcgtgatctcagctcactgcagcctctgcttcctgggttcaagtgattctcgtgcctcagcctctcgagtatctgggattacaggtgcatgccaccacgcctgattaatttttgtatttttagtagattcgtggtttcgccatgttggccaggctggtctcaaactcctggcctcaggtgatccgcccgctttggcctcccaaagtgctgggattataggcatgaaccaccacacctggccaaaagcaggtctttatttttaatgtccaatttatctgcttaattttgtctaaaaagatgatcttaatgcatacattagatgataatttcctctttgttccacttcatttcaacataattttttcccatatagtgtcttttaactttttttaaagaggggatatttgaatgagactatgctatgtgatgtaaaactaattcacaaaaaactgtaacatttggttgggtgtgatggctcatgtccctaatcccagcactttaggagaccgaggcaggtgaatcaattgagcccaggagttcaagaccagcttggtcaacatggtgaagccctgtctctacaaaaaacacacaaaaaaattagccgggtatgttggtgcatgctggtagtccgagctacttggaaggctaaggtgggaggtttgctttagcctgagcctgggtagcagagtttacagtgagccaggaccatgccactgcactccagcttgggcgacagagtgagacgctgtctcaaaaaataaaaacaggacggggcgtcatggctcatgcctctaatcccagcactttgaaaggccgaggcgggcggatcacgaggtcagagtttgagaccatcctggccaagatggtgaaaccccgcctctactaaaaatagaaaaaaatttagccaggcatggtgacaggcgcctgtaatcccacctacttgggaggttgaggcagacaactgcttgaatccaggaggcagaggttgcagtgagctgagattgtgccactgcactccagcctgcgtgacagagtgagacttactctcaaaaaaaaaaaaaagaaaaaaaaatttgtaacatttaacaaatattttaaagtatgcatacttacaaacacttgtgtaaatatgtagattcagaccaaaatgagtacatggttaaattagcttatgtttaatatttttttgtttgtttgttttgttttttaagatggagtctcactctgttgcccgtgctggagtgcagtggcgtgacctcggctcactgcaagctccgcctcctgggttcatgccattctcctgcctcagccttccaagtagcttggattacaggcacctgccaccacacctggctagtttttgtatttttagtagagacggggtttcgccatgttggcgaggctggtcttgaattcctgaccttaggtgatccacctgccttggcctcccaaagttctggaattacaggcgtgagctactgcgcctggcctcaaattgttttttcctgatttttcttaataatgttgtgtctgggcccagcccagtggctcacacctgtaatctcagtgctttgggaggctgaggcaggcagatcacttgagcccaggagtgcgagaccagcctgggcaacatggtgaaaccctctctctacaaaaaaatacaaaaattagcctggcctggtggtgcatgcctgtagccccagctactcaggagtttaaggtgggaggatcgcttgagtccaggcagttgaggctgtagtgagccaaggttgcacaactgcactccagcctgggcaacgggagcgagactctctcaaaacaaaaacaacaacaacaacaacaaaaaacggaaaaaaagaatgtgtctggtctgctaaatcctgaagaatcaaagcaaggccctttcacaaggattactttacaaatagataaatattataaattatgagtctaagtacatgtcatgaaaaaactcatttacattattatattctgacttacctagcgtgagtaactatagtatttggtaccaaacaaggcaggctaagtacttaaactatacaaaataatttagtaagtgctgttacacacgttgtctcatttaagccttacaacaactcatttaggtgagtggagtagaaattttaaattgttttagaaaaaagtcccatgagaatctcatggagattctccatgtgaactcactctcaggttttctgattctagtttgtccttccactgtatcatatgggccacatacatcagtgtactctttctattcagttggaaaagtgcttttaggtaaattcctccaagttaagaatggctgaaaatctttaattaaaagtggttggagtcaggggatttgatttcaattttgaagttttctttagcatgctaaagtaatttgtctttgctttgcttctgccatagttagcactatacatttctttctcaggttgaaaaattgttccctttggagagttaaataaaactctcccacagccgagtgcgatggttcacgtctgtaatcctagcactttgggaggccaggagttcaagaccagcctggccaacatggtgaaaccctgtctctactaaaaatacaaaaattagctgggcgcggtggcgcctgcctataatcccagctacctaggaggctgaggcaggagaatcgttggaactgggaggcggaggttgtggtgagccgagatcccgccactacactccagcctgggtgacagagtgagactctgtctccgaaaaaaaaaaaaaaaaaaaaaaaggctgggtgtggtgtctcacgtctgtacgcctgtaatgccagcactttgggaggccgaggcaggtggattacctgaggccaggaattcaatcaagaccagtctggccttgaactctggtgaaaccccgtctactaaaaataaaaatacaagaaattagccaggtgtggtggtgggagctgtaatcccatctatttgggaggctgaggcaggagaatcgcttgaacccgggaggcagaggctgcagtgagccgagatcacgccattgcactccagcctgggcaacaagactgaaactccgtctcaaaaaaacaaacaaactctcccaaagctaatcagtaagagaaaaaaatagatattattagacttcatcaaaattaaatatatacaggctgcaaatgatgccatcacgaaagtgataaaacatatagaatggaagaaattgttgcaagtcatatatctcataagggacatatatccagtatatttttaaaactttttttttttttttttgagacggaatctcgcttttgtcacccaggctggagtgcagtggtgcggtcttggctcactataaccttcgcctcgtgggttcaagcagttctcctgcctcagcctcccgagtagctgattataggcacgtgccccgccgcccagctaattttcgtatttttggtagagatgggtttcaccatgttggccaggctggtcttgaactcctgacctcaagtgatccgcccacctctacctcccaaagcgctggaattacaggcatgagccaccccacccagctgtttaaaaactcctataactcagtataaaaataaataaccaattaaaaaatagtcaaaggatccgagtagacatttctccagataagatggctagtaagcacacgaaaagatgctcaacatcatttgtcattagggaaatacaaatcaaaactacagtgaagaagagccaggcacagtggctcatgcctgtaatcccagctactggggagactgagactggaggatcacttgaggccaggagttttatgccagcctgggcaacaaagcaagaccccatctttaaaactaaaaattagctgggagtggtggctcatggctgtagtcccacctactcacaaggctgaggcaggaggaacacctgagcccagaagtttgaggctgcagtgagctatgatttggccactatactctagcttggatgacaggttgagacccagtctctaaaaaaaaaaaaaaaacaagtattgatcagatctttctgatgaaccccacataagagtacatcaagtatgattggatagctaaatgtccttttgtcattttatttttgttataaggagtcagaatttaatcttagaagaaggaagagagaaactgttggccttttgaaacttttgagctccttttgactatcctggtacccaaatccctcagtaccacatgttattgatatttagtgtaaaaataaagtggagacttgtgctttattttaaaacatccagattttaatgttgatatttagtataaaaataaagtagagatctgtgctttattttaaaacatccagattttaatgtactagtaaattttttttcactttcctgcaaagatctggtaagcaggaagaaatgtacatcctgaaagaagtaagcagccgggcccggtggctcacgcctgtaatcccaacactttgggaggccgaggcgggcggatcacgaggtcaggagattgagaccatcctggctaacatggtgaaaccccgtctctactaaaaatacaaaaaattagccgggcttggtggcaggtgcctgtagtcccagctattcaggaggctgaggcaggagaatggcgtgaacccgggaggtggagcttgcagtgagccaagatcacgccactgcactccagcctgtgtgacagagcaagactctgtctcaaaaaaaaaaaaaaaaaaaaaaagaaaagaaagaaacaaataagctgaagatttaatggccatatatctgtttccttctctcttccctcccttcctttccccctcctcctcccctccctctctccctcccttctccctcgtcttcctctcctctggtcttctttaaaggcaggggctcactctgttgcccaggctagagtgcagtggcgcgattgcagctcactgaagcctcaaactcctgggctcaagggatcctcccacctcagcctcctgagtagctgggactatgggtacatgcccctacacccctggctaatttaaaaaaaaaaattgtagcaatagggtctcaccatgtttcctacgctggtcttgaaatcctgggctcaagtgatcctcctgcctctgcctcccaaagccctgtgattgcagctgcgagctaccgcacccagctttcttttcttttgaacagttggtaaatgtgactctcttgagatctgtgcattcaagtgtaggtctctggggattcagtctcatactatcaaatattctcactgtcccctgctgttttgtttgtttgtttgtttttttgagatggagtctcactctgttgcccgggctggagtgcagtggcgcaatctcggctcactgaaacctctgcgtcccaggttcaagcaattctcctgtctccgcctcccaagtagctgggattacaggcatgcaccaccacgaccgactaattttttgtatttttagtagagactgggtttcaccatgttggccaggctggtctcgaactcctgacctcaggtgatccacccacctcggcctcccaaactgctgggattacaggcttgagccactgcgcccggcctgtcccttttaacctcaaggcttcatccagaatactaaagagtaatcattcatctgtgaacttcacatttaaactctcataaaacagattatgtaactttcagtttgtgtaatttggtttgatagtattaaaccaacatagtgctgggaacttatttttgttttttactatcaaaactttttattttggtcaattttgatcaatcctaagatggatcattaaatgaaagatttttgaaacagatgtttatgtaaaatgtagcaatattttatgcttatggtccagtatttcattcagtaactattttgggggtcctttttacttgaacctctagtaattcttgagctatttctcttttcttgagacagagtctcacatcgtcgcccccctggagtgtagtggcatgatcttggctcactgcaacctctgcctcccgggttcaagcagttctcctgcctcagcctcccaagtagctgggattacgggtgcctgccaccacgcccagctaattttttgtatttttagtagagacggtatttcaccatgttggccaggctggtcttgaactcctgacctcgtgattggtctgccccggcctcccaaagtgctgggattacaggcgtgagccaccacgcctagcctacttgagctatttctaaaaacattgtaatgtgaggcaggtttggtattctgtcactagcttctctgatttatacttctgcctataagagctaagagtctagaaaggcttccagagagtaacctaaatcagtggttttagtaggtatctttatattcaaccagtgtgacaaaattctcaattaagatttaaatggtaggtctttaaatgctttaattacattcatgtgaatgggttttagtttctctttctctgcctttttttggtactgtagattctagatcattttatgagagccataaagattatttgtcttggttgctgcattagtaattttcttcttccttttccttctgctattttaaagacttagccctgtgtatgtgtttttgctcatttttttgatgatggaatttgaccttaataacagtgaagacaaattaacatagtgttattagaatgtgaataggtttttattcagagtttaatgccaatggattacatatgtttagtcctgttggaatgttaaacagatatgatctactaaattaaatagatatggattacagatgagatcatctatgatgttgagttaaaagttcacaataatgtaagaatgttcggcatggtacagtggctcatgcctgtaatcccagcactttggtaggccaatgcagaaggatcgcttgaggccaagagtttgagaccagcttgggcaacatagcaagacccgatctctacaaaaataaaaattaaaaaaatgagcaggacatggtgacacttgcctgtagtcccagctactcagttggctgacgtgggaggattgcttgagcccaggagtttgaggctgcagtgagccaaagttgtgccactgtactccagtctgggcagtagagtgagactctgtctcttgggaaaaaaaaaaaaaaacttaaatatacaatatgctagagtatctctaactttttgtagcgtgggtatgaaagattgcaatattagttgaaaatatttatttttttccccatcttctatcaagaagggtattctggcccggcgtggtagctcacggctgtaatcctagcactttgggagaccaaggtgggcggattgcctgagctcaggagtttgagaccagtctgggcaacgtgacaaaaccccatctctactaaaaatacaaaaaattagccgggtgaggtgttgcacacctgtaatcccagctacttgggaagctgaagcaggagaattgcttgaacctgggaggcagaggttacagtgagctcagattgtgccattgcactccagccttgacaaagtgagactgtctcaaaaaaagaaagaaaaaaaagaagggtattctgggtattctggctgggcactgctggtggctcatgcctatattcccagcagtttggggggtcaaggcaggcagatcgcttgagcccaggagtttgagaccagcctgggcaacatgggaagaccccgtctctattttaaaaaaaaaagaagaagaagggtattctttccataattataaacattggcagcttgttggcatttctgcttcaaccctgttggggattctgcgttgtccaattgttagtagattttgatcccacagcctatttgtgctttgtttgtgttagtaggaagaacagggaatcacaaaaaaggaaatatttagctaaaaatttctgatttaaggccgggcctggtggcttatgcctgtaatctcagcactttgggaggccagggtgggtggatcacctgaagtcaggagttcgagaccagcctaaccaacatggtgaaacccagtctccactaaaaatacagcaaaattagtcaggtgtggtggcacacacctgtaatcccagctactcagggagctgaggcaggagaattgcctgaacctgggaggcggaggttgcagtgagcaaagatcgcaccactgcactccagcccaggcgacagagcgagactccatctcaaaaaaaaaaaaattctgatttaaatttttctaataacttcttaagtctggtagtagtattagcaggaaaagaaaaagattgatcctgaaaagactagtgaagatcttgaattagtacctaaatggttaatggaaaatttaatttttttaattgtctcaatatttttatattttgtctgggtgtggtgacccacacctataatcccagcactttgggaggctgaggtgggtgaactgcttgagcccaggagttcaagaccatcctggacaacatagtgagaccccatctctttttttttttgagatggagtttcgctcttgttgcccaggctggagtgcaatggcacgatcttggctcaccacaacctctgcctcccaggttcaagcgattcttctgcctcagcctcccgagtagctgggattacaggcaatgcgccaccatgcttggctaattttgtatttttagtagagatggggtttctccgtgttagtcaggctggtcttgaactcccaacctcaggtgatccgctcgcctcggcctcccaaagtgctgggattacaggtgtgagccatcacacctggctgcgcatctctatttaaaaaaaaaaaaaaattaatattttattaagtgctttctttctttttttcttttttaagttgttttctttctttctttctttttttgtttttttgttttttttttgagatggagtctcgcactgttgcccaggctggagtgcagtggcacgatctcagctcactgcaacctccgcctcctgggttcaagcgattctccttcctcagcctcccgagtagctgggattacaggcacctgccactacgcccagctaattttttgtattttcagtagagacagggtgtcaccatgttggccaggctggtcttgaactcctggcctcatgattcatctgcctcagactaccaaagtgctgggattacaggtgtgagccgctgcgcctggccttaagtgctttcttaaaaaatagtttagtgtattttaatagcaaactcaaaggaacagtacagagacagacaacattaaaaacatacttgcatgtagggcaactcagaaaaatagagtgaatgaatgaagagtctaccatacgataaaaacgctacaaacaccatttagttgccatcaataaaaatttacggccgggcacagtggctcacgcctgtaatcccagcactttgggaggtcgaagtgggcggatcataaggtcaggagtttgagaccagcctgtccaacatagtgaaaccccgtctctactaaaaatacaaaaattagcctggtgtggtggtgtgtgcctgtaatcccagctactcaggaggctgaggcaggagaattgctgaacccgggagccagaggttgcagtgagctgagatcatgccattgcactccagcctgggcaacagagcgagactccgtctcaaaaaaaaaatatatttttttttttgcttgatatgaaaaaaatccaggagggtctgggcacagtggcttatacctgtaatcccagcactttgggaggctgaggtgaggggattgcttgagcataggagttcgagaccagcctgggcaacgtaacaaaatcccgtctctacagaaaatagaaaaattagctgggtatggtcccagctacttgggaggctgagacaggaggatcatttaagcctgggaggtggaggttgagctgaggttgcgccctttactccagtctgggtgacaaggagtaaaaccctgtctcaaaataaataaatctaggagagcagtgtacaagcagtggcagcatcagcagtcatggcaggacaagagtttagaaagtttctttcactcttttacagagtattggttgaaaggagtgctgccaaaactataaccaaaggaggcattatgcttccagaataatctcaaggaaaaatattgcaagcaacagtagtgttgacagttgttgaatttgagctctaaaggaaagggtggagaaattccactagttagcgagaagttagagatacagttctcctagaatatagaggcaataaagtagttctagatgacaagttttccttcttttttttttttttttttttttttttttgagatggagtttcgctcttgtttcccaggctggagtgcaatggtgcaatctcagctcactgcagcattcacctccgagtttcaagtgattctcctgcctcagcctcctgagtagctgggattacagacgcccgccatcacgcccagctaattttttatattttcagtagagacggggtttcactatgttggtcaggctgatctcgaactcctgacctcaggtgagccacctgcctcggcctcccaaagtgctgggattacaggcgtgagctaccacacccagcgacaagttttatttcttatttagagatggcgacattcttagtgtgtagactgaaataaatcactattgaaatgacatcaacgtgaagctgcccattccactaaagttctgaaatctttcatcatgtaaataatttccatgtctctcttttataataaaccaatgatataactagtgacaaaaataaaatccaactgctagcattgtccagaaaaaatttacaggtatgtttataattgttataaaggtgaactgctgaaacttgttcaccgaaatagtttgacttgaattaatgctttacatcctcaattttatattagaaattcacacacaagttaaaatggaaaaactgccaatacctgatttctgtcccctgtttttccactcgcagtcatatatgtagttaccttttgaccccgtgggggaaaatacatctaacagagaactatcaataacagaaagaagaaaaataattgttttttttttttttttttgaacatgaaatgtttcccaatcttaagcacagtctccatgtaattggcatgctagctggatgtcttttggcatacttgttacatatttggcatgagttacacataagttggtgtcttcataaaggctcatcagataggcctcacttgcctcctgcaaagtaacaaaagccagaagtgtagatttgtttcgaagtcctgagcaacttcttgtatcagatgctggaaaggaagtttgctaatcagaattcagtggacttctgatgagatctgttttcacagagtaccacagtaccagacctgtagcagtgaggtttctttactcttccagtaaagggtgcactcctgtgagtgacttctgtagctaattgcttcctgggtgctttaccactgggccaatttgctggtaatctgccttgtactagtcatgatctagaggcccccttacttatcccccttctcagcagacattagagatgagggcgccactgtggcaggcagtgcctgagaacacttaaaagcagtgctttcttactatcttacccaactcttacagctttgagtggaaatgcaggtacaattaatactcttccattataaccacaaatttaaataacaggaaagaattaagtagaagaacaggtcccttgaccagttggtcatacttttgtctaatagtgtttttagtcttgttattgggggttgttaattctagttatcaatgttttatttactcaaattgtaagtatatttgtgattaaaaatagagtgagactcgtgtatgtgtgcatgcatgcgtgtgagcatgtgcgtgtgtgtgttttagtcttgtttttaatttttttcagaaacagggtcttgctatgttgcctgggctggacttgaactcctgggctcaagtcatcctcccatctcagcctcctgagtaggtgggactacaggtgcccacttttgtgtctttaaacaacatacaaggggctttttataggacttcccttgaagatactaggtccagttttagtggcccagaatggctttgtccttggcttactcagtccattaaatggtcagcagagagtaatataagtgtttgtaagtactagtgagggctaatctaaggaagggagcctcagcaattcctatcctttacctttaacccctaatcaacaagctgctatttttaggttcaagtcccagtgagcaacaaaccaactttagggattaatttgatattaaggaggttggaaggaactttaggatttggactgacattctggtggatttttatatggcttcttagtcttcatgtttcttctaccttgtgacaagagttacctggtttgggttgttcaaatataaccccagtgacaacttcccttaggttgctcagatcatagtatgaatggtaagtgtgctaagtagtagcttaattataagtaaaaactctggcttttgatctctcatgatgcacttagtagcatgagaacatggaacaagcatcattttctgcatttggaagatatttatttattgaacaagtttataacttattagaagtatccctggagcttgtaatcaaccttgggctttcagctaatattttcttcttaaattttactccttttttctcttttttcctctttaacttatcctttacattaggagagatgtttttctttctttaatgagggccagtaatgtacagacctacacaagagtttttagaaattttttctccttgttaaaaccagtctttcttaatttgagtattatctaccttgactttactgttttgtcccccgtataccagcattataaaaggagtcatgcctgtaattccagctttgggaggctgaggtgggtggatcatctgaggtcaggagtttgagacctggccaaacgtggcaaaaccttgtctctactaaaaatacaaaaattagccaggtgtggtggcacttgcctgtagtcccagctacttgggaggctgaggcaggagaattgcttgaacccgggaggcgggggttgcaatgagccgaaattgcgccagcgcactccagcctgggcgatagagtgagactctgtctcaaaaaaaaaaaaaaaaaaaagtgtattatatgtaattgttttgaagaaatgatttaccctgtgaggtaaagaaataactgtttaaaagtagaactgtaagccttgtcaagaagtttgtctacctgacatgaagtttcaagaagttttagcccaaatactttcggttttttttgtttttgtttttgagagagtcttgcagtggcgcagtcatggctcattgcagcctccacttctcaggctcaagcagtcctctcacctcagcttctggaagtgttgggattacaggtgtgagccaccacacctggctctaaatatttttcattgagcaccttatcagtgttctaggccattctagtcatttttcttgtttctttagactgttaatttatgttcctcatcttgctcatactcattatcatattatttataaatgaatttggattagaaggggaatgatatgttactatggcgtagatacaatgtagatattgttacatggtgacttttttcttgttatttttcagtgttccattggcaagctacaataatggggccagtaagtattcagattaatttcagaataaacagtttatgtaatttactcattttaatcccacttttcttgttatcaacagaatgacagtccctatcagggtggagtatttttcttgacaattcatttcccaacagattaccccttcaaaccacctaaggtaattaattggaatgtggcagtttttaatgtactttctataatactaataaactagtttacagaaagtttcctttctttctgtaggttgcatttacaacaagaatttatcatccaaatattaacagtaatggcagcatttgtcttgatattctacgatcacagtggtctccagcactaactatttcaaaaggtaacagtgggtatttgatatcaagataaagcaaccgtgtcttttgtctttttagagttatttatttttgaaaagattacttatgtttcttttaagaagagatagcaattcttcttaatctgaaatggaccttgagaactgaaaacgagttggatttttcaagcaaaagtattccttggtgtagtgactagtctgtcagttgtgctactctagcataggttagaagatgaacactgggcctggtgccgtggctcatgcctgtaatctcagcactttgggaggccgaggcgggcagatcacaaggtcagcagatcgagaccatcctggctaacatggtgaaaccccgtctctactaaaaatacaaaaaaattagctgggcatggtggcaggtgcctgtagtcccagctactcgggaggctgaggcaggagaatggtgtgaacccgggaggcagaggtttcagtgagcagagattgtgccactgcactccagcctgggcaacagagcgagactctgtctcaaaaaaaaaaaagaagatggacactggtatgaatgtttttttagagcataaagtagagcacaattaacatctcttccaaccttgagattcatgaatggaaaaagatagatactattgcagaataggaaatagaccagccctttagacaaatgcctatgctgtaaacatagacgttaggttcttgaagaacaaaatataggtaaatattttaccagctcttgtctttaggtttctgtatcaatgaactgagtgatgtagttgttgtcttaatgtgttgatttgaaattgtacaacccttcaacattattcccagatgaaatcacagttgcgttacaataatctagattttttttttttttttttttttttgagatggagtctcactctgtcgcccaggctagactgcagtggtgcaatcttggctcattgaaacctccacctcccgggttcaagcaattctcctgcctcagcctcccttgtagctgggattacaggcacccgccaccacgcctagctaatttttgtatttttagtagagactgggtttcgccatgttggccaggctggtctcgaacgcctgaccttatgatccacctgcctcggcctcccaaagcgctgggattacaggcatgagccaccgtgcccagccaaataatctagaatttataaaggaaaacaaaaacaagtatttatggcctggcacggtggctcacgcctgtaatcccagcactttgggaggccgaggcaggagaatcgcttgaacccaggaggcggaggttgcagtgagctgagattgcgccactgcactccagcctggccagcctgggggacagagcgagactccgtctcaaaaacaagaatatttatcagatctcactgctgtactctgaaaggtgataaaagagttcactggatgtacttttgtgaaaatgaaatcagttgtttaagagaaaaatcaaatatggtaatggattaatatgtttaaaatatgaagtacaaaaatcagaaaaaaattcagatcccaatagatgaatggacacaggggaaccaaagaataaataaatgaatgttacgttcctattttttacctttttaattaacaaagatatttttaaaagaagacaaaacactaatgaggtacattgaaatgaacactcatattcttcaagtagaggtatagatttgtagagcccagtctgccagtatgtgttaagagacttaatcatccatgcccattcacccaataattctagtttcatttatttatactaagaaaacaatcccaaatgctgaaaaaactttgtatacaagtacatttgtgacattgtgatttagttctgaaaattggaggttacttacagtagaggaaaaaatagatcggttccagcacatgcatttaaaagagtattgaccctggccaggcatagtggttcatgcctgtaatcccagaactttatgaggctgagatgggcagatgacttgagaccaggagttcgagaccagcttggccaacatggcaaaaccccatctttactaaaaatacaaaaaattagccaggtgtgatggtgcgtgcctgtagtcccaactactcaggaggctgaggcgggagaatcacttgaacccgggagacggaggttgcagtgagtcaagatggtaccattgcactctagcctgggtgacagagggagactttgtctccaaaaaaaaaaaagtattgatctttacaaatattgtgaaaataggaaaatactgtgcttgagaaaagcagaaaaaagaaaaaaggcatatacactgtaacaagagttacatataaaagtatgttgagtgtccagaaatagacaagcaatgttagttttggtatttgtgtggtgaaatgtggtgtgtgatttttttttttttttttttttttgagagggagtttcgctcttgttgcccaggctggagtgcaatggtgtgatcttgactgactgcaacctccgcctcccgggttcaagcaattctcctgcctcagcctcccaagtagctgggattacaggcacccaccaccacgcctggctaatttttgtatttttagtagaaattatctgcttataatttaccatttgaaccattaagtagaaattatctgcttataatttaccatttgtttaatgcatgtatttagacaggaagcaacatagtttcatggtaaagaacatagattctagatccaattgcctgtgttcagatctcagatccacctcttattaaatgaggctagagacacattggcccctgtattcctcagttttttcatctgtagaaaaggaacaataatacatatttcattgttgttacgaagattaaagaagcaaaaacagacagttaactggttccttgtaagtactccaaaaactggggataaaggcacagttgtcaaaagtgttgggtatttgtcatgttatcacttggatgtcaagactcaatcttaaaaaaaaattattattattattatttgtttttttttgagaaggagtttcacttttgttgcccaggctggagtgcagtggcgcaatctcggctcaccacaacctccacctcccgggttcaagccattctcctgcctcagccttctgagcagctgggattatagggcatgtaccaccacgcccagataattttgtatttttagtagagacggagtttctccatgttggtcaggctggtctcgaactcccaacctcaggtgatccgcccgcctcagcctcccaaagtgctgggattacaggtgtgagccactgctcctggccacaaattaattttttaaagcaaacaaaactctgagacattaatttaaaatttttggagtcccaggcagaaataaaaacaggatgccagagaaccacatttttttaaagttattacaactttaatgaaatagttttttagagaagtgtccccttttcttttggtaggcccccttacaattcaagagctacttgagaaagtgtttgtggacctgtgcctggcctggtgagggtcccattggttgcacttccttcaccaaatagcaatagagatgtaaatctagtaatgggaccaagataagtagaattgtgtgagaggtgtgtgtttggtggggtgaggtgttggagacacaagatagctgaaattattgccatacctctttttgttcttccccttgcctagcgttgattttttttcagctattccaaatgataaggactgttacaagtctgatttgttaggttctctctatctggatagctatcctttaaaatagttgcagtgccattttgttgaatttgattgtattaactgtctcagatttaaggttttaatgagtccctttttgtaaattgaatgtatgggcaagtagttctatgaaatgccttaatcctgtatatgatattattcctttaacatatagtctgtcttcaaggacagaaattttgacccagtattcactctactttgaaggtccgtgatggggacctaaatatttaaaaaacaaaaacaaaaacactgaaaaaaactgaagggaagcagataagtgtgccataaagccatttgattatatgtttttagaagtgaaagtaactgttgctgtaacactagtgaaaaagtaatactggccaggcgcagtggctcatgactgtaatccactttgagaggccaaggaaggtggatcacttgaggtcaggagtttaagaacagcctggccaacatagtgaaacctgatttctaccaataatacaaaaattagcagggcagggtggtgtgtgtctatagtcccaactactcgggaggctgaggcacaagaatcacttgaacctgggagggagaggttgcagtgagccaacatcacaccactgtgctccagcctgggcaacagagcaagagtctgtctcaaaaaaaaaaaaaaagtaatactgatgaagaatatatataggtaaaagttcagtgaagagactatacaggttatagaaataagagttactatctttacagaagaaggtatagtatatgtatcagtccattcttgcactgctataaagaaatacctgagactggataatttataaagaaaagggttttgccaggtgcggtggctcactcttgtaatcccagcactttgggaggccgagatgcgcagatcactgaggtcgggagtttgagaccagcctgaccaacatggagaaaccccatctctaccaaaaatacaaaaattagcctggcttggtggtgcatgcctgtaatcccagctacttgggaggctgaggcgggagaatcgcttgaacccgggaggcggaggttgcaggaagctgggatcgcgccattgcactccagcctgggcaacaagagtgaaactccgtctcaaaaaaaaaggaggtttaattggctcacagttctgtgggctatacagaaagcatggcagcatctgcttctgcggagtcctcgggagcttttactcatggcagaaggcaaagggggagccacctgtctcacatggcagtagcaggaccaagagagagatgggggaggtgccacacactgttaaacagccagatctcatgagaactctatcacaagaacagcaccaaaggggtcgtgctaaaccattcatgaaggatacacccccataatccagtcgcctcccaccaggccccacctccaacgttggggattacagttgaacatgagatttgtgtggggacacagatccaaaccatatcagtatattagaaaccaaaatgaattcttcatgaaatcaagaagctaagtagtgtactaaaaatcttttcacaaggtccagatagccagtactctcctttcctggaaagaaagaaaagccctttctttaaaacctgtcctttaaagttgacttattagaatatttagaagaataagttaaaggaacattcaaaaatttctaacttccctgttgtcatttccaggaaatacatgaagtctttcctaattgatgttagaatgttctatgcttgaagagggcttcaggtgatgacacctgacaataggaaaatgtttttggaatgccagctgccagaattgtgggtaacaggaatgaagagtcagaaaacatctctcctgattttttaaaaaaacttttcatatactcttaaggcaaggaaatagcatttttgttaccaaactgaatagggcatgccaactatttctttacttctcagaagcccttgatctctataggatagatttggtaggaatatgagcgaatcctttccctgctgaatttatgtgttgggagtaaaatgggctgagagttattatctcttggtacagaacacctattagagaaaagaaagatggctgagctctattagcattagtatagaaggatttaaatttattttgtcagaggctactgaacttaatgtaatcagtgactttatgccccctttgcattcagtaaggaatgcataagttaatgatagatatggccgggtgtggtagttcacgcctgtaatcccagcacttcgggaggccgaggcaggtggatcacttgagcctaggagatcaagactagcctggccaacatggcaaaacccaacctctacaaaaaatacaaagaaaattagctacacatggtggcactcacctgtagtcttacctggagagtgaggtgggaggatgacttgagcccaggaggtttaggctgcaatgagccaagatcatgccactgcactccagcctgggcgacagagtgagaccctgtctctaaataaatacatacataaataaataaatattttaaaacataagttaatgacagatttgaacaaaggaaattacactattgagatttgtctgctacatcccaggttgtcaccgaggaaatggcttagatgagattctaaattgtcactgaagagaatttgagacattcatagaagtatgttgtattctctgtaatgagtgtatgaccatccccatttaggggcaagtgtttgcatttatgttcttgatttagactgaattgttttcaactgaaaattaaacaaaacaattgtctgaatgtggtgcctgccactggaaaacagtgattgttggattttatggttgtcgtttttgctaagaatattcagtagtgtggctgtcttttttttttttctttttgaggcagggtctcactctgtcacccagattggagtgcagtggtgtgaacacagctcaatacagccttaacctcttgggcgtaagtgatcctcccacctcagcctcctgagtagctgggaccataggagtgtgccaccacatccagctaatatttttattttttgtagagacagaatctcactctgttgcctaggctggtctcagactcttggcctgaagcgatccttctgctgtggcctcccaaagtgctgtgattacaggagtgagccatcgcacttggaattttgaaagccatttatccttgaatatgggcttctaaaaaattgaactttatgggatctgaaaaatgttcttggtctagaatttagacaaagttctaattctattctaattactagccagggacattgaacacgtcactgcacctgtctgggccagctcccttaggagttcaggcataaagacagtcatatcaactcttcttacatcatgggattgttgtgagactttgcacaaaggggcttatatttgtatctgggagaccaagatgtcatttaacattaattttctgctatttgttttattttattttttattttttattataattattattttttggagatggattttttgctgtgtcgcccaggctggagtgcaatgctacgatctcggctcactgcaacctccacctcccaggttcaagcgattctccagcctcagcctcctgagtagctgggactacaggcacacaccaccacgcccagctaatttttgtatttttagtagagatggggttttaccatgttggccaggatggtctcaatctcttgatctcgtgatccacccccctccgcctcccaaagtgctgggattacaggcatgagccactgcagccagccttcatttttattttttaatgacctaacctaaagtctgtttaagcttcttaaaatccttgttggtaggctgggtgcagtggctcacgcctgtaatcccagcactttgggaggccaaggtgggcggatcacgaggtcaggagatcgagaccatcctggctaacacggtgaaacccccgtctctactaaaaatacaaaaaattagccgggcgtggtggcgggtgcctgtagtcccagctactcaggaggctgaagcaggagaatggtgtgaacctgagaggcggagcttgcagtgagcctagaccgcgccgcgccactgcactccagtctgggcgacagagccagactccgtctcaaaaaataaaaaataaaaaaaactatttgccaggtgtggtggctcacgcttgtaatcccagcactttgggaggccgaggcgggtgaatcacgaggtcaggagttccagaccagcctgaccaacatggcgaaaccccatctctactaaaaatacaaaaattaggccaggcatggtggttcaagcctgtaatcccaggactttgggaggccgaggtgggtggatcacctgaggtcaggagttcgagaccagcctggccaacatggtgaaaccccaattctgctaaaaaaaaaagaaataataataataataataatccttgttggttactgttaatataaagttaagtaaaacttacaaagctgctaggcattacagtataaattcttagaattttctcatgttttggcgtctcatgtttctctcaaccctttgctttgatcctctgctaatttatatgatttttttcattctagtactcttgtccatctgttctctgttgtgtgatcccaatccagatgatcctttagtgcctgagattgctcggatctacaaaacagatagagaaaagtaagtatggcctcaagatggaaagttatctgtggtgggatggagatgtttgtcacaaatctttcttgtttaagggctgaatatcggccagatatttaaagtgaagtcctaatatactctcctggggctagaaaagagaaatatatgcattgagtattattataagtagatgatgccagtcttatccctgattgtttcacgtgactcctcttgtctacaaaaacttttttttttgtttgtttttttttgagacagggtcttactctgtcacccaggctagagtgcaatggtgcagtcttggctcactgcaacctccgcctcctgggttcaagtgattctcatgcctcagcctcccgagtagatgggattacaggcgcaggccaccacgccaggttcgttttttttgtagttttagtagagacttttaccatgttggccaggctggtttcgaactcctgacctcaaatgatctgcctgcctaggcctcccaaagtgctgggattacaggtgtgagccaccacacccatacaaaaactttcctatggtatatttttcaacagcttaatgccttatgcttggcttttgatatataaagcacttttcatcaagtgcccatttgcctgccataggtatttgtcaattaatgggaaaagagaattgatttcctaccatttgacataatctaaaggaagaaagcaaataaatgccattagacgtgaaagccccaaatttcttttaaaaacaaaacttgatgtagaatttgggtattttagaattgtactatgaattattgaacagtggtcaagatatcaaaagagatagtagctaaaagtgttctagtagcattttttcttttctttttttcttttgagatggagtcttgctgtgttgcctgggttggtctcaaactccctacctcagcctctggagtagctaggattataagcatgcccaccatgcccagcactaataacatctgttttatgtagtattcagtgaagttataagaggaactagataggagagggtggatagttcttttagggccgggcgcagtggctcacgcctgtaaccccagcactttgggaggctgaggtgggcagatcacaaggtcaggagtttgagaccagcctggccaacggggtgaaaccccgtctctactaaaaatacaaaaattagccgggcatggtggcgggcacctgtaatcgcagctactcgagaggctgagataattgcttaaactcaggacgtttaggttgcggtgagctgaaattgcaccactgcacttcagcctgggcgacagagcaagactcacgtctccaacttgagttctagtggattagagaggcatagatacgtttttgtttttagtggaggtaacactgggaatgggatattctaacagtagttggttcttgctttttcctatttgtgaatttattgtcaaatttttttgattagagaactgttttgtccgatatttagaattgtgggtctgaatgcttaccagaagtcatttcccaagtcatcatggagtaatgttgaacactgttgaacagaactttcccaaactgcactgcccccaccctctaaccccccacttttttttttgcagagacagggtcttgttcttcagcccagactggagtacagtggcacaatcgtggctcactgcagtgtcaaactcatgggctcaagtgatcctcccaccccagcctccccagtagctgggactgctagtacatgccactacacctttccagcctccccagtagctgggactgctagtacatgccactacacctggctaatttgtttttttttttttttttttgtagagacaggatctcactatgttgcacaggctggtctctaattcctggcctcaagcaggccttctgcctcagccccccaaagtgctgctgttacaggcatgagttaccgtgcaaggccagcatacccacccccacccccccccctttttttttttttttttttttgaggcagggtcttgctctgttgcccggactggaatgcagtggcacaatcacagctcactgtaacctcaacctcccaggctcaagtagtcctcccatctgagcttcccaagtagctgggaccacaggcagatgccatcacatccagctaatttttttttttttgagacagagtcttgctccgttgcccaggtggaatgcagtggcacaatcttggctcactgcagcctctgcctcccaggctcaagtgattcctgtgcctcagcctcctgagtagctgggattacaggcgcacatcaccatgcctggctaatttttgtgttttcagtagagacgggattttgccatgttggccaggctggtctggaactcctgacctcaagtgatccagctgctccagcctcccaaagtgctgggattacaggcgtgagccaccacacccggcctagcacccgttttttaataggagaattatagaatcatttgctctgcttactttattcaaatgttcttctgaagcaataaacccattcattttgtcaaccaaattgttgaaattagttctaccagaaccaattgttttattgatatgaaaggaaagtttggttttttttccccctttttttttgagacagagcctcactctgtcacccaggctatggtacagtattgcaatctcagctcactgcaacctctgcctcctgagctcaaacgatcttcccacctcagcctcctgagtagctgggactatagtcatgcgccaccacaccctgctaatttttgtatttttttgtagagacagggttttatcatgttgcccaggctggtgtgaaacgcctgggctcaagtgatccacccgactcagcctcccaaagtgctgggattacaggtgtgagccaacatgcccagccttctgtcggtttaatcattattagtatatgagttcaagaactatgtaatgtagaatcatataatttcaagtactttaaatgaatgaattgagtggacatcttttgtagaaataggccaatcaagtatggaataaggtatatgccaacaaatactaaaatttaatcagaaccctctataagtagcaattaaaggagactttcacattttacagctccttcccattatcattgaattaatccttatcagaaatttgggatagaaaggggcctttccttgaatgtcctataagctactctcttcaagttacttgatgggataatgaatggaatctgttgcttactgactccacacctatgttaagccaagcttctctttgtgtgtacaggtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggtttt

SEQ ID NO: 35841 - DNA, 14324 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagagtaagagcctcgcgcgccgtggaggagggagcagggcggtcccagggaccggagagccgggcggggcgtttgggccttgtggccggctggggcaggcttggagttttggggagtctcggagaaagttctctggggcccagttctcctcttaagacgacgctgggacctgcagttccggctttggagaggggagattgcccctgaggcaaggtccaggctaattctccacgctcccacaggacatgtggggtcagggacatggcggtcactgaccaggcccttggacgtttggcagggggctttgatgactcttcttctttatatttacttatctttttttttttttttttgagacagtctcactctgctgcacaggctggagtgcagtggctcgatcgatcgtggcttactgcagcctcgacttcttgggcccaatcagttctcccacctgagcctcccgagtagctgggactacaggcgcaaacaatcactaccggctaattttctgattttttttttgtagagatgggggtctcactctgttgctcaggctggtctcaaattcctgggctcaagcaatcctcttgcctcagcctcccaaagtgttgggattacaggtgttagtcaccatgactggcctgaggaccctttaatttttaagacagggtctcactctcatccaggctggagtgcagtggcaccattatacctcactgcagcctcaacctcctggactcaagagatacttccacctcagcctcccaagtagctgggactactacaggcatgcactaccatgcctggctaattttttatttttttcaaagacgagggtctcactgtgttgcccaggctggtcctgaactcctgtacgaagggatcctcccacctcagcctcccaaagtgctgggattacaggcatgaaccactgcacctggcccacccttgctaaatggaaccctttttgtgggccaaccttgccaggtgcttcatatacataaacttttaatcctggtagcactgtgaagtcagtattataattcccattgcacagattaaaaactggaggctggacttagggttaagtttcttcccaaagccatgcagctcccaggtggaggagctggggcttgtactcagaagtgtctgactgctgtctgatcactgcatttgatcaggtttgtgtttccaatgttagataggaagaggatgcaatccagcctcagcagccagttctaggggcatatgagattttcaaattttgttcactgcaacaaaacctttgccaaggacccactttgtactgagcaggagaaggtggaaggcagcaaccgcgcccatggtaacagtagctcacgctgtaccctgctcatggggaggtggatgaaaggtggtcagtgccctgggctcagtcaggaggtgcaagtagctatcctgtgtcctgccacatagaggctccacacgtgctgactgtactgaattccatggcaagggccaggaggcaccgtgcatcactgggacaaatatctggttgctgtgagctgccgtggaagcgttgggtggccttgaccttatctttcctggcccagtccaactatgagagttttctatttcatggactccacggacaggaagagatgcaacaggccattgaatccaggccccccacctgaggcacaccctgccccccacgggccttccctgcagttggccgcctgcttggccgcccagcccctgtgaatgtgggaaagctcttctctgtgctgacctgagagctgtccccatgccttcccccttgcagcttaggctctgctggggggcccctcagcccttcacctgtcacctgctgtctcgggacagttctgagaccacccctgcctgaccctgcctcccctcagccagccccgggcagcctgaggccagggccatcagaggccaggattcccagctgggaggggcggggacaggtgtgcggctcctgcttctcctgagggcctccctttccccgcagctgtgaggtggagcagtgggactcggatgagcccatccctgccaaggagctagagcgaggtgtggcgggggcccacggcctgctctgcctcctctccgaccacgtggacaagaggatcctggatgctgcaggtgcacactgggtgggcaggggacttgagggtggcttggccctgtgggcccctcagcctgtgctgctggctcctggctgctctgcagtgctgtctgggttctgagggcgtttcctgcgataccaggcccgagcgggcagatagcttgctctggcacaggcactgcccctccctcctgctgtgaaccccttggcgggggaccctaggagggcaaagaccgcggtgtggagactgtgggtgtggggaagtgcatccaaggccctgggttctccagccctgccacaaccttgctctgtgacctccagcaagaccctgccccttctgggcgtgtgcgtagtatgagggaggacctagctcagtgccaagccccagcaggatgtctttcctcaaccgcagccacgggtctcagcccatggaagaataaacctccccctgtgaggctgttgtgacagttttgagaaaaggttcagactcagaggctgccagatgggaagggacccttgtgagtcagtgctgagccgccccacatcctggccttggcctggaagctttgtggtgtcctgcttgcaggagagggtagagagggtcacgtcccagccaccttcttggcactctcagaggtgtccatgggggaggccccagcgtggctaaagaagaccggaggcctcgctgggtggacagtccagtgggtaagagcggggccttggtggcagaggccctgaggtgaacccggctctgcctgtgactgagccaggccacttaacctccctgaactgcagtgtctgaggctgtcaaaggggattattcagagttttaactgaagaacagagatgtcagcctcttattctaagaaaacaataataagcggtgtccccatgatagtccccagtgctgtggctttgagttcctcgaggaaagatactaacaatgcactttctgcacaacaggggccaatctcaaagtcatcagcaccatgtctgtgggcatcgaccacttggctttggatgaaatcaagaagcggtaactgcagcttgggatctggagggggcctagagagaggggtggctatgagagaaagaagagctgttgatttgtttttactgcatatccctcggccattcagggagaatgtgaggtggctgatgatagaatctgtccacatgtgcacaggtcagttacaataaaccccagcagtcagaaacagtgggtaacttctgtgtaggtggcaccctttcacattcattatcttttttgatccccacaacaataccttgaagtagcaaaggcaggtgttattctttctgtttcagatgaggaaattcagaaaggttaagttacttgttcagtccctgaaccctgatcttccatcttcatatccttccaaagtgggagataatctaaataggaatgaggactgcccgtttttgagtgctcatttatagttctgagcttcctggcaggcagatcaaagagggagcaaagtaactccatggaaatgtcccagcagtagacattggtaaatatggttgaggctgatgttaccaccagatgtctgattcgtagtgggatccgagttggctacaccccagatgtcctgacagataccaccgccgaactcgcagtctccctgctacttaccacctgccgccggttgccggaggccatcgaggaagtgaagaagtaagtgaacgcagaccaggtgcggtggctcacggctgtaatcccagcactttgggaggccaaagtgagcggatcatgaggttaggagttcgagaccagtctggccaacatagtgaaaccccgtctctagtaaaaatacaaaaaaaattagctgggtgtggtggtgggtccctgtaatcccagctacttgggaggctgaggcaggagaatcatgtgaacccaggagacagaggttgcagtgagctgagatcacaccattgcactccagcccaggtgacggtgtgagactctgtctcaaaaaaaaaaagaaaaataagtgaacgcctggcaggaacgttggctctgctcagcactggatcctgatcactgtgccagtccagcccacgcatagtccctgaccccaggtgtgccccattgagtgaggactcagctaaaataaagcacaaagcagagctgcaataagggcagaaagggaagtggtgagagaagaggatgagggaggacaaacaagttctgctggtgggtgagggctggcagggagagtgtggatcagggagggcttcacagaataagtagcaggtgggcgtccgcttgagtcctgaaagctgcaggtccaccatcccttagatcccaaaatctaaaaagctcggacagctgaaagttctttcatactaacaggagactatttaaggcttttatttctcccatttaatgtgactttcctaagttttgctgcagatgtaacacttttaaaacaggctgctgcccagacactgcagagggtgatgtgtggaatctaccacgtgcgccatgctgcctttctaaaggccaaacagttttaaaatctagcctgaaggtttcagatcagggatttcggcctgtatatcaagagttagagttggccgggcacggtggctcacacctgtaatcccagcactttgggaggccgaggcgggcagattgtttgagcctcaggagttggagaacagcttgggcaatgtggcaaaagtctgtctctacaaaaaatacaaaaattaggcaggcgtggtgttacacgcctgtagtcccaactactcgggaggctgaggtgggaggattgcttgaacccaggaggcagaggctgcagtgaaccgagatcatgtcactgtactccagtctgggcgacacagcaagaccctgtctccaaaaaaaaaaaaaaaaaaagttgggggaagcattccatgtgcagatggagggactggcccgagtcaaggtgggaggcgtgcaaacgcaggctctcacagtgcgtggccagcagcgtgggccccggcacggggcatggagcagagtagacagtgctgagtcctgctcactgtcctgtctggggagtcatcacatctactggaggtggctcagggcaggctccatctcttgcccagggcagcagggtgggccctgtggctgtactctttgttgctgccctaaagtgccaagagaacttgttttggaatcataaatcctgagtttgcagcctgttgctctcaactcttccctggttgtgtgacctcaggcaagtcaccctttctggtttgttttcccatctgcaaaacaggatgagagccagtaaggccccttcccgccctcaagttctatgtctctggtggctttaaaggtggagtcgtttctgctgctcatctgcagtgccgagtggcagtgcctcatcccactctcagtccgtgacctggagggtgggtttataccttggaccacagtcagaggtgccgggttctcagcggcccccatcttggtccaaggctgggcctctcacctgcccctctctctcccctcagtggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcccttgtgaaaacctctccagttctcagaggttaggaaaaacctgagtggctttccagatggcttggaccatgtgaggacagcatcagccagtcacagcctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccagaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcagaattccaggcagagtttggtaagtgaagccttgatttccacaggagcctatctgtgcccagttgagaggctgtattttctctcaatggtggcattttcaggcagagggcaggagctccaggcatgtccaggggctgctgtctggtagatgtttaatctacctgcccctggacactggcccactcagggagcacagggacttacccaggtcctctccgagccagcagagcagtccagggctcccgtctttcagagtcctttgttaccattccccattgtgggcggagcagcggggatggtggtgggtgtgaggaagggctgggcactttcactgtcttttccttcataaactggcaagcactaccctagcctttgtgtgcgccccttagtccaggcggatccagcacctggcgggtccacagcctggtgagcagatggcaggctggatctcaagcattccccacgcccctgggcactttgggccctgaaggtagttaaagccagagtggtccagatcccactgtgtgtgatttgactttgtgcactcatgagagttgtccaggtagagactcggccttcaggaagcatcttgggagtttctgttagggagtcgggagcaaggggctggtctcccgccatctggttgtccctagcctgggactcagtgcctgatggagtcctgccctccctcagtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcatgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtggtaagaactgcactttctgatgcaaactccctgctgccctgcaggaccagtgtttttgagggggtcccaaggggccgggtgtggagctagtgtgagcaggtgttgaacccaaagggacacaccagggatcgtaaatgtttatgttgtcagtgacatgggtgtatgacaggagcagtcctcttgcgcatgctctgctgggtctctgtccctaaaggaacagaatgtaggtgtgagtggatttgtttaaaaaaaaagagtgggccaggcgtggtggctcatgcctgtaatcccagcactttgggaggctgaggtgggtggatcacgaggtcaggggttcgagaccaacctggccgatatggtgaaaccccatctctactaaaaatacaaaaattagccaggtatggtggtgcatgcctatagtcccagctgtttgggaggctgaggcagaagaatcgcttgaacccaggaggcacaggttgcagtaggccgagattgtgccactgcactccagcctgggtggcagagtgagactccatctccaaaacaacaacaacaacaaagtgggctgactacatgtctccatgtgttacaccacagtgactcgtgtaaaacctgttactataaattgctattaccagtttagctgtgaaaaattaaaagtgtaatgacaatgccaatataactcgtgccagtttttcaagctgttgtttcacaacaaagcccccttctctcttctgctttgtggggctggggccaggcctctgcacaccccatttctgctgtgccagctgcactggcaggccttgtcagcgtgggtgtggaagggcctgctccctcctgccctcccttcctgtctttgggggagtggcagcagcacttcttcatctagcagcaccagttccttcccatagtggctggggaatccagtttgcagtttttccaacacttggtgaaccagccccattgagccctgctcagagacaagagcaacagccagtcagtgcccgtgccaccgaagtctgagttgcagcaccagaagtgcctctggcagttgctacctctgtgctaccacagtgcagtggttctcacatttttttttttttttttttttttgagacagagtctcgctctgtcgcccaggctggagtgcagtggtgcaatctgaactcactgcaacccctgcctcctgggttcaagcgattctcctgcctcagcttcccgagtagctgggattacaggcgtgtaccaccaggcccagccaatttttgtatttttagtagagatggggtttgtccatgttggccaggctggtctcgaattcctgacctcagatggtccacctgcctctgcctcccaaagtgctgggattacaggcatgagtgtccggccaattctcatacttttgagttcgtcagaatcacctggaggagtgactgatcaaacacaggttgctagccccatcccgagagtttctatttcagcaggtctggggtggggtctgacagagtgtgctcctcacggctcccagatgccactgatgctgctggtccagggaccacactttgtggtttgggtttttgttacctgctcagtgagttaacaacttgatgcgtagttaatgattctttatattaagatctgttcaggtagctggtggagtttatgcctccagactaagagtgatcagggccttaggttgtccgggccagtctctgcccttaatttggattctggaatggaaacctaaacaaaaggtcttcagctgccttccccagtgaatgctcccattattgcagcccttggaaactctcccgtccctcccccaccccagcctgcaaggagcactgggtgtgatgtcagggctgtcgcccacagccaggaaaactgccctcccacccccaccctaggtcctggaattcagctcacggcctggggactgcttcaaaaggcaggtcttggtctgaggagagggcagtcagggcatgaagctgcagccgccaccgctgcttctacaaaatctaagcactgggctgcagccatgtcctactgccagcaggaagggaaggatgcaatcatttgtgatgtaaaaagaccatgcagctccaagcaacacagctgatgaccccagtgatccctatggggggagcacggattgaggctgccaaatggagacattaactggaactgcctgtgccttgggggaagggccagcggcccctgtggggaacaattcaagctggacttttcctgcttccactatagtatggagaatgtcaaggggtcagactgtgtagaccaattggggccatgcaggaatgcatgcagaaatacccagatctttgtccccaagaaggtgaggcagaggtagaggaaaagcccgcagaacatgtagaagtagcagctcccactgaggccactgcaaccaaagaggaggaggggtcaagttaatgaaggccataggactccagtccttccaccccttcagagtgacacggaccttttgcaaaatgccatttagtcaccctccaacaaagtgtctttccctctgttgtcctgtaaactgtaatgtacgaaataacatattttgatgatcggggtcttggcctcttgacatatacgctaaaaaaatgggggttgttttatatgtgtcctgtgtaaacctgtcggcaaatatagccaccacttttgaattctcctagatggccctgaattttgccactttgaaataatgtgctactcaatctcagcaaccaaaaaccattatccaggaatgtttcttgtgagtgagcggatttattctgattcattatatgtctgaaacgttggggtggggctgattagggtggctcacgcctataatcccagcactttaggaggccaaggcgggaggatcacctaagaccaagagttcgaatctagcctgggcaacatagtgaaaccccatccctataaaaaataaaaaattagccatgtgtaatggtatgtacctctagtcctagctgctcaggaggctgaagtgggaggatcacttgagcctaggaggttgaggctgtagtaagctgactatgccatggcactccagcctgggcaacaaagcaagaccctgtctcaaaaactcttctctactagaagaggccaaatagtcagatgcaaatttctccaaacctatcctgaccttgagtatgtaaaggggtactatacttcattcctgacatattttggtttccatgttggcattcagctccgggttttctatttggatggtgaaaatttggaccctgccattcacagtcccttcctaagtgtagggaaaggctggtttttgctgttcattgttattctgaaagctctggtttggggtccatgttcatgctggctctcagtttgatcagatgcaatgttcttgagaggaggggacctaattgttaccagagaggagaagaaactctgtgaattaagtactgaattatggctgggcgcagtggctcacacctgtaatcgcagccctttgggaggctaagacaggagaatcacttgaggccaggagttcaagaccagcctgggcaacaaagaccctattacaataatgataaaatttaaagaagaaaatgtactcaattaaaaggaaacatgatttctacctggaaaaaacccaaaagcagttttatggggtttatttggtaaagatgatgtctcgctatgtggtccaggctggcctcgaactcttgggctcaagcgaaccttgcatctcggcatctggagtaggtgggactacaggaatatgccactgcacccagctgacggttctttgggggcaagtaagttcacttgctctggggtgggatcagagataactgtgctgttcagcatttcattttggagttatttctgtagatcagaaaccttgtggtcatgtggcatcattttcaagggcacatggtacaggtggccagtgctaaactcctatgcgttcaccatttttttgtttgagacagagtctccctctgtcatccaggctagagtgcaatggtgcaatctcagcttattgcaacctctgcctcccaggcccaaacaatccttctgcctcaacctcccaagtagcggggactataggtgtgggccactacgcctggctaaatttttgtattttttgtagagacggggttttgccatgttgcccaggctggtctcaaactcctcagctcaagttatctgcctgccttggcctctcaaagtgctgggattacaggcatgagccactgcgcccagccctagaatacaaatctttcatcacattgtgactgggttttagtagcctggaggcccttcactctgttagtctgaacctcagctctgggggagtgtcaagcttagtgaaggtgggagagaaggcaaagcatggaaccatgaggtagtctctctttattcttcttaccggcaaacccaagccatgaaaacagcccagctgaaggctgctgaaccacccttcttatctccctctctctctctctctcctttccagtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgag

SEQ ID NO: 35842 - DNA, 20727 bp, Homo sapiens
gacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggtaagcggggcccaagccgcgcaggctggcatggagtgggaggaggatccggagagacccaggtgccccggccgtccagccccgcgcccgccgtcgtttttctgaaactcgagctgcgagggggagaccgcttccgcccgccgaccaggcgccctgacacatcctaggcaggcctggggctgcgtcccgcgacctcctctccttcccaggctgtgctgggagcttgagcgcctttgccgcctgcacctcttgttccctggcctttgggagggcggcgcaggggaacccagcccccttccctcgggtctgtgggtgtctgctcccgttcctcggaatcccccaatcctgctccttccctggtgccctctcctcgttcaccccagtccgcagatgggccggggagaaagggctctccgccccagaggtgccagcttcgcccgccactcctacttcaaaagctagaggaatagcattactcctcctgtgtggagccccggcgcgaggaggccctctccgcagcccgccggtgtgtgtcctgaacttcagtcctgctggacttcatcctcccggagtcctgtgtgacttctaagggagaggaagccccaccatctcagggcggtgtgggggttgcctggcagggaggaggagccaaggcatctcggagtggtggttctgccacctcagaggatttacgattctcaggaatgtgaagagtaagcgcctagaactgtatctgggagggaaggggaaagaccttggaagaagaaaaagatggccatggggaggagagagagctcctggggctcacggccctgtgtgcgccagcggagctcacggtgagccggtggtcttgccctggccttgccatggtcactctggtgcccacacagccagcaggccggttgctttttgcccatgtttggtgtttgcccatgggatcccagtttggatcagctgcaagaggggcagctggcaaaataggagttgtgctgagcctcctgtccccagagagtggagtggtgcattgtgtagggcagggcgtgagcctcccaggaccccttcagcttgcaccaccagctctccctggtggcagtgtctgatgggagtgtccgtggggctacgaggagcctcctggacagagaaagggcacagttcggcattaaggtagaaggcaaagccctagaggatcaactggtttggtggaagtgaggtcaccagaagccctgtccagccagagctgggtgctgggaatgccagggccaccaggctcccacttcctgcccctgccaagctggcattggcaaggggagggggaagggatctgagcacccggagcaaggaggttgatgccagggagttggggccgatgatctccagtcccaggcagaaatccagtgtgaactttgtgctgagtccatcgatcgatttgacattcttttttttttttttttttggactttggcacccacacaaatacccacccacccccaccccccacaagttgcagtctcgttcagctcctccctttgcccttttggttatgctgctgggtgccagagggcctgggaggcgaacgtggaggcctggcatagcacacgtgcgcaaaggcagcagctttgagcttcctgggtgagcacagactcagattcctgcatgttttggagggacacctacatttgtgtgtactttgttaggccaggagatgagaggagagccaccagcaaatcctggggacaccatcaccagccaagtcccaggacttctgagttctggttctcccatctgtgagatggaggcattgggcgatgtgatgcctgccttctctagaattatagaaatgacgtgaagcacttgagccccttactaaatgctgaactgcactccttcatgcctggcgtttgaatcccagctcctctaaactgactcctagtcaacaccattgagtccttctagcagaaaatcctctcctctcaatcctgtgtgttgagcatacagacacccatgtggttattagaaaaaatgttaacagacattgtaagagttcgtttttctaaaacacacccgtttcctacataaagcatcaaatggaggtttgccaattcgttttagtctgaatttgtgtgcaaggtggggctgttcccttgtcttcattagccctccacttactaagtgatgatatcagtggaaaagtgtggcgcagagagtggttggctgggtggcctctggctgggaagaccagctgtgtccagaaccactcagggcagaggctgaggggtgcctgtaacactggccatccccgctggggagtctaggcctaaggaggtggaagtggctctccagctctgcccaccggctttgctttgtggatggccttccccgcctgccccgtggggagagaggagcagcaagacccgccctgctgttcccctgcttaaagccctcctccccccattcaccaccagtcacaggatgaggcctaaacccttgagtctgggttcagagtgccggccgggcagagccgagccagctcagctgtactagccaggctgtgcgaagccaagttacctcacctctgtaagcctccatttcctcttgtgtaagttgggggttatggcagctacctcggaattgcatgaggctgtgtgtaaagcacgtagctcagtgcctggcactgagtccaggctcagccagcctttgcagttggtattggaatgaatacatatttcatagtgatcattgcacacctatcatggggcagctagcgctgggtcagcctgcctagttgggcaaatgccactgtggccaagcctggcacacagtcagtgcctgatcgatggtcactgtgggttaagaatgatacgttgtggccaggtgtggtggctcacacctgtaatcccagcactttgggaggccaaagtgggaggatcgcctgagcccaggagtttgagaccagcctaggcaacatgacaagaccctgtctctattaaattttttcttttttttttttaagagttatatgctgttccatggcccttctccatctggcagcctgttctcaccactgcctccctacccccaaaaccacacccagggtccgaattcccctctagcctctaagccttcacaccctgacacttctgtcccctcccagggagcctgtccttaatccagtaggcagagttagcatttcctttccttcactttttttgtttttgtttttgtttttgttttttttgagacagattccacccaggctggagtggtgtcgcaacctcgcctcgctgcagcctcgacctccagggctcaatcgatcctcccacctcattctccctagtagctgggactacaggcatgcaccactattcccagctaatttttaaattctttgtagagatggagtttcaccgtgttgcccaggctggtcttgaactcctgggctgaggtgatctgccagcctcggcctccgcctcctctttgtccttacatcttttatcgctctaaacacacaatattttaatcatctgtttgtgacctttttctccactacgtggtaagcccaagggcatcaactgtggcctatttgtgtttctatccccagcgctgtccttggcacatggtagggaggctctcaaaaacagtttttgaattaatgaatgaatatataacaacagtcagggacctttgtcctcattcagctcatcccgccccgcccagagattggaattccagatagaacctacccactcttctttcttgcctgctagcagcttctatttgaaaactagaaagccaaaagtccaggctttggggtcagccagatcagtgtttgaatcccagctctgccgtgtgctggttctgggatcctgggagttcatttttccctgcaaccctcagcctccacctctgtgaaaggcactgcctgcagggttattgggaagatttggtggcatgacaggtttgtaaatgaaagtgctagtttggggtgtttcctgccagccctgaccctgatcccagagtcagagtgcaggcaccccagggagcaaggtgggtggtggggcacagttagctggagggccatcaacctctttcccagggcgggcgggccattttacaccaaccaagttggagctctggtagggcagaacagagcttgagctgctgggtgtttggatttgaaatggacagggtatgtgattgtttgtgtgttgggatctctttctttgctggcaaaacagtgtagcccctggttcttaccttcaagctcctgttaactcagtaattctggagatgattctcttggagatagatgggggcttcctggccgggcgcagtgacttgtgcctgtaatcccatcacttcgggaggctgaggcgggaggatcgcttaagcccaggagtttgagaccagcctgggcaacatagtgagacctcgtctctaccaaaaaaacagggggaggggggtgaatgggggcttccttctcaaggaactccatatgtctagatggggtccttctcccctttcccagatgtcccatctcaatggtccctgggaaagtggggtgggaaattaataagaaactcaggccaggcacggtggctcacgcctgtaatcccagcactttgggaggccgaggcgggtggatcagttgaggtcaggagttgaggtcaggagttcaagaccagcctggccaacatggtaaaaacccatctctactaaaaatacaaaaattagcgaggcgtggtggcaggtgcctgtaatcccagctactcgggagtctgaggcaggagaatggcttgaacctgggaggtggaggtttcagtgagccgagatcgcgccactgcactccagcccgagcagcagagtgagactcatctccaaaataaaaaaaaaagaaagaagaagctcagccgaggtcttgttggtgctgcaggactctttacagggagaaaccagagctctagaccccaataacaaatgttcctctgttttcgttgctctaagatagagtggccctacctggaaggaaacaggtttgtacagtgcctttaggcactctacctatgacataaagatgttgacatgcatttctttctttctttctttctttctttcttttttttttttttttttttcctgagacagtcttgctctgttgcccaggctggagtgcagtggtgtgatctcggctcactgcaacctccgtctctcaagttcaagcaattgtcctgcctcagccttccatgtagctaggattacaaacacccgccaccacaccctgctaatttttgtatttttagtagagacggagtttcaccacggtggccaggctgggtggcacctgtcacaacaccctgctaatttttgtatttttagtagagatggggtttcaccacattggccaggctggtttcaaactcctgacctcaggtaatccacctgcctcggtctcccaaagtgctgggattataggcatgagccaccacacccagccaatatgcatttcattgtcccccagacaaattagctattgttttctctattttgtaggttgacagtaagtgttcaatacatgatagctactatttgtgtctagcactgtgctaagtactaaccttgcctgtctcatttaatccacatgaccaccagtgaggcagatattggccccattctctgcctatggaggctgaggcttgatcagttaaggtggccatggcgggtcccaggactctgagctagcgactcctcccacacagcgcaggggtgtgtcttggaacccaaccctctgactctagtgcctgcacagccatttggccacatgagtaggctgtgcttgaagcctgactctgccaggtgtttctgcccatcatattctgagccacagctggaccatcacagtggtataaattcaggctgcttgaactggcttcctgtaaggatccagggcttccaggtgctcctgtccctagcagggcatccttgcagtgcctcagcccataagtggcaggctcctgtccccatcccttctcacgtgatgtgataggtcaatctggaatctggtaaccaagtatctacccccgccctcactccccagaacctgcacagagagcccccctcaagggtggtcttcactgttgaccgaagccttcccctcatggtaggacaactcaccatgtccccagactcctaggcaatgtttaggtccctaggccctagaaaaggacaagagttacagattccctgaggtccaggtcacctcggggtggtgtgggaacacacagagaatgctggccaggttcaagtcccactcactgctgggtgctgagagctctgaattctccgagacaggctgcagcctctccctgtgctaaggtcaggggaacagcaatggccaggggtatttagaggagtgtgtttggggcagtctcaggcagcacaggtctgtgctgtccgggcagcagccaccagcttcgcgaggctcccgggcactcgagatgtgctggtccacatgcagacgtgctgtgtgtgcaaaatgcacaccagattttgaagccattgtacaaataaaaggatgtacaatagctcaattgttaaaaatggattacacattgaaatgataatattttgggtacattatgttaaataaaatattcaattctactatttttcctgttttttttttttttggaggcagagtctcgctctgttgcccaggctggagtgcagtggtgcgatctcggctcactgcaagctccacctcccaggttcaagcgattctcctgcctcagcctcccaagtagctgtgcaccaccacgcccagctgatttttgtatttttcttttttagtagagatagggtttcaccatgttgaccaggctggtctcaaactcctgtgctcaagtgatccacttgcctcgtcctcccaaaatgctgggattacaggcatgagccaccacacctggcctatttttcttttctttctttctttctttttttttttttttttttttttgagacggagccttgctctatcacccaggctggagtgcagtggcgtgatctcggctcactgcaacctccgcctcctgggttcaagcggttctcgtgcctcagcctctggagtagctgggaccacaggtgtgcaccaccacatatgtctaattttcatatttttagttgagacagggtttcaccatgttggccatgctggtcttgaactcccgacctcaggtgatccacctgccttggcctcccaaaatgctgggattacaagtgtgagccactgcacccggcctatttttcctttttcaaatgtgatgactagaaaatcttacattccacacatggctggcattatatatctactggacagtgctgctctggatctgagctcaaatcctgcctttgcccgtcagccatgtgtacttgagcaactgactccagctttttgaagctgggtttccttttctgtgaaatgctggcaataatactttccttttaggactataattggctcttaagaagaaaacacatgtaaagagctcggtgcctaacacatagtaggtgttcagtaaatagcagctgctatttgttacttcagtgttgagccccaatttcacaagctccttgaaggttcttaatagccccttgggacaacccctgggggttaaatctagagacttctgggaggagggtgagggatgaggaaggatgcagcagggaaggcatggggcggccagccctggatggtgtccagccgggctgcagcccaggtaccagcctgctccatcccaggcttgcccagccctgcagagacctgagccagactctgccccctcttgcccccgtgggtctccatggctggcacagggagaagaggttactagccagaaggagaacctgtttcagacctctgagtcctgggggtgtctgtcagaccagcagacctcactttagtttgtgtctccctcctggttcccaccctaccagactccagggaaagctcttcccactgagaaataggaaggaagagatcaagggctaggagcagtgagtgactttttttaaaatggacacatccaacattcccctgccgcccgcacagacctggagggatgtggagggtggaagggggtcccatagagtaaaatgaggtgacatcagggccactacgcagggggccagtgacagccaagccccctgtacctcacctagggtaaggagaagacaccttctgcctagaggtgtggacactggctgagtgcctggagcccctggtcacttcccagtgcccccaggctgcccgtcacacagcactccaggcagggccagctgtctccatcctggcttccttgaagagctggcaccaggcccagccctgtctccagaatctggggaacaaactgagctgtctcccagagcaaatatggctcttacacccaacatactcctgacacacacaccccagcccctgagaacagccagggttccttcctgcccccgccgtcctgcccccttccatcctcttgttggggctgattttcctgtattgggcatggggcactggtcttctttgcataaacaagagccctgggctgggggaggggcagtcttgagaggtggggttacctctgttgttcccctggacacccaagtggtcttcctactcctccagcccctttcctctggggtcctgagctagctggctcgaaggaagcgggctgggctgtttctgtagggcccatcaccatggcatcagccagggaggggctgggcccaatggggcgttggcccccaggctcccacagccttccctgaagggaggaaggaggagcagggagcggccctgggcctgttccccagagacggtcactgggattagggtatcgactttccccagctttccaggtgactgctggtggcgcctattgaattccgtgcccgccatccgctccctggactgcgtgggtggaggtgatggggcggccacttagggcgcggtgaagctccctgggggaaaggacagatgaagggaggaagcctgagggtggaggaggccccgggagaagggtgtgggggcagctctccgggcagggtcttttctggaaagccagccagcattttgtgaaagtgagagtctccagcctgtccagccctgggtcaccccggcccagctgcgctgcccatcggctgcatggcctcatgttccctcctgttgattctggctctctgccagtctcctctctgagcagatcctgattttgtcttgaacttgggtctcccaggctgtcgtcgtcactggaggtcccactttgccctccggaactcactggggctatgttccttttgagtctcctcctcccaccatgcttcggacccctctgtagctggctcctcctaagatcctgggggccacacaccaagcccaacatgcctggacgtcactcccatttatcccctttccccagaggcagaacccagccctgccccagcttggcggtgagggtccaagagcaatggtggctgagctcggccaggtaccccacacctccccatcttctcctctcagtgctgggcctggagaccacaggccaggccccacagatccccaggggggctgccccaagggactcccctgccagccccagcctccacccaggctgggatgggctggcttgatgggctgactcagcaactggcactgacacctcctggagacagctgggaggctcctgctagggaggggtgaggaggaacaaggctggtctcccttgaagagtgggaaccccccttcccatgtgaggggaggaagtctctagggacttgggaaggaggctctgcaggtgcatcggagctgtctaaatgctggtggggtctaccgggggcttcccatctccttgtccagccaccccctcaggtcctggagccgccacagagccacatctagacagaacagtggagcaggtcccagtgcaggggaaggaaacagagggcacctgagcccctcaggctgggtaccctgtttccccttgaactgcacgacttggtgctggcagagcggagcaaggctcaaagcaggccctggagctttggcaccatatgtcactaggcgaggggcactgggctgaagatcagtaagggaagcccacagcacagagaccagggccagaggatgggcatcccaaaggcagctagcacagccctgccctgccagccggggggggcgcccagagccacctgcccccagtccagccatgcccctgccctgtcacccacaccaggcttcatcccccagctcaggctgcagctccagctgcgagaggccctgagcgcccggaaggaaggctgtggtaggttgtggtttcttcagctcccagcctacctccagcagaggctgcagccgatgccctggagagagcccctgtctgccctctgctgcctgactcctgttgggtcctcacctcccaatgggttgccccattctggacttggatccttaaggagcaccctgcagtgtggtggaaggaggacaggttccaagtcagagaccagggttggagttctggctgtgtgatgtcaggcagtgggctccacatctctgagcctcagtttccccatctcaaaaacagctgacaagccccagtcaggttgttatgggaaggtttttgggagcgcagggacggtggagggaggttggaggaggtcactagagctgccccctgcctgtcctgagatttcaccctccccactttctcagggtgtctggctgaagcagaaagctgcgcctgtcctggtgacggcgactggtcagacttgtttctgctcacctaggcggcccgggggagggcctggctgggagctttgtggagggattagctctaggggagaagagcctcacttactcccggaacaagatcccacagggctgtgggagtgccggggggtgagcctggggcaggtgacagccgaactagctgggagtgggccctgcagtgaggcagggggtgggccagggagaacaaggcaagaggagcttcattcagggttcctgagcctttgtgagccactcacgtttttaccactcacttaaccgtctttgttgttggggtgaggggtcctcgagcctggatttgggtatgaaaacccaggcaagaaagacctgcccaagcctttaaaggaatgcaaagtcatcctctagccacccccagagatcgaaaggctggggattgagtctcctgcagatggtggcggcctcctggggctggcaagttgggacagaggcccataagccctcctgggcgcgccttcccacccctctcggccctctccactcccagctggggatttgggtttcagagcagcctggcacacacacccccaccccaccagaatctcactcccagcttcctatgactattcattagtattcacaacaatgggaaagtctgggtgtgcacagggattttttacagttagaaagtgtttaagtcaatgacctcactgggcctcagcaaccctgggaggcagatggcagtcagaatgatccataaatgacctgccccaggtcacacagctcctaaacaggggagctggaacctggctgggagccttgactatccactgctcattgtctgatgtgctgagtgataacacagggccagcaggctggacagcagccagtggccctgcaccaggcctggaggagggggagagggacagggactcaggcgtagtccttgggcacaggcttcggctgcctacacccatattccctccatcatactgtgtgtccaggcctgcagcttctaagctgagctgcttactttggaccaagcatgttggaaactgttttcagctgagtccaagcactcgaaatctgcgtgtgcccttttagtaggtcacaccctccaggccacagccacactgggctccctttagcccagccctgcttttcccagtcccctccccattcaggctcctctgtttctggggtctctgtgcttccgttgccacctctgcccttgggcagcggtgtcgggggaggaggtcctggaacgcctgaggatggccccgtcttgtccaggtccccttgctgtgctgaacaataagtttttggttatctgctccttctggctcccttttggctgggccattcggcttggtgggggtgagagagagttcgagtatatggaggaaggctttactgtaaacacactgaccagctttcagtaaacacctgcctcttcctcccctgctgcagagaacggggtacaaaggggctgggggtcctcagtcatatgccccaggtccccagccaggctgacgggtgccacactctgccccctctccaggagggccagactgagccaccaatggggagggatagaggcccgatcaacacagcatgtgattcaccttagactgtcagaagggacaggcatgtgagagctaacctggtcctacccctcatttggcagaagaggaaactgaggcttggacagagcagtgttttatccacatcacctaagcagttagctgcggtgctgggtatccacacaagtcttttgagtcctgggccagaaccctctcaaattgctgtgtagggatctaggcaaatttgcatcctcccaaaccttccttggttggggagatggggacaggcagaggacagggaaggcagaacctggggcactgtggaatagccatggaccctcccctgtccctgcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgatgcttctcgctctcttcctatctgactgcccccaccccctgcagatcagcagcacctggggcagccatcataccatcatgggcttgattagcccacgggcatagccaacctggagctgctggatggatgggtggatgggagggagggagggaagggtggtggatggatagacggaaggacagatggactgactgatggactcttctcttacctccactcccctggactcctccttgccaagcagatacagtgggcagcctgtgattcacccatcgatcagggagatgtctggggccatctccagagcttccctgctgccaggcacacagagtggggtggcagtaacaaaacccctctcctgagttaggcctttatttatttagtttttttttttttaaatggagtctcgctttgttgcccaggctgggggagtgcagtggcacaatcccagctcactgcaacctccgcctcctgggttcaagcgattctcctgcctcagcctcctgagtagctgggattacaggtgcccaccaccacgcctggctaatgtttgcatttttagtagagacaggatttcaccatgttggccaggctggtctcaaactcctgacctcaagtgatctgcccgcctcggcctcccaaagtgctgggattccaggcgtgagccacctcacccggccccgagttaggcttttagactcgtgcattcagggctctggtgctgtgctcctgggagaggaaacgtgaaccaaatgctcaggcaggtcccagaatcacagtcttagaaccttagagctagagatcagctctcccaagacttctcattttacacgtgagaaaaccaaggcccagagaaggaagtcggacagcaagtccttacccaggctgggccccaccccggcctcccagctcgctcccatcccatctctcccagctgtgtttgtttagtctcgtctggatattttcgttggcccttcccatgtatcctgcctccccagctgactgtcaatgggaggacccccagcctagttcaggactctgcagaaatggcgggggtcagtatccccaggttgtgaactgcaaactggctgagaaccaaggtggtcacccctgcccccaacccccctccacttacctgccccagaaccaaggcctgtgtccgtaacgcctccccgaccctgccctgcaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtaagccaggtggggccactggccgtcctggggctggagccccccaagtcagggatgtgagccagggctaagactgctgggtcccaggcgaggggtgggcagcttcccggcatgggtgctccctcctcctccttcatgggaggcccagaggtgtgggctgggggagcgggggcctagtgtagggagtggcagtgggtttctgaggacggcttgtgatggggtcagctggcatgaggtcggtgagagagatggacagatcttcttattcccggccaaagctgcagccccaaaggaggcccaagcccccagtcctgtccccaccagcagactttcagggcagtgtcaatgtgaggaaagggttaactccggggaggcctccagcctttgcttggtcagatcagagtccagtgacgggggccggtgcctccccctccctcctctcaggttgtcttggaaactcagccttgctggctctagagagtagtgggtcccccttcaatccctgggcccctgccctccccatcccccaccatcaccctgccaagcctggcgcctccccctgcccaggcccgagccaaacagggcagggctgctgcaccggggcagggaggggttaagcatgctctgctccttggtctggactttctccctgggaagatggctccctggagcgggcaggggtgctcactgggccatactgagggtggaacctcttgggactttgcagtgggtggggcctcctggagactcaaggttgtatgtgtaaaaggagattcacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctgggatactgtcccctgcttcccccaccccttcaccctgcaggtaattggccccctcagacattcctccctcttctgcctgtctctcgggctagaggggctgcagcctctggccaaaggacctgaagagggagaggcctggggacagtcccctccccgcagtccctccaggatggcatcctcaccctttccatagggaggaatgcccccctctccggctgccagggtttcaccctgaccactgtgagctgatggggaggggacagtgagtgaccctgtgtcccagcagcctgtccttgcccggggaaggctgtgggtgtcaaaagggaggagaagatgagagtcaggtatctctggctgtgtcctggactggggacagggaaaagataaccaggaattttaagctaagagttcagaagaagccctacactgaccagtccctggagatggaacagccacccctgaagccatgtgggacccctaccctgagtgagcccagtgaaggtgaccccagacctgtcttctctccctctgacccctccaggtttcccactggctgggggaggggatacccaggacacaccccttgagccttctcgtcccccctcatttcctgattggcaaataggagttgggattattttctctttttttctttttctttttcttttttttgagatggagtcctgctctgtcacccaggctggagtgcagtggtgcgatctcggctcacagcaacatctgcccctagattcaagtgattcttctgcctcagtctcctgagtagccgggactacagccatgcgccaccacgcccagcaaatttttatatttttagtagagatggggtttcactatgttggccaggatggtctcgatctcttgaccttgtgatccgcccacctcggcctcccaaagtactgcgattacaagtgtgagccaccgcgcctggcctttttttttttttttccggacacagtctctgtcacccaggctagagtgcaatggcacaatcttggctcactgcaacctccacctcctgggttcaagcaattctcctgcctcagcctcctgagtagctgggattacaggcgcctgccaccatgcccggctaatttttgtatttttagtagggatagggtttcgccatgttggccaggctggtcttgaactcctgacctcaggtgatccgcctgccacagtctcccaaagtgctggggtcccagtcatgagccaccgagcccagactattttctctttcagttgaggcaggtactaactatagtctggggtgtggttccaattttggtgtcatcatcatcacctgggaagcgtttggaaaatgttgattcttaggcctgcccactaaaccagaatctgtgctgccaaggtccaggaatctgtactttaacaagcttcccacgtaggagttcccaggtaggaattcccaggtaggaattaggcagccatcctcgaatttcatccccatctgagacaatacattttttaaacaccttgtgacccatcagtgcctcataagatcaatttagtagatagagaccagcaggttttttggtttgttttttttgttttgttttgttttgttttgttttgccagagtcttgctgtgttgcccaggctggagtgtagtggcgtgatctcggctcactgcaacctccaccttctgggttcaaacaattttcccacctcagcctcccaagtagctaggattacaggcgtgtgccaccatgcccagctaattttctttttgtcttttttagtagagacggggtttcaccatgttggccaggctggtctcaaactcctaacctcaagtgatccaggtgcctcggcctcccaaagtgctgggattactggtgtgagccactatgcctggcccagacatttttttgttttttttaatgaaatgaaattaaaaatatcaaagaacactgtagtaagggtgttgctttgtgaaacttttatcacacaaaatctttgtgtgtgctgagtcatcaaaatggcaaacgtaggccagacatttgctcacacctgtaatcccaacactttgggaggccaaggtggaaggattgcttggggctaggagtttgagaccatcctgcatgacatggcaaggccccatctctataaaaaaaaaattttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacctctgctctgtcctttgcctaggtcccctgcctgtgcccttcaccaatggggagatacagaaggtaagggcgggtcccctgtctctttggatttcaatccttggggtgcatgagacagatcagaaggtgctgtggttggtaggatagccatctgactaaggccaaaaccccagggtccccagttccagctccttcttcagctccaagctatagaactgccagaaccctcttggcctctgcctggggccaaagctgtcaggagggagcgggctggctgggcccctctgcagcccgccatcctgggtgacaagcccccgcctccaactccccaccatacagaaggggccattcttccccccaagaacagagcttcagtgtctggccacgggcagccgggcccctgctacttctagtctgggttggaagaacaaagcccctcctccccccttccctgggcagaagggaaagggggtgaggcccggggaagagatggtggggctgggcgccagctgaagccatggaggaacccaggaaggggctgggtgccaagctgacgccccagccaaagccttcgctctgggacaggccgactcagtcaggccacagagcaggaactctgcagggtctgcttaaaggttccccttccctaggagctcctgccagggtacttggcaagggggagggcccttggacccagccctcaaccttctttcacctcatctttggatctagaactttccatccaccttcttctttcaaggccctcctttgctgcttcagggttagggtttcaggattcctggggtcaaatcctggcaaacagtcaggtggaccacatgagattcagggagcaccacatgggctccccatgcccccatgtgtccccacattccaagaagcccctccctggtcactggcccaaaaggcaagccagtacctaaaagccacattggagtggcccagggagagggagcggttcagctaatcccatgatggtctgttcccatcccatccctccagcctgagcagtagaaccagcctgccctctgatccccaaaggaatgtaaaaaggagccccagcaggctcaggaggtgggaaccaggggtgggtggccagggcatcagtgctacctcttctcagtctgaggcccctacttccccaggagctccctccctcctcaggaccccctcaccccatcctctgacaacccacaaccctctcctctctgccaggagaacagtcgtgaagccctggcagaggcagccttggagagccccaggccagccctggtgagatccgcctccagtgacaccagcgaggaggtaggccagccatgcggggggtggcaactgggttacaggaagccgattcccaggccccacttgttcctggcacaccagcctgcctttgaggtcacatgctgagccgcattctgttcttgtgacctggcttccctgggcacggccccaacggagccacctcaccaaggctgaggaccagggagcctaatgagggactgactcccaacttcctgcccccacttctctttacagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacc

SEQ ID NO: 35843 - DNA, 43942 bp, Homo sapiens
tccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggtaagccaggcattcagcccattttttttcctcccgccctgcccgtggctgtttgcaaattgcgctcgtggaagcgatttctcagaagggactctagaaatgaagtgatgtactcaatgcgaatcccaggattgaggagtggatcaggggacgacgctgagagtgggccggagacttcagtgctgacgatgaagctgttgagggcagaggcgggatgtgagctcagtgatagagagagaccctggcttatcgaactgattgcgtggaatttctgctagagaatccgtccggcattgttcagtgtccggcgttctggggtgggaaaatgtctgtaccatacattaaagggagcaggtaatgttcccttttttccgactttccagtggctttagtgttcacagcccctatcccctgctctttatttccttttaaatggaatttaaatttaacccaaacatggtataatatttcggatggccagccatgcaagtttttttctcattttgaccagaagtaactaaaatgtgtatttccgagtcgtaaactgtttgcagttaaaattttgattcagcctcatcctcatcgttttgtaaaacaaaaggtagtgaagagaaaaatgatttcaagggttttcattacgctcttgggcaatcacttgtgacaatgttttattcttgcttcattccagtctctttttttgatggtaacattttaatagattttttgagagttcctacagttttgcaaagaaatagtttttaaaacattgagtttttttaaaacataatttttaagaaaatcgacactcttaggttcttgatttaagcatatgattgtgttcctttgtgtaacttttactccccctcattttaagaatttttaattttttgtgctagtactggctaacaaactgaagcagctgcttgttattgggcatcagttatgtaccaggtgagcaaagcaaatgtggaatcttctcttaatattgatatgaagtaaatatgagtaggacttagcaaggtgaagagtgaacaggtatcacaggcatacagaaaaatacctggaggtcctgagttaggaaagggtttagcaggttgaaggaacaaaaataaggctagtgtggctagaacatagtagttaaagggggtagtgacagaagaggttggagaaaagacttgaggcagatcatacagggagtaaaggatatattatggctgatttcattttaagtgtattgggaaccattgaaagttttaaaacatgattagattttcatttttaagagatgactggcttttgctatatggagaataggagagggcaagagtggaagatgttatcagctaaaaatacccacccaccccccaattaaagctgttgcagtggttatggaaagaagagaatgagatatattttgaagaaagtggaattgcatgagagatcagagagatgatggggagaggtgtttctgggtttgatcagatgaatgcattgaaggtgctatttaccaagatgacagtgtctggagaagtcctagtaattgtttgaaaaagaagtctgacatggcctattgaatatggtattgaagtttttgaaactcaactctttgccttagttcacatcaagaggcctgattttaggagaatttaccatcaactgaatggacagttagtagtatgtgatgttggtagagatgataaagggatttttatgtaccctaggcagtcttaacagggctcaaatatagtgaggactctcaggcatttcttgctttgaaggatggtaacacatttggaattccttgttgcttaattggttgaatacacttgaaattaaatggtaaaaaggaagacacagaaaatgaactttttcattgagaagagctcaactctaaatccttttgtgaaagaaaagagatataactaattcaaataaaagagatataactaattcaaataaatcttttcaaagaggtagaaaatatgtatcttgaaatgatttgattatttttaaagtttcaaaagaagttactgtttatttttttttctttttactgcccccaggctgtaaggaacttactgtttctttctgactctaaaaatgatacattgcttcacttgactagccttaaaacaaatccatgtttttttgctaaaaatgctgaaagtataaataagatcgcccataatctcattactcagggatacgtatcttagactaaattctttcacacatttttttctataaacaaacacgggtatgcatacttttttttattttaatttttttttttttttaagatggagtctcgctctgtcgcccaggctggagtgcagtggcgcgatctccgctcactgcaagctccgcctcccaggttcacgccattctcctgcctcagcctcccaagtagctgggaccacaggcgcccgccaccacgcccggctaattttttgtatttttagtagagatggggtttcaccgtgttagccaggatggtctccatcccctgaccttgtgatccgtccgcctcggcctcccagagtgctgggattacaggcgtgagccaccgcgcccccacgggtatgcatacttaaggtagttttacggtcagctttattccttagtatgtcacgaatttatttgtgtatcaatatccatgggatgagaagtctggaattttgagtcagattctaaatctttgttgtcttcatctattaaatggtctgtacccacaataatggcgttagtccattgatgagggcagagccctcctgaactaaatgcctcttaaaggtcccacctcttaacaggattacagtggcaactaagtttgccattgttctcaactcaaacttgagttttgaaggagataaacactggaatttttactggaagtgggccctgatccagaccccaagagagggttgttggatctcgcacaagaattcgagagagtcgccaggcgcggggactcacgcatgtaatcccagcactttgggaggcagaggcgagcggatcacgaggtcaggagatcaagatcctggctaacatggtgaaactccatctctactaaaaatacaaaaaaatagctgggtgtggtggcctgcgcctgtagtcccagctactcgggaggctgaggcaggagaatcactcgaacccaggaggcggtggttgcagtgagccgagattgcatcactgcactccagtctgggcgacaaagcgagattccatctcaaaaaaaaaaaaaaaaaaaaaaaggcgagagagtctataaagtgaaagcaagtttattaagaaggtaaaggagtaaagaatggggtactccataggcagaggagctgcttgggcttgtccacgaaggatacctacagttagttatttcttgattttatgctaaacaatgtgtgattattcataagttttcagggaaagggggacccctaaggttcctcccctttttagaccacatagggtaacttcttgatgttgccatggcatttttaaactgtcatggtctggtgggagtgtcttttagcatgctaatgcattataattagcacataatgagcagtgaggactagcagaagtcactctcctctccatcttagttttggtgggatttggctggcttccttactacaacctgttttatcatcacggtctttatgacctgtatcttgtgcccacaccctatctcatcctgtaacttagaatgcctaacctcctgggaatgcaacccagtaggtctcagcctcatttaccctcattttgcccctactccagatggagtcactctggttcaaaagtctctgacagaactgtaacaagaagtataattgttactcattattatagctgtttgaggattaaatgggatgatagaagtaaagcctgtagtactaaacctggtatataataagaacccatttaatgtattcatttactcaacaaatatttattaagtaaatttttttttttcttgagacagggtcttgccatgtcattcaggctggagtgtggtggcatgatagctcactgcagcttcaacttcctgggctcaagtgttttttttgttttcatttttatttatttatttattttgagatggagttttgctcttgtcacccaggctggaatgcaatggcatgatcttggctcactgcaacctccgcctcccaggttcgagtgattctcctgcctctgcctcccaagtatctgggattacaggcgcccaacaccattcctggccaatttttttgtatttttagtggcgatgggatttcaccacgttggccaggctggtctcgaactcctgacctcaggtatctacctgccttggcctcccaaagtgctgggattacaggcatgagccaccattcccggcctacttactatttttttttttttaaatgttggatgtatttcattctgtggtagtttctttttttttttttttttttttttttgagagacaggtctcaccctgttgccctggctagagtgcagtggcatgatcacagctcactgcaacttccgcctcctgagatcaagcaattcttctaccacagcctcccaagtagctgagactacaggcgcacaccatcacacccatctaattgttgtattttttggtagagatggggtttcactgtgttggtcaggctggtcttgaactcctgacctcaagtgatccacccacctcggtctcccaaagtgctggggttacaggcgtgagccactgcactcgaccagtggtatcatttgttttgccgctcccctaatgctggatgtttccagctttctactattttttaaatgtttcgatgagagttgttctctatgcatgtgcaagtacttgtcagattatttccttataataaattcctagaaggtggattgctacaaacaagaaatgtatgtatttttgatacttttgatttacatattcagaataatatcctgaaagaacataccagttttcgtctcaccagcagtaaatctgagtacttacagtttttagtatacagagttgatatataatgtacctttaactcttaacaaatcctgacaaaaaaaggagattgttctgtttatttaaaaaaaaactacttagtttttaacttttatctttttctaggttacagttcctctgagtcatctcatcaatgccttccatacaccaaaaaacacttctgtttctctcagtggagtgtcagtttctcaaaaccagcatcgagatgtagttcctgagcatgaggctcccagcagtgaggtaagtctttatcctggttgtgtgagaaagcctttttgatatacagttgacccttaaacaaatgaaggattaaggatattgtccctcccccgtagtcaaaaatttgagtataatttttgactcctgagaaacttaactactaataccctactattgaccaggaagccttaccgataaaataaagggtccattaacatatattttgtatattttatgtattgtgtactgtattcttacaataaagtaagatggagaaaatgttattaagaaaatcataaggaagagaaaacatatttaccattcattaagtagaagtggaccatcataaagatcttcattatcttcaagttgagtgggctgaggaggaagaggaggggttggtttttctgtctctggtggcagagaccggagaaagtccacgtatctgtggatctgtgcagctttaatctgtgttgttcaaggatcacctgaggtcaggagttcaagactagcctgaccaatatggtgaaatcccatctctactagaaatacaaaaattagccgggtgtggtggcgtgcgcctgtagtcccagctactcaggaggctgagacaagagaatagcttgagcctaggaggcagaggtcgctgtgagccaagatcgcaccactgcactccagcctgggtgacaacaagactctgtctcaaaaataaataaataaataaatataaaaatgtaatctcattttttggtttaatctaaaaaaaaacacctgtttttacagggaagtggaataggtagggatttaagaagtaaataaaactcttaaaaaaataaaggaccagcagatttagggagcagctcatacttctagggctgagatagagtcaggaagagttctccatccccagggctgagatcctgacattgttggcgaaggcatggccttggctcactgaatggtagaaaagttgctgtgatgtcatgccagggtaacgtgctagaaatctgggaagtctgccctctaggatactgggaaaagctgttcctggggatgtgtcctactagagaagctgttacacgagtggtgccaggggaagctgctaggtcctgctggccattgtgcacgccaggagccagggtttggtgaaactgcacaattgacaggagccagatgctatagaaaccacgggtgttacagacaggaacttgctaaatgagcataccacaaccaggaatcaaaacctctcttcctacagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctgtacactgcgggtttctccaaatgcctattgtctatgatttgttttgtccatcgttcttagtcacggcttagttcaggttcttgccatctttcacttgttccatcagccttctctctcatccagtctagtttctttgtttgtttgttttatcatttttaaattttttgtaaagacagggtcttgctttcttcaccaggctgatctcgaactcctggcctgaagcagtcctcccacctcagcctctcaaaagtgttgggattacaggctcgagccaccatgctaggccagtctatcttccttagttctccattttcttctataagacagaactaatcatgttacttagagaattaaattcaaacatggctcttcacagtttggccataacctatctctttaattttttctttccttgaattttttgagatattccagacccttggatggctttttgtttgcccccgtccctaagccgccttgatcatttttaatagcttaaaaagtacttttaagtattttatttcatcatgcctttaactgtcttttactatgtgctgtcatgttgtatgctaggatacgtagatgagtaaggcatgatctctgcctttgatccttactattaggaaataaggtgtattttatagttatgttagtattgagaaaatgaattctaagaatatgagttatagctaatttaaaaagtaccgtattcccagacatcagtccagagctatataatccgtgtccatgcctcttttaaaaaaaactttatttttagagacagggtctcccctttgtagcccaggctgaagtgcagtgatgctgtcatagctcactgcaacctccagctcctgggctcaaacatttctcctgagtagctggtgctgcgggtgcataccaccatgcccagctaatttttaaatttttcatcaagatgatgtcttaccatgttgctcaggctggtctcaaactcctggcctcaaacgatcttcccaccttagctgttttgggtttgagtaacatgtaattgttacttgcctttaagtgcctctctttcagctcatgtggacaagaaaataatccctatcctgttgtttaaaagtgggtatacacacatttttgtgatttttagacttttttgcctgattttcacacagttttgactttaattttcttctttattagaagatatgggtaactttagaacctctgagttcaaggaaggatctaagcaatgaggccagaggagtgagatgtcctatggtaaccaagcataccatttctttgtcaagtgggcttttgtttatggctgcttaggggcttaaaagctccatggactggtgaggattatcatttgaatggaatttccccaattcaagaaccttactattatcctccaatcagttctacactgttggggaaaatcccctggaccttatataacatactttgtaaccctgcagttagttactcttacactcttgtcattataaatgcttgatcaatagttgatagactagctcttgatcagagtacccttgtatggagagaaggaaaaaatgccatacatttcacttgattctgtgaaccataatgcttaggacagtagtggtttgggtttgatttaaaaaaaaaaaaagtttttctcattcatgctgaaatgtcatctctttatttaaggataccattaggaatataattttttaacctatgtcaaacctcatatgactgatctcagtaaaacgaactgtgaaaatatttgcatcaatttatttttaaatattaaaaaaaggaaatatatttgttagacttttaaaatctgattgttttaactgataatatgtactccttaggttaaatatcttgataatattaatgcatacctggttgacccaatcttttacagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtatgttaatgtgttttttgttccaattaaatattttagcactattaataattatagataccatttcttagctttcacagtagcgtttattgtgggctgggttctttcctgaagtgttttttttttgtttttttttttgcaatttttcatattgaaatagtaccagatttacaggaaagttgcaaagatagtacagaattttgcttccactaattttggcatcttacataatcatgttacatttgttaaaactaggaaattaacattggtacaataattttttttttgagacggagtctccttctgtcagccaggctggagtgcagtggcacaatctccgctcactgcaagctccgcctcccgggttcacaccattctcttgcctcggcctcccaagtagctgggactacaggcgcccgccaccacgcccggctaattttttgtatttttagtagagatggggtttcaccgtgttagccaggatgatcttgatctcctgacctcgtgatccaccctcctcagcctcccaaagtgctgggattataggcgtgagccaccgtgcaggcctaacattggtaccttatttttaactaaactacagactatttgaatttcaacaaaatttgttttcaccaaatcactagttctctgcaagtgtcctttttcttttccaggatctgatccagcataccacattgcatttagcagaatgggggggcgttgtttgttttaattttaggtgacacacatttaattccaggaaacatacttaatctttgagaatacattgattaaaaaaacagttgttatcccttttgtggaatgtctacatttttttttacttgaatctcataacagtatggtagtataataagtgggttcatactagtctgaaaagggatgtcaactttatgagtttttctttggatggcacttaaacaggccataaaaatccaggaacaaaatagcaggtttgactagtttataatgaaggtttgatttgaagctgtcctttgcataaacttaattcattaattcttgacccttcctttgcctttatttcagtgtaagggcataaaaaaccgtaagtgtgaggaaaaaatgaaatggttttgagcttgggggcttagactaaaagtttgcctctgcctaaagttgccttcttataaaatatttggcccataccaagtgttcaatagaataaaattctttttgttactatgttattatgattattcctactgctcttctagtctgcatatttacatttactcttaagattgttcctcataccaccagctgcttgctaggtttaggcaggcagaggtattaggaagagattttttgactggatgctaagggaccttgaaaaaagtccctaaattctaactgagacacacaaatagatgatagccactgtttgtttctgctgttgctgctgatgatcttttccctaggatcttggatataaaataggatgagacacactagtcaagagaagcagttaggaaggatcagtgaagtattcatggcttgacctttctttttacccaatgactagggaagctttatgagggaaagataatagtagctatgattcacagtgttttattataccattagagcttttgaaattgtctctaagaaacagcagttctttatctctttatgttcttaactaaaagtaattttagcctaaacacagtacatctttttttttttttttttaaagagacgagtcttgctgtgttgcccaggctggagtgcagtggggcaatctcggctcactgtaagctctgccttcccagttcacgccattctcctgcctcagcctcccgagcagctgggactacacgcatccgccaccacgcccggctaatttttgtatttttagtagagacgaggtttcaccatgttagccaggatggtctgtatctcctgacctcgtgatccgcccgcctcagcctcccaaagtgctgggattacaggcgtgaggcaccgcgcctggccttaaacacagtacatcttttatcactggttttgttttgttttgtttttgagactgagtttcactcttgttgcccaggcgggagtgcaatggcgcgatctcagctcaccacaacttctccctcccgggttcaagtgattctcctgcctcagcctcctgagtagctgagattacaggcatgtgccaccacacccggctaattttgtatttttagtagagacggggtttctccatgttgctcaggctgctctcaaactcccaacctcaggttatccacccacctctgcctcccaaagtgctggaattacaggcgtgagccaccacaccaggccatttttatcactgtttatttgaatttagtttcattagctacatttgtatgccagataaaaaagataatgtaggctgggcacagtggctcacgcctgtaatcccagcactttgggaggccgaggtgggcagatcaggaggtcaggagatcaagaccacatcctggctaacacagtgaaaccccgtctctactaaaaatacaaaaaattagccgggcatggtggcgggcgcctgtagtcccagctacttgggaggccgaggcaggagaatggcgtgaacctgggaggcagagcttgcggtgagccgaggtcgtgccactgcactccagcctgggcgacagagcgggactccgtctcaaaaaaacaataaataaataaaaataatgtaaccaacaagtgatagctagtaaatggaagaactgtgagatgtagttaaattagcgatgctttagatactttcataaaagcagtcatatcatggataaataaaagttgaaactcatattgtgatttccctaatatttgatagaattatttatatttcataggatttttgttttttggtttggaaattagaaaatttactttttgcaatttccctccaggtaacttagatatatttagtacattacgttcctcttgcttgtatcgacatcattcaagagctcttcaaagcatttgttcagatcttcagtactggccaggtatgaagcaacaaccataaattgtggaaaaaaaaatatttatttactatagtctgatttgtctttcttaatggtattaattctaaacattcatttgcaattcacaggacctaaagagtatttggaattaatgagtttgggtacttctgtataatttttaatctggaaaatatataggagctaaattttgagcgtgatagtgccacaataaatcaaactccagggaacttatctacgcttgtttcaagataaatgactaaccacatttgcttactcatcctcactttcaaaagcccattgaaattaattttatatatatatatatgagaaaaaaagagcaacaacagaagcgttccgttaacggacgagaaatttgagggctttcagtaagttgtaaaataagtgacatcaaattgacagtaaaatcaaatttgcatttattcatataatttttgaatacaaggcactagtgatagatgtcaggtgatagtgatcactgtaaatgaaaaagacatgttttctaccttcatgggactaatggtgtcatgaaagaggtgagtacttctgtttccagtagtagaactcaggaaaaaccccacttccagagccagtaaaattgggcactgggatgggatggaataaacagttgaagattgccagaaatgggccaatcacagtgcagatatggcctttaacctttagataaattagcaaaaaacacctttctaataagacgtctgtgtgtgtgtgtgtgtgtgtgtgtgtgtgtgtgtgtgtgtgtgtgtcgagggacatctgtctgtggagactcctggtttgagcattgatgccaaggaaagaaagaagctagcaccccagattactttggttttgaattacacattcgctaaagtattctgctcatttagcatagtccatgttttatattctaagtatatttacttttgctagtgttgaggatacccatttgtagtcaatactgatgactgtatttgttttgttttgttttgtttttgagatggagttttcctcttgtgacccaggctggagtgcagtggcacttcctgggttcaagcaattctcctgcctcagcctcctgaggagctgggattacaggttcccaccaccaggcccagctaatttttgtatttttagtagagacggggtttcaccatgttggccgggctggtctcagaactcctgaccttaggtgatccgcctgccttggccttctaaagtgttgggatgacagcatgagccacggtgccaggccctgatcactgtattcttatttataaatacaaatggattaccaagaatccacatatttgaggaaaacttaaagcataaaagagaggcaccaatttcagcaaagagactaataaccctctaaagaaatagttaatgcagaagacagaagaagacagctgatacgtttttagctattgttggaagatgtataaaaactgagcgtgtgttacctagggtatgaaaactatcttaataaattttcctaatgttgtaactctgaggttagattctctcaatgtcagaaaataaagataaaaatccagtaacagaaaagacagcttaaaaaaatacctaaatacggccaggcacagtggcttatgcctgtaatcccagcactttggtaggccgaggagggtggatcacaaggtcagaagttcaagaccagcctggccaacatagtgaaaccccatctctactaaaaatacaaaaattagccaggcatggtggcgtgtgcctgtaatcccagctacttgggaggctgaggcaggagaatcacttgaacccaggaggcggaggttgcagtgagccgagaccgcgccactgaactccagcctggcaacagagcgagactccgtctcaaaaaacaaaaaagacaaaaaaaacctaaatacttgaaatttttaaaacccttttctaaatgtctcacgactgaatggaaataaaaccgggattacagacactcagtaatgaaccacagtgaaaatctgtatatcagactcttggtgaggacaaaatgacattgagggcgttatataatttactgagaaatcaggctggatgcagtggcttatgcctgtaatcccagcactttgggaggctgagtcaggtggatcacctgaggtcgggagttcaagaccagcatggccaacatggtaaaaccccgttctccactaaaaaagaaatacaaaattagccaggtgtggtggcacatgcctgtaatctcagctactcgggaggctgaggcaggataatcgcttgaacctgggagatggaagtttcagtgagccaagatggcacctccatcctgggcaacagagcaagactttgtctcaaaaagaaaaaaaaatttaagatataaagatagaaaataaattgaatttctgaaaaataatagaagaaattaatacacacaaagcaaacattttaaaataataggtggaaatagttttaattaaaccaaaaacaaatttagtataaaaaaaggaacaatttaacaattctgattaagaaacaacaggaaaatacagacagtattagaagtatgagtgggaattgccatggatatgtgaaggttttaaaattgcaaggtagtatgtgtaactttatgtcaaaaataaaaatatgttgaaatggacaattgtctaagcaattaattaacaaagttaacccaagaagagataggataataaccatgaagtttaaaagacagtattttaaaaatattgtccctttgccccagaggcactaggttcagataatttttatggctgcattcttctagaatcttgagtttctttttaatttaaaaccttattaaaaagaaaaagatagagttccctatttattccatgagattgctgttagtaaaactttttagtattagcataaggccaggcactgtggatcacacctgtaatcccaacactttgggatgatcgcttgaagccaggagttcaaaacaagcccagacatcatctcaacaacagcaacaaaaattagcccgtcgtggtatcatgcccctgtagttctggatacttgggaggctgaggtgaaaggtttgcttgagcccaaagttcaaggttacagtgagctatgatcatgccaccgtacttcagcttgagtgacagcaagatcctatctaaaaaatatatatatgtatatatgtatgtatctgtgtctgaatgtatatacacacgcaagcacgacagaggaacaaaatagatgtgtttcacttaacagaaatcctaaataaaatctgaagaaagcaaatctagaaatgtgctaaaaatattatatcatgattaaggaatacaaaagtgatttaagattattagtaagtcaatttatcatattgattagaaaagaaaaatatcattatttcaatgtatgataaaaagacatgatatattttaattgctgtgcttcctgaaaactcttagaaagttagaaatggaaggaaacttaaaatttattaaacatctattatgttcctgttaatttgagaaacatggagtatcctggtttttttttcagcattaatttggagattctgaacaatatgatttaaaagaaaacgaaatgagccatatgtaagtcaaaagaaggagtaaaattataatttgcaggtgataacgattgtttaccagaaaattcaagaaaatcatccaaaaggctgttgaaataaagagttcactgcattgtccataccagataaatgcataaaaatcaatagctttcttatattctagcggcaggttttatttacaatttctttaaaacccagtaaatgttttatcctgacaggaaatatacaacatagatatatacacacatacacacgtgtgtgtatgaagctttactgaaggaaatgaaagaggaactgagtgaaataaaataaggccataatcctatttggaagaactaggtattacaacagtatcaatttacacccaaatttgtaaagtcaatacaaccccaatcaaaactctaatgacccacttgggaaatcgagaagttgattttaaacttaatttggaataactgagtacatgttaaaagaatactaatgaaggggattttatcctacttaagtacatgaaaatacagatatttagccatggaaatcagtagtgtagtattacaaataactaaaattaaaaaatttaacctagtgctgacatacatcagtgcaacaaaattaagaattttgaatcaataagcaaatgatggattatcaaatgttatcagcctaagtggctgttttggaaaaatcaagttcttttcttacatcataccaaaaaaaaaagttccaaatatgttaaagggttgaaaacaaaaatataaaactgaaaatattagaagtaagtagactacctttaaaatcttagtttggcaatgaaactctaatcaagttaaaatgcagaaaacacagcaaaggtatggctgcactgagctaataaattactgtatatgatcgaaagacaaagacacattaaaataaatgtttacaatatatataactaaagattactatctgtaacatccatattatctaaataaaaatggaaaaatgtgcaaaggacatgcatggtcaatttactaaagaaataaaaataaaaatagtcaataaaaatacagaggaagcttttcaaaattttcccacacttgtaatctgggaaatgcaaagtaaaacaaggtactgttatttttgcccgtcagacttgcacaaatttaaaagattcatattatttagtgtcggcaaggatatgaagaaaaggaaactcataagcattggtgggcacataaattgataacagccttttttagaaagtagtctcttagtgtcaaacaaaatttaaaccttaacagtgtttctttcaggaattcagtctacatctgctgacatacatatataagaatgttcaccacagtattgtttccagcaataaaaaccagaaaacaaataatgttcagggaaatggttgaatgaattgcactgtgataaattggaaaagtgtaaacagccattaaactgaatgcactgttctgttctgaaaaatatgcacgaaaaatgaaaattgcaaaaaattaggtactatttctagagtagtttttatagaaagagcacctgtgtgcatgcatacaagggtagtcagaattgttaacaggttatacttctgggaagtgggattggggcttgagaaattagaagacactaatttgatacacttacccttttttcaaaaacattatgtaattaccaaaaacatgtaaaaatcagttgtgtagattcaatctattttaattacttggttgggtttttttttttttttgaaatcacagtttatcagagttgatactcagttttttaaattatattgtataaccctctgacttctctatttacctttatcccctatcaacataaaaaataggccaggcgcggtggctcacgcctataatcccagcactgtgggaggccaaggcaggtggatcacctgaggttaggaggctgaggcaggatagttgcttgaacccaggaggcggaggttgcagtgagcagcaatgccttgcactccagcctgggcaacaagagtgaaactccatctcaaataaataaataaataaataaataaataaataaataaataaataaagttccttttgaaaaaaggaggatagaaaaaactataagctgggcatgatagatttaagttctcagacctaatcccagctctttgggaggctgaggcaagaggactgcttgagcccaggagttcaaggccagcctgggcaataaaaggagaccccgtctctacaaaaaagaaggaaacaaaggaaaacgtattgaagtgtcaggcaaattagatagactaggatatacaggtagggtgtcagactttagaatcttaggcatttttcttttcctgtaacaatttatagtgacagtgaatggtattgttttatttagttttcatacagtctcggggttttaaaactttgaaatcaaggacacgacgtctccagtctacctccgagagattagctgaaacacagaatatagcgccatcattcgtgaaggtaattagacctttttatgatccaaaaagcaaatattttcaagttgttagagtgaggagcttcaatatctgatttcttttgttggctgatagatattcttccttctttccactaataataagggattagtaacctgtgtaatcattatacctctaactcttctgggcaccagacttgcctctccacttactagatttttttcccacaaacctacacctgtcgaggtgttctctgtattaatgagcagcatccacccaagctaaaaacctggctatcaacctacgtttgtccatgttgccttacctcccacatccattaaccactaaagtcctgttgatccaacctcctaaatatttcttacatctgttccactgccatagataggctataactatttgttgcctaaattactgtaatgaatacttgtttagtctccttgcctctagtcttgctgcgttcagtccagcctccagactgccacccatcaatctttctaaaataatgatctagttatattactctgctttattgcttacctccacctgatacactgggaatttcatcatttgatctctacctgccatgtttctcttctcaccattcaatatgcccctctgtttccctgctcctctcttggcattgaagtcttatataagattgcttacagttcttgagcactgaaggctattgattcatgcctccgtcagattgttcatagtgtttattccctgtgttttagatgtcctattctctgtaaggccttttccatattcctgaggtagcattgatttaccaccatacataatacttctaacataatatcaaaatgatttaagaaacttagttatttatatatctttttccagtagactgaaaactttaagatcagtggtttatttatctttacatcttcagaacttatataaggccaagtatatgaacggtgcttagtagacatttagtaaattaatgagattttttcctctagcaaagatagagggatatgaacattaagccaatcaaaccctaaaataatatgtgacctgttttcagtgtagtgttcgtgcagagaataatgccactttctttatattattaattgattgatgcaggaatgggatctagtgttagtttcctagttattgattaattcattgctgagtcttaatctgtttcttcacattgacagtaaaaattatacagaattttagtgaatttttttgagtggtcacaatattgttgggaagtatcactgtgttgttaaccagtactgatgtgttgtttgtgtattcaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatggtaagttgaattgacaccatccgtgtttgagaagagtaactgaaaggaagtcatagtcctacatttaagttttaagtaacttttctaagaccatctattgattaaattccactatatttgtaacttaatctatgtagaaatggcgatactgctgatggtttccctttctcaagagagaaaacaaattggagaacaggaagtgtgaatggcttcataaaggtttttgtttctttattttttgtttgtgtttgtttttgagacacggtcttgcttcattgcctaagccagagtgcagtggtgcaatcatggctcattgtagccttaactttctgggctcaagtgatcctctcacctcagcctcctgagtagctaggatcacaggcatgtgccaccacgcccagctaatttttgtggagatggaatcttgccctgttgtccaggctggtcttgaactccagggatcaagtgatcctcctgccttgacctcttaaaatgctaggattacaggcatgagccaccatgcttggccttaagtttttgataatagggtacttacaggaaatcatagcagttgtgagaaagaatgccagattccaaaattggatgtgatgaaatatgattattaacaataacctaatatttgcatttcattgagctgtcatatttcataaatgtgatttcatgtaaagctttttctttctctcctagattccctaaggcgaacccgtctgattctcttcgttctgctgctattcggcatttatggacttctaaaaaacccatttttatctggtaaaagctttttttatttgtctaacttatttcttattcctttaaatacatgattccttttaatgcctaatctaacccttaaagaaagaacatattaatgtttacagtactagaattaggctttcattcctagtagtggttagtttcccagatttttagaaaatgatacctgtccaattataaaatttaaaaattatcctggtcaacagggtgaaaggaaaattaattaattaattttaaaattatgtagaagaattttataatggcaatacaagctgaaatagtcttctatttcaaagataaacaaattcagtttattcataaaatcacattaaatgtttcccttttttttagtttgcttatctgaaattaagcaatagtgtcagacttacgtggttccaattaccttttccactactgtgcagttttcaccctgtgttgcctattctcttaaatattaaggatatgtacagattcttaaaaaatactttgtgggccaaaactattggtgttcattctagaattactattttaaatttgttttcccagcttctatgttcctgatttattaagcatttctccttaaccccatattttgccagctcatttttcagcctatcttaacagtattttgggcttcttctgaggaaattagaaattgctcaatttactcatttataactgctctagtttggaagtttctacctgagtgggaaagacttaagaaatccttgtaatagttctccaaaattgatctcaaatattttactctcctatcagactttttctgtcttgcttgtcagacttaatgttgtcataattgataggtcatttgagggcaagtaataacagttgtcagaggaagaagactacatgaaaagtataataatgtgttaagcctcaattttttattaatgtgtgtcaatgttttctgctaactttaaggcaatgtgtttcaaagtgtagacctgtgaccaattagaataattgaagtgtttgttaaaaatgaaaattctcctgggccctgtgctgtggcctgagaattaacatacttctcaagtgagttttattcacaccaaagtttgagaaactttgatttaagatttctatcattagatactacaataagaagtagaaaataatttttgattttattaactgaaaagtacaaataggtcattttattttatttttttattttatttcatttattttttttgagatggagtctcgctctgttgcccaggctggagtgcagtggggcaatcttggctcgctgcaacctcctcctcctggggttcaagcaatttcactgcctcagcctcccgagtagctgggactacaggcttgcgccaccatgcccagctaattttttgtgtttttagtagagacggcgtttcaccgttagccaagatggtctcgatctcctcaccttgcgatctgcccgcctcagcctcccaaagtgctgggattacaggtgtgagccaccacgcccagtctttattattttttattttttcaagtttattaagaaagtaaaggaataaaagaatggctactccataggcagagcagccgaaatatgtctttttaacgtgaatcacttactctttgaagatggtttagaaatccagaagaccagccgggcgtagtggctcacgcctgtaatcccagcactttgggaggctgaggcgggtggatcacctgaggtcaggagttcaagaccagcctgaccaacatggaaaaccctgtctctgctaaaaatacaaaattagccgggtttggtggcgcatgcctgtaatcccagctacttgggaggctgaggcaggagaatcgcttgaacctgggaggttgaggttgcagtgagccaagatcgtgccgctgcactccagcctggtaacagagcaagactctgtcaaaaagaaaaaaaaagaaatccagaagacctagtttctattcctcactctgatttgatatgtgaagttaggtcacttagacatttaatttttctaggctttgctttcttgcatctaaaaaacaaggtgattggaatgttattaatctatcaaatataaacatttcttttcttccctttagtccgcttccggacaacaacagggcttgattctgcagtagatcctgtccagatgaaaaatgtcacctttgaacatgttaaaggggtaagttaagaagattgccttgccttcttcatacatcctctaattgatactctatatgaggtcgatatttgattctacagtgtattctagaataggtaaaattgtgtccaaaagtattagaaacattagtattttgggataaataataatagccaaggatcaaatcttgctttatggcaggggatagtataatttatgaaggagcagcctggtgtagtggagtgaatgtggacttcagagtcaagctgactaatgtttgaaattcatttttatacttattagctatgagaccttgaagaaattactttagatcctgacagataatgtatgtgcttgacacatagtagatatttaataaatggtccttctttacctgtacctcttactgatctttgtaactccactatctaaaacatgttagacaatgtatatttcttgaatgaatagaatggataaatgctagtttatagttgattaatttgttaaatatttaatagtattaagtgctaggccctattttagctgctgggatagaataaataatctctgcattcttagagtttaaactctaaaagcagtaattggacactgatatgtgatgtaagaaaaagtagagtatgttaaaagaataaaagtgtatggaggaaaaagtagagcagggtaaagaggattgggagttttgagagaaggcttacagttttaaatggagtgttcaaggtgtgattgatggagaaggtgacatttgagataaaatctgaaggagaagatggaataaactgcatttatctgagaaaggaacgtttctgaccaaaggaacagtttgagcaaaggctctcaagtaatagggtgtctgacttgttcatttttgaaagtagaactaataggatttcttattggaacgtagggtgtaagagaaaagaggagtcaaaaagagccacaagatttttggtctcagcaattagaaggatagaattgacatttactgagatttttgtttttgtttttgagacggagtttcgctattgttgcccaagctggcgtgcaatggcgtgatctcggctcagtgcaacctccacctcccagattcaagcgattctcctgcctcagcctccagagtagctgggattacaggcacgagccaccacgcccagctaattttttgtgtttttagtagaaacagggttttaccatgttagccaggctggtcttgaactcctgacctcaggtgatccacgcagatcaaagtgctgggattacaggcgtgagccacggtgcccggcctttagtgaggttttaaaaggctgtgagtggagcagatctgggggacaaaggttagaaatttagttttaggtatgttaagtgtgagagatacgaatgaaagtgttgagtaacttggatataccactttggaggtatgggagaggtctgagctagaattaaaaataggagattatatttatatgtatgttaagtccacatgtttggatgagatcacccagggagtgagtgtaaccagaagagagatttaaataccgagttacagagcacttacttgaaggttcacaagacagagaagagaagccaggaaccaagatgagaaggagctgccagtgagttaggtgacaatggtatcctggaagaaaatatttctatgatgaggggagtgatcagcaatgtgaaatgctattgatgggccaagtgagaactaaccatttgatttagcagtaggtcattggtgtacctgataaagagcaatgttagtggagtagcaggggttaaattccaattgcagtgggtttacaagaggtggaaagaaatgagatggaatagaggattgcaaacaattcttggattttgtctgacagaagagcacagataatgtatctcataatacaaaataaagttggaatgttggtaaactgttaggtggggggttgtggaaattgatagaatcaaggtcaccagcagagagaatatggctgggagaggaggaatgagtggttaatggaggaagtaaattgtgtagcaataggagaatgaatggaaacaggaaataaaactgttgtgctcacttgaaattttggatcatgaatttatattaagtcaaaatgagtggtttttctactgattttttttttttattttatcttttccaaatgtgaattctgcaactttagtaccacactgtgctcttctctgtgctttgccattatatctgctctattacatttgatttctcagaactgtagtggctgggtaattatctttcaggagtgttttagaagaaattcttccgcaggagggatttgaagtacgtgatctgaggactcttccaactctgaagagattggttatgttattatttctgcttttcttctttacttattcgtgtctctgtttatacataaccatgttttttcagccttgactattggggaataaggcattgggaatcattatgatagttttacaaccaagtagttctttcctttcctttccagtttaaatggctatgaaccctgttggaattgtataaagggaacaattgaggaagaggttggtgcagtgattatttgaaaacttcagtcatcagcgtggagggcccttctcattgtgtttgaggtctgcatgccttttctaaattgagcctgtattaaggctgaggtcagacacagcattgttattctctgtctgtaatgtacttacatacttactgaatatatcacacttcttttggaatgagagttttttttttttttttttttttttttttgagacagggtcttgctctcttgcccaggctggagtgcagtggcatgatcatggctcactgcagctttgaccttctgggctcaagtgatactcctgccttaacctcccttgtagctgagaccacaggcatgcaccaccacacttggctaattttttaatttaattttattattctttctagacagggtctggctctatcacccagactgaagtgcagtagtgtgatcttagctcacaacaacctcctcctcctgggctccagccatcctcccgcctcagcctctcaggtagctaggactacaggcgtgtgcccctatgcctggctaatttttgtagtttttttttgtagagtcgggatttagctgcgttgcccaggctggtcttgatctcctgagctcaagtgatccacccatctttgcctcccaaagtgctgggattataggcatcagccaccaagcccagctgatttatctttctttttcttcttcttttttttggggggtgggggagcggtgtagagacagagtttcactttgttgtccaggctggtctcaaactcctgagctcaggcagtcctcccatctcagcctcacaaagtgctgggggtaacaggcatgagccaccacgcctgtcctggaatgtggggatttctgagtactaaactaaagccatgctgataactaagcatagtgaaagtagacatcacaattaaggtagatccttaccaagttttccatgctaaaatgaatcaattttataattgctgtaagacctaaatttatatagagcaaagtaattcagtagcatttaccagaacaggtttgccattaggtagttcctgtgacaaatgtttaccaaatctcaaagagcttgtataggaatgtcatttccttgcctagaatttctgaatatatgggcacacttatatatatagccttaaaaatattaataagggcatttaataacttgattcattaccttgatcccattaactattttccttgatagatcttatgttcctcaagtggggattctcttgccacagaatttggagagagaatatagtttatttgagtattaaattatgtttaatctcttctttattcctacagcttaaaattggaattatatctattattttgaccaaatatattttagtcttcttttagtacatggatattatctttcaagttctcttttaataaaccagccaagtctttttttaaccataaatttcattgaagtttaacaaattcacacaacagtgcacaaatccataaattttcacaaactgtctgtgttataagtacccagctcaagaaatagaaccttagcagaagcccagaacctccttgatgcctccttctggttactaacctagggacaatttcctgtctaataccatacatgaattttccctatttttgaattttagataaatgtaatccatatagaatatcctcttttgtatgaggcttcttttattcaacatgtttgtgagatccatctatgttacttggagttgaggtttatttatcctttattgcatagtatcccattataagaatactacaacacggtgcaattacactactttagggtggacatttatttctagtttttggttcaaatacagctggtgtgactatttttatacaagtctcttggtgaacatatgtacacgcttctcctggacctaggaatggacaaagctttgttttgtatttttttaaatactctgaaaagaaaatgctatgtttttaaccattaacttgattaaaacattattacatttttaattatttaatcagaataactttcaaagatcatttcaagtctaacaaaaaaacataactttgttctttaataagtgtaatatttcctggaaatatgcctgggaatttttcttgaaataataagcgaatcttgacattaattggacattttcagaatgccctttggcgtgaagctatgtttcatgttttagaatgctcctctctaggtactttctttttaaccctgtccaatgtacttgacttttgttttctcactgagaaaatgaaagttcagaatgatttttttggggatagtaaggagactttgcataatgggaaataatggtcaggggaaaaccctttgttttataaggggccatttttgtatgctttttttactgaaacagagaaggtcaggttaattccatatccaaattaaatttatgattttcaaaagggaagccttgataatctaaccaaacgtgtccattatctaaagttatttggaaaattgtgtcactttaggtggaggaagctaaacaagaattacaggaagttgttgaattcttgaaaaatccacaaaaatttactattcttggaggtaaacttccaaaaggtaagatatcttttctttatcatgatttgatggaaaaaacaaaaacaaagaaacaaacaaaaaaaacctatattacttatttaattttaactgattaaagtttaagtcttaattgctattttacaaaatagatgttcattctgaacatacaattccatagccttttttttttggtaactgcaagtttttatatactttcaaatttaaagttacaagaatagtacatagaatgctcctcataccctttacctagactcacaaatttttaatatttagtttcctttttagacccaggcttgagtgcagtgatgcaatcatggctcgctgtagccacaacctcccgagttcaggcggccctcccaagtagctgagaccacaggtacacaccaccatgccggctaatttttgtattttttgtagagatgaggttactccatgttgcccaggctgctcttgaactcctgggctcaagcgatccactcactttggcctcctaaagtactaggactgcaggcatgagccagcgcactcaacctaactccattttaaaaatcattcactttgtctctttatgtatatataaatataaaaattatttgtaaataaataaatttttaactatttgagagtaaattgtaaacaatcaccccaagtgtgtatttcctaagaataaggatattcttctatgtaactccagaataatattaaaattaggacattactgggtgtggtggctcacgcctttaatcccagcagtttaggaggtggaggcgggtggattacttgagatcaggagttcgagaccagtctggtcttgaaccaggggccattggagttccaaccagcctggccaacatggtgaaaccctgtctctactaaaaaaagaaattagctgggcttggtggcaggcgcctgtaatcccagctactcaggaggctgaggcaggagaatcgtttgaacctaggaggcagaggttgcagtgagccgagattgttcccactgcactccagtctgggtgacaaagcaagattctgtctcaaaaaaaaaaaaaaaataggacatttaacatacatacaaaaccattatcaaatttagagtctatattcaaatttcagcatttgctccaatagtatcctttgtagtgttgccctgatccctacccacttccccagttcaggacctaatccaggatcacaggtaacatttaggcttttattgtttttttttttttttttttcaaatgaaacaatgaaacaattccttagccttttgtgagggagtggagagaagaggatctttcatgatttttacagttgcaaagagtacttgcctaattatttatagaatgttctcagtttagctttgtctgatgttttctcatggttaacatgacttttaatgacttcacagtatccttctaatttatggttgtatcacaatttaaccatttatattgaatttttatatggtttccagtttttttgctattaagaatagtgctgtgtttcatcttaattcaaggctttgcctgcatgcttaattatttctttagaataaatttctagaaatggaattgctgagttaaaggatgacactcctttttaatgcttgtttttatgctgccaactatctccactgaaaatacagcagtgtatgaaattatttgcagtaacctttgctaatttagggtacatttattaaatcagtgcttaataatgataactttagctaatatcactggcaaaagccttatcaacatcatgtacttcctgatgctctagaaaggacccaagtgatggcttatgtggtgtccacgcaaaaaggaattaaaaaagagcacaatctcaatacaatcatgagaaaacactggaaaagcccatatcaggagacattccacataccacctttacatttatttaaacatcacagagtgaatgtttaaaaccatagaagtattaatagttacactcttcctctttctaatcacaaggagtattttaaatttgtagaaaatttgagtagtataaatttgtagaaaaatcttcagataccaagatgtaatccacagaaattaatatgatttaaaccagttaagtataactaaaacatgacaatactaggatagtcttaaagctatttttgagcttgagctttctttaaaattttttttatgttaaaatgcagcaaacatgtatgtaaagaagttttgttgctttttaaatgtaatatgtatatttataaaaacatataaatcaggtaattctgtttttctaacgtgaaaatctttggtgttatgaaaatttgcaaacatggaaaaccttgaaagaacagtacaattaacatccatatcctatccacttagactcaacaattgttaacattctgtcatatttgctttctgtgttatgtgtgtatttttccccctgaacatttgaaagaaaactataaacgtcaactacttgacatctaaagactttcttgtacatcacctaagaataaggacagtgtcctaaataaacataataaccttatcccaccaaaggaaattatgcctatttccttaatatcatgtactctcagtcttgtttaaatgttttcaccagatgtctctagaattttttgttctttatgaaaaagcatcaaatcaggattcactaattacatttggttgtttagtcttttaatctatttttacatgaattttatcttatttagtgataaatgggtttatatttttttgcctcaagattctccctgtcatgtctcttgttgatatggaaacaatatttatataatacaggaacattaattttggacaagattctgaagtgaaccattagcagagacaagtacggtttgctgtgtttcaaaatattggttattggtgtgacctcagcctgaaaattatataaatgaataattatttattttataggttcatatcgagggattttttaaaaatactttgaatcattctcgttttcattttcttttaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagtacgttttggtgtatctttgatgcagtgctaaattttgttaagggaagtgtgtatcttaccctttctttgctaattactttttttcttcctttttttaatttctattttttggggcctccagctttgcatgctaattagttttgattgatagttaaaatagccattgtgggaccttggtttgggtaacttactatatgaattatcggaagagctagtggaagtgcaagatgaagttggaggctaccaaaaatctcttagtgttttttcattttattcatcaattttgtagtatggaattaaggagtaattagcttcaaacctgattgtatatatttgtatagctggaaagaatgaatgaatgcccaactgttttgttttatatcatttctttggtatagttttttcccccctgaagatactatttttaagtcagtaaaaaatgacgtccttttctttcagtgaatattttttgttggcttttgacagttgtataggattttaatatttatctcgttttgttcaaaagtgttgactttctttcagcttatttgaatgttttttgttttcttaggggaagcaaaggcgaatgctccttgtgttatatttattgatgaattagattctgttggtgggaagagaattgaatctccaatgcatccatattcaaggcagaccataaatcaacttcttgctgaaatggatgggtaattgagtcttcttttttcttagaatatggtgatgcctcccagcatttgatatacgtagaattgatcttatgcaaattatttccataaggcatttcatatctagagatatgaaaaatgtgatgtgtataggaaacagagtagtccctcatgcaagaactcaagacaagctttttctctcagtattgtattgttttcattactaactggatatttgaatatcaactcatcttatttaatttatggtatttatatcctttctcatttattgttacacttatgacagaaaaacaatgatttatgccgagactagtagtctatttgaagaaatacagttgtttctacataatttatgactaactttgagtgttgtggcagatttaaagcttacatcaatgttcataatataagaagcaagaggtgatgttgctttgaaagaagtatcttaaaactcaatataagacattttgaaaccacataggaagcccaggagcaaataatttgaattggtatacttgaaagtaatttttcaaaaattaaccaggcacctaagctttttatatcaggttatcttttcctgcatagaccagataattgtgaaggtatgtagtcagagatgaattggtggtttattatcagtttcttttcttggctgttatttgattaatgaagctgggcatggtggctcacgcctgtaatgccaggacttttggaagccaaggtgggaggattgcttgaggccaggagttcaaaaccagcctggtcaagatagcaagaccctatctctactaaaaataaaaacagtcaccgggcacagtagctcaagcctataatcctagcactttgggaggctgaggcgggtgtattgcttgaggtcaggagttcaagaccaacctggccaacatggtgaaaccccgtctttactaaaaatataagaattagctgggtgtggtggcaggcgcctgtaatcctggctactcaggaagctgagacatgagaattgcttgaacctgggagatggaggttgcagtgagcaccattgaactccaacctgggtgacagtgagactccatctccaaaaaaaaaaaaaaatagtggcttgtacctagaaattggggagaaaagatttaaaaataaataaaaaataaattagtcagatatgttggcatgcacctgtcattccagctacttgagaggttgaggcagaaggttcacttcaacccaggagtttgaggcagcagtgagctatgatcatactggtgcgcttcagcctaggccacaaagcgagtcctagtctcaaaaaaagaaaacaaaccagttttgtgtagagcatttctacatgtgtgctgtgcttcagtgttagtaaaagatactattttttttccaatatagttttaaacccaatgaaggagttatcataataggagccacaaacttcccagaggcattagataagtaagtattaaaagaagatttttgtgaagtactgttacatgctacaaaattgtgctaaaagaagtccgttgcaaaagatcacatcaacactgtatgattccatttatatgcaatatccagaataagcaaattcacagagacaaattgggttagcggttaccagaggttagggagaatggggaatggctgtcattggatatgggatttctttgtgggggatgggaatattctaaaattagattgtggtgatggttgtacaattctgaatgtattaaaaaccactgaagtatccactttaaattatgtgaattacatctcaataaaacttaaaatatttatttgttatatgtcacaaaagttgtatgtagagagggtttttaaaataaattaactgtagtattataactaggtttaaagttactatgaaaaaattttactgtagaagttattcgtattttcatttgatcagtagtttgtcactgcctaagactctagtctaacattctgtacttagcagttgagatggatgtgtggttctcataatagtttgttgtggaattatttgttcctggactgaattacctgcatgcttttgtttctgaggggtaggctacctaggtacacacgtgtatctaaatgaacctttgttctgctttctggttattgacactgttacttgagccatgttttaaaggaactatctgaatatttatgtacaaaactccatctgcgctctggctgccattggcttcccagtcacgtcattagggtgtcagtcctgttgaatttgagcttaaatagttttaatttatattttccttttgcattcttcctgtagtgccttaatacgtcctggtcgttttgacatgcaagttacagttccaaggccagatgtaaaaggtcgaacagaaattttgaaatggtatctcaataaaataaagtttgatcaatgtaagtatcaaaacaaacatttgtcatttctgtaaagtggtaatataccactcaccctgtttgtggtcctttcatgatacatgtattaacattaaaagaccagttcatttttgtcttttttttttccattagtatgttcgtttaaaagtccattccttagtgtatatccaggagattctattgttttgaaccctgagtctaaagaaaggtttttttagagtattcagacagataatatttgaggatacatacatatacatacacacacacacatttttttaagatgaatgtaaaatgcaaaataatttaaaaaagctgcagaaacagtaactcatgatatagtcagtgtggggccaaaagagaagaaagcaaattataaaacaaaacacatggaaatttattactcacttgagtaataaatgaaattattaaagctgcagtagtttcagagatagctgtatcaattcattaaactatacatgtttcctataagggcagcttttatgtctaaagtatttccagatgaaattcagagaaaaagtgactaaactatggctcagaatagctagctattttcttttttcccttggaatgtgaggtgttttttttttttggtttttttttgagacaagagttttgccctttttgcctaggctggagtggagtggcacaatcttggcttactgcaacctccacctcccgggttcaagtgattcttctgcctcagccttctgaatagctgggattacaggtgcatgccaccatgcccagctaatttttgtatttttagtagagatggggtttcaccatgttggccaggatggtctccaactcctgtccttaggtgatctgcctgccccagcctcccaaagtgctgggattacaggcatgagccaacgcacccagttggaatgtgagttctttgtgaagagctttcttttacctgttttagacttattagcgttgtgttctctttttacattagccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatgggtaggtttcctttcttttttttctgtcttttacttttcattgtgttagataattcatttaggggcaaatactctattcaaacagctaaagccatggctatgttgaatctaatcttactctaaaacttcagtgtctgggttttcaagatttgtaataaatgattttacaaaattcccaacttaacatcaaacaaatgccattaaactgtaacattttcttgacaataatcttgtcagtgatacagaactgattttatagtgtaccacatttattagttttgtctctttcttagaaaacctttttttctgactggaaagctttaaaaagtgatgggaacatgaaaatatatacttgacaacaccacaatttggcatcttacgaaacaaatatattctagttgcttatgtaattatatagttaaactggtagtggggagatgaggcacgtatacatttcctcttgtcagacattgctgcgaaaaaggatactttattctgtgcttaatttcgattttaaatcttggattggcttaaaatcacattaattatgatattcttgttaaactggaagtttattttatagaaatagaaataagttttcccttttgaattaagatgatagttttgacagttttggttttcagttaaattgttaaagtttgtatgtgttaggaatgaattctgcccattttaaaaaactttgtagactgggcgtggtggctcacacctgtaatcccagcactttgggaggccaaggcaggaggactgcttgagcccagaatcgttggagttcaagatcagctgggcaacatagcaagactccatctctaccaaaaattttaaaaattagttgggtggggtggcatgcgactgtggtcccatctacttgggagtcctaggtgggaggattacttaagtccaagaagttaaagctacagtgagccatgatcatgccactgtattccagcctgggttacagaccctgtttaaaaagaaacaaaattactaaaaattactaaagctaggtgcagtggcacatgcctgtaatcccagcactttgggaagctgaggtgggtggattgcttgaggctaagagttcaaggttggagtgagctataataagaatgactttaaggagaatgagttttttgttttataatattaatcccatatcagatacattcacctctcagtatccactgaaggggtggggattggttccaggacccatgtggataccaaaattcagggatgctcaagtgtcttttataaaatggtgtactatttgcatatacctacataattctcctgtatacttcaaatcatctctagattactaatacaatataaatgctctgtaaatagttgttataatgtatttttttcatttgtattattttttattgttcctcttccccatagttttaatccttatttggttgaatctatggatgcagaatctgctgataggaagggtggagtgtatttgatttgcagacaagaatgtgttttgttgatttaaatatacctttctaatggagtatttactcaattaaatttatcttagggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtaagttttttgtagtgtctcgccctgtcacccaggctggagtgcaatggcgcgatctcagctcactgcaacctctgccttccggattcaaacgattctttcacctcagcctcccaagtaactgggattacaggtgcccaccaccacgcccagctaatttttgtaattttagtagagatggggtttcaccatgttggccaggctgctctagaactcctgacctcaggtgatccacctgcctcagtctcccaaagtgctgggattacaggcgtgagccaccatgccctgcctaattcttaaatatctaattactccgctgccccaaaagggaaaacattatgttttgtagtaactgattcagtagtttctctaagatttttatcatttagtacaagtttatcagatctttcaacattgtagacatttaaaaaatttctatgcacctggggagaaaacagtcctattgcagcattatccacctattgttgttgctttataaaggatgtttttattctctaattgctggtttttcatcagtcccctgatgaccagctttcagcaacatggtataaagtactttagtgagagctaaatgataattctggtttgtatttttttattttgcccagtcttacggtgctgaaattctggtttttaatgtaactatatcagaactgtatctgaattttttttaaatttttattttattttatattgatggagtctcgcgatgttgcccagtctactctcaaactcctgggctcaagtgatcctcacacctcagcctcccaaagtgctgagactacaggtatgagccactgcacccagcctgtatctgaatttctttcattacattttattttattttaatttaatttggttttattttatttattgtattttatttttgagatggagtttcactcttgttgcccaggctagagtgcaatggcatgatctcagctcactgcaacctctgtctcctggcttcaagtgagtcttctgccttagcctcccaagtagttgggattatagccatgcaccaccatgcctgcctaattttgtatttttagtagagacaggatttctccatgttggtcaggctggtctcgaactcccaacctcaggtgatccacccacctcgcctgccaaagtgctgggattcaggcgtgagccaccgcacccagcctctttgcttattttttatctgattaatttttaattgtctaggtgtccctgttacctgagaatgacagatggaatgaaactagagcccagctgcttgcacaaatggatgttagtatgggaggaagagtggcagaggagcttatatttggaaccgaccatattacaacaggttagctttaaagaatggctttagttcaaattatatgtggtcttaaagatatgttttaaaatggtatgtttttattttattttaggtgcttccagtgattttgataatgccactaaaatagcaaagcggatggttaccaaatttggaatgagtgaaaaggtaatagattttttaaatccttttcatgtatcaaattatgtgtcaagtgttgatttgagagctggttctgattataaattggtaatattcactttttctctcactccaaatggatttgaggctctttattctgaacattgttattctctgaataaagaaaatggaccttctcttagctgctgagaatgagctgcccagatagtaactattacttcacgagttaattaagtgataaagcaaggtgaattccttagcttttccatgtggcatgaaagagtctactttctaagtttggttactttactgtttccctctatttcatattttcatcttgtcattgttccttgaagcactactatactctgtgaattatggatttctatatttgaagtagctgccaaggtttttcaagaaagtactgagaaccagacttaaaatgattttaggctgggcactgtggctcacatctgtaatcccagcactttgggaggctgaggagactgtattgcttgagcccaggagtgagttctggaccagcctgggcaacatggcacaaccccatctctaaaaaaatacaaaaattagccaggtatggtggtgtgtgcctgtaatcccagctacttgggagtctgaggtgggaggattctctgaacccaggaggtcgaggctacagtgagtccactgcactctaccctgggtgacagagcaagaccctgtctccaaaaaaaaaaaaaaagattttaaatgttctgtcttgctcatacttttactattttgatattagtgtttttttgtttctttgtttttgagacggagtcttgctctgttgcccaggctgtagtgcagtggcgtgatgttggctcactgcagctaccgcctcccgggttcaagcgattctcctgcctcagcctcccaagtagctgggattacagtcacctgccaccatgcctggctaaatgttagtctttatactttcagaagaatgtggaaatttctttgccctcaaatgcagtttttatttttattttttttggagacggagtctcgctctgtcacctaggctggagtgcagtggcgcaatgtcagcttactgcaaccaccgcctcctgggttcaagcgattctcctgcctcagcctcctgagtagctgtgattacaggcacgtgccgctatgcccagctattttttgtgtttttagaagaaatggcgtttctccgtgtttccaggctggtctcgaactcctaacctcaggtgatccacccgcctcggcctcccaaaatcctaggattacaggtgtgagccactgtgcccggcctcaaatgcagttttctattgtacttctttcttgtcccccatatatttgtttccttatatataggatagtactttctctttcaaatttgttggtgtttgggggttttctgttcaattactttcttccttttggttttagcttggagttatgacctacagtgatacagggaaactaagtccagaaacccaatctgccatcgaacaagaaataagaatccttctaagggtaataatattttttgtgcttatttattttcttaggaacaatgtgcttaaatagtcaggttcttaaaaaataacagctgaaggccctctgttcactagaaacatcattttataaaataaagataatagtcaccatggtgtctggggaaaaaattaaaaaataaagataatagttgcagcatttcagcaatgatttaaatgttattaaggcacctctctgttcatgaacctggacacgggctaagaacagttctatattgcatggttgtaaaaattcaattctcagggtgagggacaaaataactacatattaggtattaggtacagtgtacactatgtaggtatggatacactaaaatcccagactttaccactatacaattcatccatgtaaccaaaaccacttgtaccccataagctgttgaaataaaatctatatataaaattttatatgtatataaaattcaattgtactttagctgcaaaactgtaagaggtaatagaatgggaagagtattgtttattgagtctttgacatgtattcaacaaataaatttttttttttttttttatggagtctcattctgctgcccaggctagagtgtagtggcatgatctcggctcactgcaacctaagaaataagtttagtaggtgttttattgttggttttttgtgggttttgtcattttttttttaaggggatgggtcttgctatattgcccaggctggacttgaactcctgggctcaagtcaacctcccaagtagctggggctacaggcacacaccactatgcctagctctatgatttcagttttttgtttttgttttttcttttttttttttttttgagacagagttctgctcttgttgcccaggctggagtgcagtagtgctatctcggctcattgcaacttccgccttctgggttcaagtgattctcctgcctcagccttctgagtagctgggattacaggcgcgtgccaccatgcctggctaattttttgtatttttagtagagacagggtttcactatgttggccaggctgatctcaaactcttgacctcaggcgatccacccacctcggcctcccaaagtgctgggattacaggcatgagccactgcgcccggcccaatttcagtattatgtatgttgaatttgaggcatcttagttggaaatagatgtgggaacttagtggagagattggttatgtattgcatttgaatgttgaagctacccattcatgaaggcaggtcttttttttttttttttttttttttttttttttttttttttttttgagacagcatcttgccctgtcacccaggctggagtgcagtgctgtgatcttggctcattgcaacctctgtctcccaagctcaagtgatcctcccacctcagcctcctgagtagctgggactataagcgcatgctgccatgcctagctaattttgttattttttgtagagagcatttcactatgttacccaggctggtgtcgaactcctgggctcaaacgatccacctgccttggcctcccaaagtgctgggattacaggtgtgagccaccgcacccagccaggcaggttttaagggtaagactgaccagcctgggcaacatggcaaaacctcatctctacaaaacatagaaaaattagctgggcatggtggttcatgcctgtagtcccagctacttgggctgaggtgggaggatcacctgagcccagggaggttgaggccgtagtgagttgtgattgcctgacttcactccagcctaagcaacagtgagactgaaaaaaaaatagagagagagagagtgacagagctgagtgccaaagtctttagtgagtaaggactatgtttgtcagatggcacaatgaagacggttggatagctccatagtcaaatggcctggacttcaacagaataggaagagtgcattatataagagggtaggttagtaatggtctgaaagaggtaatgggaacaatgagctcagctgtttactgtgaagtaactagggtaaacatgaacaaatagcacttgagagggcttagggaatgcattctccacaggagggaccatgggtttgattatttcaaggaagtagagggaatgctttagagtagttaaggatacagaaagtttgtatgatggaaaggtttagagagtgttatagaagaggtggtctctgccttctcaggtgtttattctcttttccttactatgttataatgcacaaattatctctactgtagaatcaagattctacatgattttataaatataaacagatttcatattttttagggtacataaagtttttctttctcttcccattgactggttttcgcatccctgcatttgctgctgcttacgtatctccttttctgtttcaggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaat

SEQ ID NO: 35844 - DNA, 42346 bp, Homo sapiens
agccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccgggtgggggtacgggtgggggtgcgggtcggggtgggggcggagggctaggaagctccgggtcggacgctccatcccgtcctttgtattggccgggggtcttttccctcccaagacccctaggcgtaccctttcaggcctagggctgctttgctggaggaaggggaggaggaagcgggtggggcgaggtgggggtgcagcgcgttgattaagggacccgcggacatagagtcggaacccaccaaggaccgcgataaagcgctttagggttttggcagagtattcaggcacaaggtctcttaacttgagcatgcagattgtgtgttgtgtaaaaaccatacggtccataacattgtggggtgtggctggggggactgtcactgttctgtgggccttcattcggctatacagcattctcaaacactggaccgggatgcgatgagggagtgatagataatataccttatgccagagctgataatgtggtttttactagaatttatttttatgggaacacgatatagattgacctgccctttctaatactttaaaaggtcactataggtacttgtttgtgggttttttttttttaatttgtaatgatatgtctgtgtttatttttctagattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctaggtaaacttcgatattattttgagaatgaaatgaaaaaagaaaaaacaaaaataaaaaactcatatttcatattcctttataattagaaatgcttaatttttgtctaaagtttttctaggatctcttcgatagaccttttattaaaaatgcgaacttctttaaatattggttgtttgaaatagaacatctcagtttatcttagtaaacctaaagaaattgtaatagtttagatattcctcaaaatgtcataatttttgtagacttcaatatattaatgtggctgattattttctctaggcaacaggttgaggatgtgtattggaatatcttaattccatcgtgcacttaacttcatgttacttagcttgtaaaaccaaaagaactttgttctttggattacccacccaaacaattaggtgaacactggaataaacatgtattttccagaaaagtttaccttttcattttttatgcatttttgcaaataagaaaacaactatatttctgaactttttgtaatgtttaatttttgggggtacacagtagatgtatatatttatggggtacatgaaatgctttgatacaggcatgcaatacataattatcacatggaaaaatggagtatccatcccttcaagcatttgtcttctgtgtgacaatccagttacactttcagttatttttaaatgtccaattaaattattattgactgtagttaccctgtgtgctatcaaatatcgggtctaactcattttttctgtacccattaaccatctccacttccctaccactacccttcccacctctgataaccatccttttactctgtctccgtgagtttgttttgatttttagcttccacaaataagtgagaacatgtgaagtttgtctttctatgcctgacttatttcatgtaacataatgacctccagttccatccatatttttgcaaatgacaagatctcattctttttttatggctgaatagtactccattgtgtatatgtaccacattttctttatacatttatctgttggtggacacttaggttgctttcaagttttgactgttgtaaacagtgctgcaacaaacataggagtccagatatctctttgatgtactcatttcctttcttttggatatatacccagtagtcggattgctgaatcgtatggtacccctgtttttagttttttgaggaccctccaaactgttctccatagtgggtatactagtttacattcccaccaacagtgtacgagggttcccttttctccacatcctctccagcatttgtttttgcttgtcttttggataaaagccattttaactggggtgagatgatatctcattgtagttttgatatgcatttctctgatgatcagtgatgttgagcaccttttcatatgcctgtttgccaattgtatgtctttgtgaaatgtctgttcaaatcttttgcccatttttaaatcagattatgagtttttttttttcctgtagagttgtttgagctccttacatatctggttattaatcccttgtgagataggtagttagcacatattttctcccattctgtgggttgtctcatcacgtatgtcgattgtttcctttgctgtgcggaagctttttaacttgatgtgatcccatttgtccgtttttgctttggttgcctgtgcctgtggggtattattcaagaaatttttggccagaccagcgtcctggagatttttcccaatattttcttgtagtagtttcatagtttaaagtcttagatttaagcctttaatccattttgattttatttttgtgtaagttgagagatgggggacaagtttcattcttctgcacatagttttccaagcaccatttattgaagggactgtcttttctccaatgtatgttcttggcacctttgtcaaaatgagttcactgtaggtgtatggatttgtttcttggttctgttattttccatgggtctttatgtctgtttttatgccagtaccatgctgttttggttactgtagctatgtaggataatttgatgtcaagtaatgtgattccttcagttttgttctttttgcttaggatagctttggctattctgggtcttttgtggttccatataaattttaggattttttttttttttctgtgaagaatgtcattggtattttgatgggaattgcattgactctagattgctttgggtggtatggacattttaacaatactgattcttctaatccatgatcatggaatatctttccatttgttgatgttctcttcaatttctttcatcagtatttatagttttcattgtagaaatctttcatttatttggttaaattaattcctaggtatctaattttatctgtgggtattgtaaatgggattagattacttcttcaatttctttttcagattgttcactgttgtcatatagaaatgctactgatttttgtatgttgattttgtgtcctggaactttactaaatttatcatatttctgaattttaaaaatgtataccgtgtctcctttttgtgagtgattctgtcaagaaaaaaaaaatttataattaatatgctttccaaagtaatgattcttgtttaattgaactgctaaaaataaatacaacttaaactgataaatattgtttaaacagagcagagtgaaaattatgcttcaaatatagaaaggatcttttagaagatagtttgcagtttgaaaagaaacttaatattttacttgcctattcccacttcttaatcagcagtaatggaatacctcctgattctaggttacttaatactaggtttctattgaggtctatttttagagaagggaaaagaaacccagttttatgatatttaaaatgataccattatatacataagccacatatatttcccttttttcatgttcatgtaggatagttgaatgcaaaatagtgaatacattcattagtgtttttcctcataatttaaaaattttcattgttagatcctcaggatacctaaggttatagctaggaaggtaaagaataaaatctgcccttagttggaacaatgccctagtcttaattgaagctgccttagctaccttcctccaaccaataaataaatacatactctccagtttaatgtatatttttgccattaagaagagttgagactgggcatggtggctcatgcctgtaatcccagcactttgggaagctgaggcaggtggatcacttgacttcaggagttcgagaccagcgtggccaacatggcgaaaccccatctctagtaaaaatacaaaaattttaagtggctattaaatgaagagttctgtgggccagatgaaccaccgcatctgacgctcagaactctgtttcatagccgcttagctctaatcattagaaatgtatttctcatatttaggcccaaatctggttcccggtaactactacccattagttgtagttcttttcctcataatggccctaaggttattgaagacttgtaatcattctttgttctccccttcccaagataattcatttattttgatgatctaaacagttgtagtacagtgtgctactacatacttctctgcctttgagttttggatccagaagatttttagtactataaattcttcagtatgcaatgataatggtgtgaaattttagatagttttgcgtaaaatactttatgttgcagagtttttaggctaaataacagtaaactagcattttatctttaatgtgtcatccttaattctaaataatgactactaatctagaacatttgaattacctcccagttttccagatgatatcttaagaaagattctaaagttttacagcctgcctgcagaactatgatgagattttagaaataatccactactttagttttcagcctttttgagtatgacgtttctctttctaatgttaaaaaagttacatatttatcctcccataatagtagttttaactttgttaaaatgcacacaaatagctaaaagctgttttgaattcaaaatcaattaatagtatgtatttacattttgaaaaatagctatatgtgttttgaaacacgtttacttggtatgactgtagattcatggagcctgcattaactcaattggttaggaaccagaaatctaatccagcgccttcatattatatataaagagtctgatttccagagataaatgacttgagcaaagacagattatttggtggagaaccaggtggagaaccttgtcacttgggtttgtacttttattaccattgctgatactgaagtaagaaggtacattttattttgttaattgcttttaaatttatgtgatgaattttcttttgaaataattgtgcttttttttaaaaaaatttttgattcagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggtaaaccaaatcataattatttctgaatattgctttgaatttaaatgtaaaattggtagaatgggctgtgttttaattgttaaaattgagtctttgataagatgtaagttgtagagatttggaattgtaaaagagttatttttaaaagttttattgtcacttttcagacattttctatgcattttatgtgtatatattaattaaaaaacagtgacacacatataagacattgatgagataggtaaaaattgcttcagtcaacaagaatatgatggaaattgtcggtaatctaggttttttctcaaacgtattttttttccattggaaagttttgcattaaaattttctttttgtaaaaagctgaaactcagcatttcatattttaatttttatatcaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctataggtaaataaagatactgctttggcttcattctgtgagtactgtttagtcttttagactagtggttccaaagtggttgcttgcagactgaatatagcttgaagatatattttgtatggccagcactgtattttttattatgaacattgaaaagtcaaaagatctggcagcgctgttcctagcttccacaagacaacattctgctgaacttgtataacagtaaccccctttaaataagttatatactttacagtttatgacagtgcttgtcattctcaaccgtattactccaagccactttatatgttcacttgcttagcctctataggcttttaactttggtccttgttttagaattcgttttgtggaatgtcggtctttttactgtcagaagctttgaggaaggaactttttaaatgagaagggctacagttataactgagtccaattcttagaaagctgaagattttgaatttttatttgtttttgttttgttttgagatggagttccactctcgttgcccaggctggagcacagtggcgcgatctcggctcacaacaacctccacctcccggattcaagtgattctcctgcctcagcctcccaagtagctgggattacaggcacccaccaccacgcccagccaatttttgtatttttagtagatatggggtttcaccatgttggccaggctggtctcgaactcctgacctcaagtgttccactcgccttggcctcccaaagtgctgggattgtaggtgcaggctgccacgcccggctgagattttggatttttaaaccaatttaaggaaccagttagatgaagctagaatgctcagtttttacagtcacaggtatcaatttattaaggactacaatgtaatttttataagcatctttgtactttagtagatttgttggttaagatataatttcatagttatcttactgttagattttatccattaaggaaagtggtattctggttaataatgtagatgagccaggcgtggtggctcatgcctgtaatcccagcactttgggaggccgaggcgggccgataacctgaggtcgggagttcgagaccagcctgaccaacatggagaaaccccgtctctactaaaaatacaaaattagctgggcgtggtggcacatgcctgtagtcctagctactcaggaggctgaagcagaagaattgctcgaacctgggaggcagaggttgcgatgaaccgagatcgcgctattgcactctagcctgggcaacaaaaccaaaactccatctcaaaaaataataataaaaataataataataataataatgtagggtgagttcctttaatgttaccatacagactacacaaatttcagaatttaaactatagtgcacatagaaaaattaggccatttataggacaattggaaatgtgaacactatgtcttgatattaggaaattattaattttgtgaggtgtgatgatgaataattagttttgcaagtaaagagtccttgattttagagaaacctaccaatatatttacagaagaaaggatacattgcctgtgatttgcttcaaaataatatggcaagaggtaaatttggcaaggatatagatgaaacaaaactagctatgaattataattgttgaagcaaggtgatggattttattaagctagtgttcactcttctctgtactaatatttctaaatttccaaaagaagaggcaagtcagtaagcaaatagtacacaactaataaaattcaagggactatgtttttcctcttaatgtaattcttaatatattgatatgcttaaaatgtatgcacaacagttattagagacattggttaacagatggtgtgttgaataaatcagctttttctgtattgaactagaaaacgtataatttgataatttaatagatgaaggtataactttgtgtttccttctaccagttcctttttttttttttttttgagacagagtttcactcttgtcgcccaggctcgagtgcaatggcacgatctcagcttactgcagcctccacctcccaggttcaagcaattctcctgcctcagcctcccaagtagctaggattacaggcatgcgctaccacgcctggctaattttgtatttttagtagagatggagtttctccatgttggtcaggctcatctcaaactcccaccctcaggtgatccgcccacctgggcctctcaaagtgctgggattacaggtgtgagccactgcgcccggctccttctcccagttctaattgatttgaagtttcaaaaagcaggccgggcgtggtggttcatgtctgtaatcccagcactttgggaagccgaggtgggtggatcactcgaggtcaggaatatgagacaagcctggccaacgtggcaaaatgctgtctctactaaaaaaataacaaaaattagcctggcatggtggcacgtgcctgtagtcccagatactcaggaggctgaggcaggagaatcactcgacctagaaggcggaggttgcagtaagccgagatcactccactgcactctagccttgtctgggcacggtggctcacacctgtaatcccagcactttggaggccaaggtgggcaaatcatgaggtcaggagttcaagaccagcctggccaacatggtgaaaccccatccctactaaaaatacaaaaaattagctgggcatagtggtgggcacctataatcgcagctactcgggaggctgaggcaggagaattgcttgaaccctggaagtggaggcagcagtgagctgagatcgcaccactgcactccagcccaggcaacagagtgagactctgtctccaaaaaaaaaaaaaagcaaaagtatgttgtaaagtttgattaaatttaattttggtattgtccagagagttactaaaatagtaaagtaggcttttattaaatatggatgttacctgttttatttaaagaaattttgaacatcttatacctgatgctcctgaactgatacatgattttctggtgaatgagaaggatgcaagttgcaaaaggaatgcatttatgatgctaattcatgcagatcaggtgaggtactttttaaaaaatactcttattactgtatttaagtgacaattgaaagtattacatagacttaatcatgtttttagtcagtaattttgtttatagttcatgtggtttgtgtattttgaaatttttaagcttgtagaaaaatacatttttttcttaacccttctctaaaatattgcatatgtatacattcttttttcaattaaacattgaagaggcattttagagcagccaccctacagtttttaaaaattaaaattattatgactgttctttcctatgatggtatagatctaaaattgtttagtagagaaaaatagtagctttgcatagatacatccttagccatgcctgtggaaatagggtggccttcagtgtagaggtgtatccttttaggttcttcaactttcatacacgggtgccaactccacatcctgctctgctggtggttaaagtacatggatctacttttggttagcaattactctgtacaccttgatgccatctaatcttgaaattttctagccagtatttatcaccaaaatatgggaaataatatgcatgaagtctgaaaaatatggaggccttccagtcctctgaaatctagacactgtgacttttttcccccagatcttcctttaatggattgtcccccagttatttaaaattgtggtaacatacacataacaaaaaaatttaccctcttaaccatttttaagtgttcaatgattttaaatacatttataatgtagaaccatcactatcttccatcctcataactttttttgtcttgcaaaactgaaactctgtacccattaaaaaatagctccttattaccacttcctcccagtccctggcagccaccattctacttgctgtctctgtgattttgactaagtattccggataagtggaatcatacagtatttgtccttttgtgactggcttattttacttagcctaatgtcttcaaggttcatttatgttgcggcatgtgttggaatttctttcctttttaaggctaaataataccccattgtaaatatatgctacattgtgtttacctgttcatccattggtggacacttgggttgcttcaatcttttagctattaggaataatgctattgtgaacgtagatgtacacgtatctgtttgagactttgctttctgttattttgggtatacacccagaagtggatttactgaatatacagcaattctgtttttaattattttaggaagtgccatactgttttgcacagcagctctaccattttacattctcactagtagtgcacaagggttccattttctccacatccatgccaacacttgttgctattgtttttttgatagtagcaatgttaatgggcacgtgaagtggtattcaatattgtcattttgtcttcctaaacaagattatgagaaagctgcgtatatgagcagtgttttgtcctcttgtgtaattggttttactgaccaatgcttttggcattatgctgttaacctacattgaggggcgtaatcagaaatagtccaataaaatttattgatacttttactggagagatgttttcagcattgtagttctgtatattacagtgtccaatatatgaggacacataggagatttttcttttaggtctcagtaataggaataactatacacctaagcagctggttttgattgtatggataccctgaatcccataacacatagtgttttccctctttggtttagctgctagaaaatcagaccccaggtttgtggctcatttccagaaaatatatttaactttatgtcttatattttatatgttaattttattcttgatttttttcccagttaatttctctttgccctgatctcctcatttgttttatattgagttgtaatgtgtgtattttttaagatgcattaagtccttctattgaatgaggtggagaatgataaatatattcttattttttttaggatcgagctttggattacttaagtacttgcattgatcaagttcaaacatttggagacattctgcagctggttattgttgaactgatttataaggtaagaatgataatctatgatgagtaaaataaactcagcagtttaagacagggttaaatactttctttctgggataattattgctaggataatatattttaatagtataaatattttatagcatagcctattaaagcctttgtttcttttacttttggtttattgtattttccaagtagaatacttgcttatatcctttctaaacctccataaagattttgataaaaattcatggcttgagccagtgtagctgcacataaatcattgtgaacttcccagtcactgaatagattataattaggctttaaaataaaattcaagattttcttgagcatacatcagactaaaatcaaacaaaaaagccttaaatactttttatgttccctgtttgtaaaagagaatagaaaaactttaaatgcattaatatgacattgtaggccattgacaggaaatctaaaaccagctaagaattttggatttttaaatcaaatactatattggcaacactttactatgatatatcctttgaaagagttggttacatcttaatgttctgataaaaggtacaagaagatccaactttgctattgataccattagaggccaacaaaacataggtccagatggctttattaaatatgatagtatggtcaaaacaccggtagacattactaactgattatagctgtcttgcttctgtaagaaaggggctcctcttaacacaaggtaccagtagtttggaatgggaatttaagatgaaaccaagacttactgtacagtttttttttgttttttttttgttgttttttgttttttttgggcagagtctcactctattgcccaggctggagtgcagtggtgcgatcgcggctcactgctgcctctacctcctgggctcaagcgattctcctgcctcagcctcctgagtagctgggattacaggtgcacgccaccgtatccagctaatttttgtatttttagtagagacggggtttcaccatgttggccaggctggtcccaaactcctgacctcgtgatctgcccaccttggcctcccaaagcgctgagattacaggcgtgagccaccatgtccagcctatagttctttttaattcatgtgtatagtttaggataccactgaggttctcaaaattagcggttccctgctatctaatgacttaagtagggtccatgttatagtaaaaggaaataacttttaagtcatgtccatgtaatagagttttgactatatatattttaggaaaatctactacaaatactgacttcaaaagagaaaaaataagggatatttactatacaagtaaaggtatcaggatacatttagaatgggatagaaatttttagttttctctccaatgttgaatatagtctcaaataataagtagtagtacttgggaaaaatgtgttatctttcttgcttgaaaaactggtattttccttttattagctattgagatttatatcatccgtcatgtttccctttggcatccagaataaacatttaggaccaaatttaatatcctgtgacagtacccatattagtgtactgggttaatgtgtccttacttttgttactttacattttctttttctctttcacttgtgtatagcatacacattttaagtcatcagaaaaccttttacgaaacagtaaaaatataaattatgatgggatgaataaataagtgcacagctgtaaaaattattttgttcacaccatcctatctagtaaagccatttcttatctatgtttttgttggcctctaacttgcttctttctgaaattactgatgttgtgtcatagtgtctcatcccattttgtctgatattttcatgtcctcataagactgttcttagctttcatattgagaaaactagcatcccataagctgacattcatgaaaaaactccatttgaaaacaagcgttcctgaaatcggttgaaatgttaatgttttcttctccaggtctgtcatgctaatccatcagaaagagctcgttttattcgctgcatctataacttattacagtcatccagccctgctgtaaaatatgaagctgctgggacattagtgacactctctagtgcaccaactgcaatcaaggtactgtgtatttcttttggggccagattagatgatagattttctgtcttagcactcatgatttagtgacatttcaattcactatgtggttacatggcacagagagaataactacaaacttataaaattatttgatgccttacattgttcagccttccttcttttcttccttcctgctttcatacacacatatatagatacagacagagaatgacagtacagttaacctctgacaacacaggttcgaactgcgcaggtccacttatacatggactttttttctacctctgctactcctgagacagcaagactaatccctcttcctcttcctcctcctcctcctcagcctactcagtgtaaagaggttggggatgaagacctttatgatgatctacttcctcttaatgagtagtaaatattttccttatgcttttcttaacattttcttttttctagcttacttgataagaatacattatataatacatttaacatacaaaatatgggttgttttgttttgttttgagacaaggtattgctttgtcacccaggctggagtgaggcaatcttggctcactgcatcctccacctcctgggtttaagcaattctcctgcctcagcttcccgagtagctgggattacaggtgcccaccgctatgcccagctaattttttgtgtttttagtagagatggagtttcaccatgttggccaggctggtcttgaactcctgacctcaagtgatccgctaacctcggcttcccaaaatgctgggattacaggcgtaagccaccgcgcctggccacaaaacatgttttaatcaactgtgtcattggtaaggcttctggccaacagtaggttattagtagttaagtttttggggagtcaaaagttacgtgcgtggctgggcacagaggctaacacctaaaatcccagcattttgggaggccaagctgggaggattgcttaaaaccaggagtttgagaccagcctgggcaacaaagagagactctatctgtacagaaccttttttttttaattagctggtgctaggtgtggtggtgcatgcctggagtcccagtactttgggaggccaaggtgggatgatcgtttgaggccaggagttcgaggttgcagtgagctatcgtggtgccactgtactccagccaaggcaacagagaaagacaaaaaataatatgaattagctgggcatggtggtgtgtgcttatagtcccagctattctgaaggctgaggcatgaggatagcttgagcccaggagttcaagactgcagttagctatcattactccagcctaggtgaaacagtgagaccctgtctctaagaaaataaaaattaaaagaaaaatgttacatgtagattttaagttttagtgagtgttttcaataatagagtatttacctttctccctttctctaatttattctatcaagactatatcatcagcccctaatctattcagagaatgagctgttctaaaagccaaattgtttaaattggagaatttactgctttacccaaaacttgaactttttttaatttttgattttgaaataattttaaacttacagaaaaattgcatagtacaaagttcttttctgttgttgtttttttgttttgtttttgttttttgagacggagtctcactccgtcgctcaggttggaagatactggtgggatcttggctcactgcaacctccgcctcccagattcaagtgattctcctgcctcagcctcctgagtagctgggactacaggcgcatgccaccacacccagctaatttttgtattttcggtagagacagggtttcaccatgttggccagaatggtctcgatctcctgaccttgtgatccacccgcctcgacctcccaaagtgctgggattataggcatgagccaccatgcccgatgaggacaacattcttatatattcttcacccagcctttctcatatgttcacattttctataatcatataattgtcaaaactacaaaattaacatcagaacaatattattaaccaaactacaggctttattcatatttcatcagttttcccactgacgtcctttttttgttcaggatctaacctaggatcccatattgtatgcagtggtcatatcgtagtctcctccaatctgtgctagttcttagtcacttattatttttcatgaccttgacgcatttgaagaatactggctggtttgtttgtaaaatatcccgtaacttgggtttgtctgatgttttctcagattgaggttgtacatttttggaaagaataccacagaagtgatgtgtccttcttagtgtatcttaccaaggagtacatgatgtctgtatgtcttattactgatgatgttaaccttgatcagtgaaggtgctgtctgccagatcttccagttttatgatttcttctagtgtaatcagtacatgttgtagggggagatactttgaaactatgcaaatatgttgttcctcaaattcacacctacttattttagcatccatcagtggattttcttacaattattgctttggtattctaatggtggttttctatttctctcattcagtatttatttattggaattcttatgcaaggaagggctgttctttctcttccctccctcccttcttttccttccttctttctttgtatcagtatggacattttattctatcattctaaaatactttacacattttttgtcttattaatagttattataaatactaaaatattttaacaactctgggtgatctttatattcttgttgtttgtgtactgcaatgcagatgagttagactttgcctctaaactgaaatatgcttaatcgatgtacttcttgggattcttttcctgcatttttctggcttgttccttagttttaacccttaaattttggctgttagtaagtatgtctacctatagcagctttttttcatccttttaatttgtaatgcctctaatcttctgtaagtttgaaaaataacaagggactagaggaacccattcctcagaacaaaatgtataatatataaactctagtacagggattaattaatgagtgtattttggcttcatgggagtgtgtgtgtgtgtgtgtgtgtgtgtgtgtggtgtgcgcgcgcatgcttattttcaaattttatgatagatgaataacttcttaaaatgtatttctttttttatataggctgctgctcagtgttacattgatttaattattaaggagagcgacaacaatgtaaaactcatagttttggatcgcttgatagaattaaaagagcatcctgctcatgaacgagtactacaggtaagtgttatctgaaaaagagagatcctaaataaaatgtttttcaaatttaggtcattctcaagctttgcccatcttggttaacctaaatgcttggaaactgagcagtttatattttgatcagctaaagtgttaactattgagtcatcatagccttttggggtattatctttaccacaaaaaatatttctaaaatggctggacgcggtggctcacgcctgtaatcccagcactttgggaggcagaggcgggcacatcatctgaggtcaggagtttgagaccagcctggccaacatggtaaaaccctgtctatactaaaaataacaaaaattagctgggtgtggtgaagtgcgcctgtaatcccaactacttgggaggctgaggcaggagaatcacttgaacccaggaggcagaggttgcagtgagctgagatcgtgccactgcactccagcctgggcaacagagtgagactctgtctcaaaaaaaaaaaatgtttttctaaagtgaatcagtattatatttttttatcttttcggtttgtactgtattgactattcttagcgacagtgacatactcattttaatttgaatataatttacatttcgtggaaaattattataccaattgagaataaaaggtgatctgattctagaaaattatcaccatatttgtttaatccatgagaataataatggttataaaaataaaaccccatggcaggtaaatgcagtgctgatcttggatcagaacaacagcaacaacaaatttctatgaaggacattattgggacagattgagaaatatgaatatggtgtgtatattagttaatagtattgatcagtgttaaattctctgataattataatgtggttatataagaaattatccttacccttgagagagatacactaaaattatcagcagtaaagagcaaatgtgggccaggtgtggtggctcatgcctaaaatcgcagcactttgggaggctgaggcaggtggatcacctgaggtcaggagttcgagaccaccctgacaaatatggtgaaaccctccctgtctccattaaaatacaaaaattagctggacatggtggtgtgcaactgtagtcccagctactcaggaggctgagacaggagaattgcttgaacccaggaggcagaggttgcagtgagccaagatcttgccactgcactccagcctgggtgacagagcaagactccatctcaaaaaaaagaaaagagcaaatgtgggaagatattaactggtgaatgtaggtgaaggatatacaggagttcactcttagaacttttttatcagtttcgaattgtttttaagtgtgcatcttttaaatgttacattttcctatggagtcaaataatatcacatttaacgaaattgttaataatttatgaatgttatctaataccaagtctatatgtagattttcccagttatcccaaaagccctttttgtttagtttgcccattttgtgaccatgtatcgtatttggtggttatgccctttcagtctcttaattttggacagtatcttttttttatgacactgatttgttgaagagaccagaccagtaatactataaaatgcccctctttctggatgtgtatggctactttcttacgttgtttagcttgttctttgacttctgttactttctataaactgtaagttggagctttagctttagcttgacagagtcaaagtaaacattatcagtttgaatgtgtcatgtgctattatttcatattgcagtgtatcaggagacccaaactatctagttcttccaccactagtggttttgttattgattaaagaattaaagtgatgatagataaaccccaccattctgcagtgaagatttttttcctgtgaccagaaagattggtgttaattcttgattttttcttcttttttaggatctggttatggatatcctaagagtattgagcacaccagacttagaagtacgaaagaaaactctgcagttagcactggatcttgtctcttctagaaatgttgaagaggtaaaaggaaactctgacagcactttgtagctatcaggcccaaatatgatgtaactctcacttatttttacttcattctataagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtggtatgtaattctgatgactttaattttgaaattatctaaaagaattttttaaaaaatatagttatttgacaaactccagaaatctcagctgcctagaaccattaaatctcatggtgagaagtgatctttatatctacctctacctttaaactcagaagggtgaggactgacttctttcacttatatattcatcaaaaaaacaaaaacagtgaccaaaaaaaagctttgcatattattttaattgatgatacagttacctaaagtaaaattatgctgtgtatatatattattcagtaaggcaaataggtatttattttaaatagctttagctcttaaaggaatcagttataggaaaaattcacatatgtagaatattttgctgtcactgtcagataagtgaggtatgttattataatttgatttttgcctttgagctcttgagttctctctaaaatgattttagttacaatttaggaggatcgaattcatttatttatttggagttttggatctctagcttatcttttatagtgaattttaaaataaattttgctgcacataaaatggaaaagccattgtgactttgtttacataatagtacttgtctctcaatttacattttgttgtgtatttgaaaattattaagaattacaagggtcaggcatggcacttcatgtctgtaattcgagcactttgggagggctaggcaagaggattacttgaggccagggattcaagaccagccagggcaatatagggagaccctgtctctacaaaaaaattaatattagctaggcatagtgtcatgcctgaagtcctagctcctggggaggctgaggctgccagaggatcacttgagcccaagagttcaaggctgcagtgagctatgattgtgccactattctctagcctgggcagcaaagcaagaccctgtctcttagaaaacaaaaaaagaattacattcttttaatttatttcttgtcctagataattttcttttcgaaaattgttagttccattttcttttttttttttttcttttagttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagtaggtttaaaatacatttaaatgtaaggtcaagtaagcattttatcagtttttatctttaaagggtcagttgatagaaaatagaatggagaggacaatcaagccaaaataagacaagtttgtacaacaagcatctcgctaactccactctcatttagtctataataaatggcccaaaataatttttttaggagtgatttagctcagggtctctattctgattttctctaaaacattgtgaatcttaaagtaactaaagagcatatttttaaatggcatcactttttggctattactattatttatatcttcctttcacatttaatgaagagaaagattgaaaatgcaacctaaatctgtctttcccttcagagagcctttgctaatgagaaaggactgttgcatctaaattttgcttcatttaaagcatctgatggatagtctctaacagacttgaaatatgtctcaggaaggaagggacaagtacaaaattgtttttatgatatgaaaatatattaatatttatggaagtgagcagagcaggatttgcttcctttgtgagaagaaaatcatattaaggatttgctttttttttttttttttttttttttgtgagagggctttccggcaaaaaccagaaagcctgctaaacaaattttaaaagagctatgacattaagaatttgtttttgacagccataatctcttagagctttggtttctataattaagtttttctgaataaatttaattaaaatcttaggggaaagatgactaaggactttattcagtttaacattttaaactaaagaattgttggctgggtatggtggctcacacttgtattcccagcactttgggaggccaaggcaggagaattgctggatgtcaggagttggagaccagcctgggcaacatggtgagactttgtctctatttatttttttaatctaaatgaatgaatgaatggttgctttctttactattatttttttactgatcccttgtacttcttctgtatccattgttcagttcaacaccttgcctcttcagtgactgaaaataaaaagtgaattactttttacattaaaataatacattcctgattttttgtttttgtttttgttttgtttttactttatttatttatttttttaagagagatgagggccttgctttgttgcccaggctggtctcgaactcctggactaaagcaatcctcccacctcatcctccccagatgctgagattacaggtgtgagccacagtgtctggccataaaataatacatttcttagagtagtaagagattaagccaaatttgccttcactgtgtcctaaatggacactttactgggaaacattttggtattttatttttactgctaggtttaccagttttagaatgttcctaataataagaacagttattttacttttaatctttgtgatttctggagagaactgaaacctaggttttgttagattctttctgaaatatttatctaaaatactttagaactgcagaatcttgttggtttttgttttttgtttttttgttattgagacagaagcttgctctgtcacccaggctggagtgcagtggcgctatctcagggcattgcaacctccgcctcctggattcaggcagttctttttttttttttttttttgagatggagtcttgctctgtctcacaggctagagtgcagtggcgcgatctcggctcactgcaaccgccgcctctcatgttcaagcgattctccagcctcagcctcccaagtatctggactacaggtgcgtgccactgcatccagcaaattttttttgtattttcagtagagacgaggtttcaccatgtttgtgaggctggtcttgaactcccaacctcaggtgatccgcccgcctcagcctctcaaagtgctgggattacaggcgtgagccactgtgcccggcctcaaggagctcttatgcctcagtttcctcaatagctgggattacagatgtgcatcaccatgcctggctgatttttgtatttttagtagagatggggtttcaccatgttgcccaggctggttttgagctcctgggctcaagtgatccgctggcctcagcctccgaatgtgctaggattacaggcgtgagccaccgtgcctggcccttgttttttttttttttttgagacggagtctcgctctgtcacccagcctggagtgcagtggcgcgatcttggctcactgcaagctccgcttcccgagaatgggttcccgccattctcctgcctcagcctcccgggtagctgggactacaggcgcccgccaccatgcccggctaatttttttgtatttttagtagagacgtgatttcaccatgttagccaggatggtctcgatctcctgacctcgtgatccgcccgcctcggcctcccaaagtgctgggattacaggcgtgagtgcctggcccttgtttttatttgagcttaaattaacaaagaaagatctctgcttcaagatttgtctgccaagttcatgtttcagatcttgtattgtgctaggatttaccgaggagcattatggatcctgggagaatactgtagtaccaaggaagacattcagagtgtgatgactgagatccgcaggtcccttggagaggtatgttttactttagtaaatgttagtttatatggtaatttttcctttaggaaaatctgactttttatagtgatttgcttacattatttacacttctgagttagattttgtttgaacaaaatgttctgtgtttattaaaaaaaaaaaaaaaaaaaagaagcagtagcttgtaaaattctgctttagcctgtattctgaaggaagaatgccttagagtaagtctgacttcagaatatttatgcagtaaaactgacagtattcttcatcctaacaaccttatggtagaatagaaagaacagtggactaattatcaggagacctgacaattagttctagtcattgttgtgtcgacagttagctggaggaccttgaatataagttcctcaacctaacttgacatcagtgtttttcacctataaaataaattaaaataggtaatgattaaatactcttagtgctcttatattaggtaatggactggtattgagtaataaatacataatagccattcagttaatttaaaagttagttgatgaggttattatgtacaaataagtcggatttatttcattttagaaggatgagtactgttttggttaaaatttcaaggaaaggaatgaagaagaggaatacgacttaatgaccatctgctttgtgttagacactgtccaatgcatttttctattaggtaaaatgtgtagaaagaattaagatttccacttagcagattaagaaactgaggtccaaagtagtaagtggcagagtgagaattcaaaccctggaatatccatctctgaagcccctattctacctactacattatcctgggaaggaaataaattgaaagcagagttcccagttccaaaaatcccattagggtaatgccttttttagagaaacaatcaaatatttaaagataattttgcttgctgttgatactattactaaaatgatgtttccaattgacttttagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacaggtaatttatggcacatataccctgccagctgtactacttttattattactcttgtatgtaagacagtcaaatgatttctttcctcttgcttttgcaaccaaaatgaaaatctttgccatttaaggtacttgagaagcggaggatgtttaagttcttccccctaggaattgtattgatggttttaattctctgtcccttccagtgtttttatggaaataactgttctgtttaaactcaaattatttttactcagaaaatgctaagtgggggtaactgaagatatttgagttttgttgtttattagcatctgaaaacattttgaagatttttcaatttctaaatgatggaataaaattgtgcatttttctattaagtaaattttaatggtgaagatggtgaaatctttgcctaaaattttactgaatacccactaagtgctaggcattgtgctaagtagtttgtctcatatagtcttgacaataagcctttgagatagaatatattatctccattttatggaagaagaatttgaggcttacccagtaaataaacaggtaagctggaattcggaggtacttcattagctgcaattacgtatgcccctaattaaatattgtatctttccatattctgatggcttttgtgtcattcaaagataagttttcttttttttttttttttttttttttttgacacagagtcttgctctgtcggccacgctagagtgcagtggcgcgatcatggctcactgcaacctgtctcctgggctcaagcagttctcctgcctcaatctcctgagtagctgggattacaggtttgtgccaccatgcccagctaatttttgtatttttagtagagacggggtttcaccatgttggccaggctgtcctcgaactcctgacctcaggtaatccgcccgccttggcctcccaaagtgctgggattacaggtgtgagccactgcacctggccaaagataagttttaaagtcatgtattatttttctttttccttctttcttctgggagctaaggagttagttagctaaggtatccttatcactgaaggatggtaataagagtgtttaataggcctatatcattcatttatacagaagctgcatgctgcttagcaagttggtgggtttgattttccttggttgctttgcagacctcccttgagaggattccttctggatggagatttctttgttgctgcctcccttgccacaactctgaccaagattgcattgcgctatgtagctttggttcaggagaagaaaaagcaaaatgtaagttcatttattttacatttaaccaacaattaaacattgagtgcctactatatgcattgaacagtgagggactcaaaaattaatgctaagtttctgtcatgaaagagtttatgatttaatagcagaagtggacacagtaatatattactctaaaattgataaagtatcttcctcttctgtttgggctttaaaaaaatgaaaattgacaaagtaatacaataacaatgtcatgtgattattccagtggaagagaaaggatttatgaagtcacctcagtttgctgggattagttcaggaccagtgaaggaaatgtccttctctccagcatctgcatccattcggtcattgtctgttttatcccagaatgtctcttaagttattctcatctgtagttcatgcctgctttgtagcttctgaccgttctaaccaaacacccatttacaatggtatgcagttggtcctccatattcacagcttctgcacctgcagattcaaccaactatggattgaaaatatcttttttaaaaaatgataaacagtaaaaaataatagaaagttgaaaacaatgcagtgtaacaattatttacatagcatttacaggcatacttcattttattgtactttgcacatattgcttttttttttttttttaaacaaatgaaggtttgtgggaaccctgagttgagcaagtctgttagcatcatttttccaaataagcatatgctcacttcatatctctgtgttacattttggtaattctcacaatatttcaaactttttcattattattacatctgttatggtgatctgttatcagtgatctttaatgttactatcatagttgttttgggatgccaggaaccattcccatataaaatagtaaacgtaatcaataattgttgtgtgtgttccggctgttaccccgtctctttcctccttgggcctccctattctattccctgagataccacaatattgaaattaggccggttaataatcctacagtggcttctaagtgaagggaagagtcacatgtctttcactttaaatcaaaagtgagaaataattaaacttagtaaggaatgcatgtcaaaagctgagctaagccaaaagctaggctgcttttgccaagtaggtagccaagttatgcatgcaaaggaaatgctcttaaaggaaattaaaagtgctactccagtaaacacatgaatgataagaaagtgaaacatttggcaggcgtggtgactcacaccagcactttgggaggcccgagacaggcggatcacgaggtcaggagttcgagaccagcctggccaacatggtgaaaccctgtctctactaaaaatacaaaaattagccaggtgtggtggcaggcgcctgtactcccagctacttgggaggctgaggcaggagaattgtttgaacatgggaggcagaggttgcagtgagctgacatcacaccactgcactccagcctgggagacagaacaagactccgtctcgaggaaaaaaaagaagaagaaagaaagcgaaatagctttattgctgatagaaagtttgagtggtctggatagaagataaaaccagccacaagattcccttaagccaaaagcctaatccagactaagaccttaactctcttcaattccatgaaggctgagagaggttaggaagcttcagaagaagagtttgaagctagcagaggttgattcatgaggtttaaggaaataagcccgtcttcataatgtaaaagtttgacatgaagtagcaagtcctaatggagaagctgtggcaagttatctggaagatctagccaagatcattggtgaaggtgaccacactaaacaacagattttcagtgtagactaaacaaccttatattggaagaagatgccatctaggactttggtagctagagagaagtcggtgcctggcttcaaagcttcaaaggataggctgactcttttggtaagggctaatacaaccagtaacttaagttgaagccattgctcatttcccattttgaaaatcctagggctcttaagaattgtgcttaatcaactctgtctgtgctctgtcagtggaacaacaaagcctggatgtcagcacatcctctttacgggatggcttactaagtattttaagctcaccattgagacctactgctcagaaataaaagactccttttaaaatattactgttcattgacaatttagctggtcacccaagagctctgatggagatgtagaaagaaatgaatgttttcatgcctgctaagacaacatccattatgctgccactgatcaagtagtttcaactcttattatttaagaaacagaatccatagaacatttgtggtagtagcgcagagttggttacaatgtcctaccacagcaatttctgacattcaaattgggcctgtagcaatgggactccttttgattccttcagctttcgtattatgttggttatctatacagcaggtttctaaattgaaacactttcactcacatcactcatatttccttcgtttttggagactaacagcttgatctaaaaaaaaatttttttttagacggagtctcactcttcttgcccaggccggagtgccatggcatgatctcagctcactgcaacctccgcctcctgggtttaagcaattctcctggctcagcctcccgagtagctggggctacaggcgcctgccaccacgcctgtctaattttttttgtatttttagtagagactggggtttcaccatgttgaccaggctggtctcgaactgctgacctcaggtgatccgcccacctcggcctcccaaagtgctgggattacaggcatgagccaccgtgcctggccaggttctttttgtttttgttttaattccattataagaaaagccataaatgagagccagataatttacaaggtatattatcccttaattgatttgatttttgagcaataatttattttgtaactcttttgtgggcatttatttattcaggtctggtcacagtataatctttaaagtatgttttttaaaagtctccaacatttttttatctcagagttgaatttgctttcctctcctggttgcatcacttctggaagttgggagtgtttactgatacctgcttaaaagagccagtttcttgtaacataccgagttaataatgtttgcactgtttggtacaagaaggaagtttggttgcttataatctcactggcactccttcatttatgccatttccaacactcttcatttctttgtgtaggactaagtttctggtatcatacatcttttgcctaaagaatttgctttaacttttcttatagtgcagatttgttggcaacagattgttccagtttttgtctggaaaaagcctatttttttgtacactttagaaagttacctttgtgggtataggattctaagtcttctgtttttttttcccagtagtgtaaaagtaaagctccattgtcttctggctttttggtgagaagtctactgtcattcttatctccctgggtgtagagagagagagagtgtgtgtgtgtgtgtgtgtgtgtgtgtgtgtgtgtgtgtgtgtgtatttcttccactggttttagattttctccttttcacttggtttcagtaatttgattaggatatgccttagtgtggttttcttcatgtttgctgtacttgtggttcattgagcttgttgggtttgcaggtttatatctccatcagtttgggaaattttcagtcatttcctcggatttttttttctgtcccctcctctctttcctctccttttggagacagtatccaaacttgggggacatatacttactcttctgctggtttttcccaggcctccagtagtttttcatgcatgtgtgcagatcagtactcagccaaaggcaatttggcaagggcttagagcatatgtgtcaggataatgctacatgagactaaaaaagtaagttgcaatcacttgtggaagactttgaatagcgagctaagtaatacggacttcagtatgaaggctgacattcattaaaggtatttacatagggaatgaaatgattggtgcagtataaagattaagatagcagcatcaggtgatcacgcttagcagcacaataattggacagcctaactttaggtaccttgtgatgcagtacagggtgaaatacaaaacatcacctatctggtattctaatcaaaagtgtgggatattctataaaacaactggcctcagttctttaaaaaagttagtgcgattaaaaacaaaacggcagagaactggtctagattaagagggataaaatgcatgaagctgatcctggatttaaaaaataaaacaaaaacattttaagacaatttagggagatttatttgaattcagagtatagaagctgtattttggaattgttgaatttttcagatgagaaaatgaaattgtggtttgtaggaaactgttctgactcttaggagatgaatgctgaagcatttatgaggtgaagactttttcacatgtcagccaaaaaaaataagtgtacatatacagaataggtaagcaaatgtggcaaaatgttaacaattggtaaagtatatcattcttttaacttttctgtagttgggattaaaaaggacagcatcagcatatgaagtggttacagagaaggactggagcaagggaaaacagttaaaaagcctctgctgtctctaattgaggattaatgcaggtcttagagagtggcagttaagagtagaaaggaaggagaagaatgcaaaaacagatatggacataaaatccaaagaatttgaaatcttattcaggtgaagtgaaaatttagattgtgagttataatgaagtgacatgattgcaatctgagaatcaagacaatatcagtaaccgatttctttactttcttagtcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaaggtaaggtatatatgatgaggcaacaaaagtgttttgtgtctcttcgtgcagtggctcacgcctgtaatcccagcactttgggaggctgaggcaggaggactccttggggccaggtgtttgagaccagtgtgggctacatagcaagcccctgtctcaacaaaaaaaatgagaaaattagccaggcatggtggtatgtgcctgtcattccagctacttggaaggctgaggatgaaggatcgtttgaatctaagagttcgaggctgcagtgagctgtgatcataccactgcactccgcctgggcaacagagtaacagcctgtctcaggaagaaaaaaaagaaaagaaaagtgctttgtgggttttcttgttgttttgttgatttttcagttttcatatgtgagggctgtctctgtcaaaagcctctaaaaaactatcttttcatattaaagagagactttgttatattctcaacacagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtaacaaaatgtctgatagactctaaattatttaaatcgactccttaaggaagttgttagtgctgctatttttaaaagaaagataactattttgtcaagtcactgtgataggtccattaaacctcagttgaaactcagaagctgatgaagtaccttactactatatgtgatagtactgtaagtccatcagatggtttaactcgatccagttgtgtctggaatcatagaccaataaatagaagttgagggaaggggatccttaaaggttagctgaggtttttaaagggaagctgaacaggcaacagccctggcctcttcccacaccttgacctcaccttctcttattctctgctactttaaacagagcagttctacttttatattcttaatatatcgagttccatatagaattttattaggaaaatgattctactctcttaaatatataaatttaagaatcagtgatccctcatctattagactgaatgaacagtcttacattacttttgtttaagataaggtcagtagcagaattggaattactaaaacaatttccctcccttaaaattgggaattgatatcaataatattacatttataaaatttttttagtttttttgaattatagttaaagttgcaaaagatttgccattttaacccatttgtaagtgtacagttctgtggcattaattaaattcatattgttatgcagccatctccaggactgttttcatcttgcaaagctgaaactatgtccattaaacaataactcgtcattcctacttcccctcaacctctacttacccctagccaccattctactttgtgtctctgtgattttgactattttaagtacctcacagaagtggaacaatacagtatttttccttttgtgactggcatatttcactcagtataatgtcttcaagattcattcatgtcatagcatgtatcagaatttcctgccttattaaggctgaataatattacattgtaagtatatgccacattttgtttatccatatatccatccctggatatgtgcattgcttctgccttttggttactgtgaagaatgctgctgttaacacagatgtacaaatatctgttcaagtccctgcttttagttcttttgggtatatatctagaagcagaattgctggatcatatgataattgtacttttaattttttgaggaacctccattgtgtttttcatggtagctacactattttacattcttaccagcagtgcacaagagttccaatttctccatatccttgccaacacttgttttgtttttttttgatgatagccatcttaatgggtatgtgaagtggtatctcattgtggttttgatttgcattttcctaatgattagtgatgatgagtgtcttttcacgtgcttattggccatttgtatattttctttggagaaatgtttgttcaagtcctgtgcctatttttaaattgggttgttggttttttttgtttgaattttaggagttattaatattctggatactaacccccttatcagatacatgatttgcaaatattttcttccattctgtgagttgccttttcattctgttgataatatttgatgcataaaagtgtttaattttgatgtttaatctattttttcttttattgcctatgcttttggtgacaatattagctttttaaagtacagtgctttcagtgtgtttaaatttggagtgggagggcatttgtaattttatttttgtggcattacaatcatttcttactatataatctgtttagtgcctcagtttgtggagcaagggctaccacatgatttggattttatttggatcctgagtttcatagatcaagtagtgagtttagatacttactgagggatttaaatgaaagtgtatccaaatttatttagttggcaaaattgggataatgtttaatgtatttgctaaatatatttaacatttttctactactgaacttataagctcaaaaatcaacatgtataataccttatactgagttattgagcttaaaaacaaatagatgtcttaaactctaggacctgttatttcttaatattctggtttcaatttccatttctgcattataaaacaattttattttacctatctcaaaatgacttctaagcaactctgttaataacctaccagacttaatcatttggccagggtatgtttggtgaaattgcatctgtcatttgattatgtctttgtttttgttttgacaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggtgaggaaacttaccattcaggaaagagattgtcacatagtagatctttatgacagattaagggaggtgcacaggtttcagtataaaaattctcttgaaccttttctgacattttgaatcaaggcttagtttttcatttatcatttagtttccttaaactccagttttctgaacctctgtcatactgaatttttatgctcttggcacattcaggtggattcatttaataagcttaatctagcaaatgtcagtatttctagttataatacgagctgtttaagtcgcagattgaccaggtagctcacttagttaatttctaattgcctcattacagaactaagtattttctgaatgcataactgttagataccacatgtgaccaaagtaataaatcatattacatttagcaatatgagatgcatttttttttcttagtaaagacacatgggtcagactgcttacttccacatctggttttgaagttggaaaatataaattgtatatgggaacagtgcagtacccccatcagatttcatatggcttatgcaagtgttaaggaacttcaagatatcaaggggaaaacatacttttgccctgttgtcctcagcatagcttgatggctgtataaaaaaccatgtttcttaagcatttacaagtctttatgcagattgttttatctttcttcataatgaagtatatagtttaagacttaagctttttgagaagtttgcattcattcattgaaataaaatgaccccaatctctacaaaaaatcaagaaaattagccaggtgtggtgggccactcctgtagtcccagcgactcaggaggctgaggtaggaggatcgcttgagcctggaagatcagggctgtagtgagctatgatcatgcagttgcactccagcctaggtaacaaagcaagaccctatctcaaaataaataaatggtaggctcaaagtatcctcccttcccacaaattaaatatggaattattctgagatgcctattaccttttaaaagaaaatatgcctattgatggtgaataataaggatggttaagtggtttctttattttgtcctcattatatttgattcatactcttctcatattcgtcatattccttattttcctagaaactattaagctgcatacatttaaggttttatggttagtgtgtgtgtgtgtgtgtgtgtgtgtgtgtgtgtgtgtgtgtgtgtgtatttttaaccatatccaaactctttctttcaggggatctgaaacttgtggaaaagccgtctcctttgactcttgctcctcatgacttcgcaaatattaaagctaacgtcaaagtagcatcaacagaaaatggaataatttttggtaatataggtaaggtgctgttttatggcatgtaatgtttgaatacttttactgaagaatttctatagtgagtagctggggacattgtatgaggagaggatctaaatccatttattcataatttatgagatactctctatggtaccacgcattgaactatgttctggatgtacagaaatgaaccagatagagtcactgtcctctagaaactgtcaggcaaaaggaggagctagctaaggcaatatataattgtagtccagtgtgttacaggttggtttatataccatatgctttgaggttagggaaaaaaaaaatgctaacagtgtggaaggctttataaaggaagatggtgtgttatcaaaggataatattttacctgagtcatttgttgctaggtgcacaagggtatctcagacctagggattagcttgtatagagtcattcagtcagtaagcttattttgttgcaatttctgtcataaggatagggctaccatggtgaggaacaaatgatagattatggttgagtaagggaaaacagatatataaaataaatatgtgcagtatgtaatggtaagtactgtgaaagaaaaaaataagtaaacctgtactaagtaaggtaggaatccataaagggatttggtcagttctcagagtggtgggggattgggagaaaagcttagaaaaggcttcatggaggagcaagtgctcagtagaagactacagatagacaaggatgcagttagaataaatgcaaatgatttgatacacttggagttcagaatgggttggaggatgatggcaggaaaaaaatgaagttaggaaggtttgtggaagccatattttacttgtcatgctaaggatgttagactttatctgtggagagaggaaacattgaggaattacaaatgaatgacttatagcattatatctttttgcgacagtactatagaaggttgattggaagaggcaggaagattaactagtagagaagcccaagtgagagatggcagaggacttgagccaacacagtagtggaatggagagaaggatgaatataatattaaggatatggttaatgattgaagaggaagtggctagagtaacactcagatttccagattaggtttattgggttgtttatgtcatcatcataacaggaaatacaggagagaagaacaaactttagagagacataataggttaaatcttgagcaggttcggtattaaagtgcctaaagatattcaaggacagtttgatgtgagtctgggacacaaacaagaggtctaaactagagataggccgggtgtggtggctcatacctgtaattccagcactttgggagaccgaggcgggcagattacctgagatcaggagttctcaagaccagcctggccaacatagcgaaatcctgtctctactaaaaatacaaaattaattgggcgtaatggcgcacgcctgtagtcccagctaactcgggaggctgaggcaggagaatagcttgaacccatgagacagaggttacagtgagccgagatcgcaccactgcgctccagcctagacaacagagtgagactctgtctcaaaaataaataaataagtaaaaataaactagagataagtatttgtttaaaagccataggaatagaagaaatcacccagagagggcatacagactaaaaagaggggagatttgaaaacagaatccaagcaaacagcaacactgaaagcttggtcaaaggagaaagagcctacaagggtatctgaagtgtggttagaaaagtaaggaaaaaccttcagaaagtatttgaagctccacaggataaaataactttagttattaaagtctgaaagagaggtcttttggatttggctattagtgattttaaaacatttcttgtgggacatcttgggtgttagtggtgggttgaagactaaatacgatatgaagaaatacaggtagtgtagactattctgagtgtaggatcttggctttgataggaataagaaggggcagtaccaagaagagaaggcaagaatgagtgaggatttattttttgaaaataagagaacctcgagtatatttatagaccataagggaagaaagttggtagagaatgggaaagtaaagacataaggatgaaagagatagtgattggagtggggtcctggaccaaagcaggaatcacagatggcaggaagtattaatcttgaagaaatgaggtagtacttctctgatacgtatgagagggaaggatgtgagagtgaattccaagagagagagttgtttttagatgtggagctgaaaattaaaggagcttattcttggtagcctcagttttccctgaaagttgaaagagtggaagaatgtcaagaaaagagcctagaggccgggcacagtggctcatgcctgtaatcccagcactttgggaggccaaggcgggtggatcatgaggtcaggagttcaagaccagcctggccaagatggtgaaaccacatctctactaaaaatacaaaaaattagccaggcgcggtggcaggcgcctgtggtcccagctactcaggaggctgaggaaggagaatcatttgaacccgaagggtggaggttgcagtgagctgagattgtgccactgcactccagcctgggtgacagagtgaaactccatctcaaaaaaaaaaaaaaaaagaaaagaaaagagcctagaaagaggaatgtaggctccaatcagattataactctctactgtggaagaaatggtcatagaagcaaatatagtcagccttctgtatccgtgggttccacatccatggattcaaccagccacaaactgaaaatattttagaaaaaaaaaaaaatggttgtgtctatactgaacatatatagacattttttccttgtcattatatcctaaacaatacagtataactatttacatagcatttatgttgtattaggtactgtaagtaagctagagatgatttaaaatatatgagaagatgtgtataggtaatgcaaatactatgccatttaatatcagggacttgagcatctgtagattttggtatccatagggggtcctggaagcaattccccattaatactgagggatgactaatcttgtatcattaagtagtatgggtcagcaatatttattcaaaagtattagttaagtacctcctatgggaacatcgtccacttgtatatctgctgcagtgcctagtatgctgcaactgctatgtaagtactcactgaattgaattatttgtttaaccacaaaaaacaaagtgtgcctgagttcgaatcctatccccaccacttatcagttgtgtgatctggaacaacttacttaacttctctgctttcatttcctcatatgtaagatggaaaataataatactatcagaattgatgggagtattaaaccagtaatatttataaagcatgtagaatagagctctgtacataataagtattatataaacaatcttattgttaatagtgtagttctttggatatttggatattaagattttttaaattcaagtttgccccagtgattgcgaatctttttgtatatgtaattgcagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagttagtccttgggagattttctcatattcctttatctttcttccttttgcctgctgttgaggagtctgctaataaaattaatctcgctaaaaagtgtttaacatgaaaagcaaatagtctttcagtatctgttcttgcaaattagccttaactaaaaatcatgtaagtagtttggtaatttgctgttataaattgattagagtagcagttctatagccaatctgataggtttagacattataggtaatattccatcccttctatgtatgaccaagagcttaccatttaatctagtgcccgaaaaaggctttacaaagttcatggtctgttgaggaactttgtccctttgagccttgacttttattagaaatattctatatgaggctgggcacggtagctcgtgcctgtaatcccagcactttgggaggctgaggcaggcagattgctcgtgctcaggagttctagaccagcctgagcaaaatggtgaaactccatctctacaaaaaatacaaaaattagcccggtgtggtagtcccagctactccggagactgaggtgggaggatcacttgaacatgggaggttgaggctgcagtgagctgaaatgacgcactgcactctagcctgggtgacagagtgagaccctgtctcaaaaaaaaaaagaaatattctatatgcttcatattgaatctctgtgaagttatctctattgggaagtactgataccaacctacagcttgttggattttatagatgttatttagtttcttggtgtctactctttccaacctaaacagttggaacaagtttttaatatgacatactggtgattcacagctttctcatagtaagatttatgatctccttgacttttttttcctctctacaggtgacagttaacaccaacatggttgatttaaatgactacttacagcacatattaaagtcaaccaatatgaaatgcctgactccagaaaaggtaaaatttgactaggaaattcagaaatctgatggaatggtagagtaggttcctggccttcctgtatttcctctagcacatttttgttattcaatatgcagtaccattctaggctatctaaaagatgttatcccatagaatgttggaatctgcttacctctttctattggactataccatcctactttttcctagtgcagtgacccaactgaatagtcagattaattttttttttattttcttttcaatcttctcccccattcagctagaggcacattctaaagtagtttatgctgcacatggtggttcattcctgtgatcctagcactttgagaggctgaggcgggcagatcacttgaggtcaggagtttgagaccagcctggccaatatggcgaaaccccatctctactaaaaatacaaaaattacccaggtgtggtggcacgtgcctgtaatcccagctacttgggaggttgaggcaggagaatcacctgaaccccagggggtggaggttgcagtgagccgagatcacaccactgcattccagcgtgggtgacagagtgaaactctgtctcaaaaagataaataaaatcgtttatttgtaatactggattagaaaatgtccatgagctcttccgtgggctctgattgttggttaaaatatatgtgctcaaatacagaatcgttgttatactgtgactttttgctatgtttgtgtatgtatgaaaaaaacgagagagaaagaaaaatgaagctggagctctaaggaacttttttctttatgtaaaatttctataatgttataatattcattttataaataaaataatgtctgctaccaaacaagtaggttttaatttatatattagtttattcagcatatactgagtccaacaaaagtagtctcttccttcatggcgcttaaggtctgatatgggaggcagtcaagcaagttaagtaaacagaatatataaatacaaatcggattaagaactatttatttaacatcagatttattgaggtataatacacagtaaaattcacactttttacatgtatagttgagttttgacaaactcataagattatgtaaccaccaccctgtatgtaagtactgttttaagtgataaataaccaatggggctgggcgtggtggctcacacctgcagtcccagcattttgggaggccgaggcgggtggatcacttgaggtcaggagttcaagaccagcctggccaacatggtgaaaccctgtctctactaaaattacaaaaattagccaggtgtggtggcgaatgcctgtaatcccagctacttgggaggctgaggcaggagaatcgcctgaacctgggaggaaggttgcagtgagccgagatcacgccactgcactccagctccaagctggacaacagagtgagactctgtctcaaaaaaaaaaaaaaaaaagtcacctatgctgtttggtttttgcctctatgtaggtatctggtaaagtaatgaatttatcacaaattttttccaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccaggtaacagttcctttttttttgagagtatctctggactgacaaaggggggaggaatttatgactttattatttctatatgtagtatctttttagcattagatgcatatacacatacaataataatatactctgaatagaagtataacttttctcattaaaatttctcaccttttgggcccctcattctgggatatttgcctaaaaccagattgattcctatggggtgtttgtgaaatgggttctctagaattttttgaaagccaaggtgtaaatctagtgactaattagctgggtgttgtagcgcacacccggtaatcccagctactcgggaggctgaggcaggagaattgcttgaacccgggaggtggaggttgcagtgagctgagattgtgccatttcactccaacctgggtgacagaatgagacttcgtctcaaaaaaaaaaaaaaaaaaaaaaatctggtgacggcttgaaaaatctagcactgaaaggtaattaccagtaaagtttggtaagtctgtttggtatgtccttgattttattgttgataatggtgtcattgaattgaattggggcttaataatatggaataacctactgattgtacatagtttaaataattataaatatcttaatttttctttacagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttat

SEQ ID NO: 35845 - DNA, 42346 bp, Homo sapiens; identical to SEQ ID NO: 35844

SEQ ID NO: 35846 - DNA, 9237 bp, Homo sapiens
ggcgcgggtttggtggcgcgtttcagcgaagtcgcacgtgaaggatagcagtggcctgagaaaggtgagagcgggccgaggtcggaatgtggggcagcgcacgggaaggggagacagcagccgctgcaggcggcaccaggcggagccgcgaggcctggagagtccgagtggggaggggtccgcgcgcccagcgtgcgaaacaaaccggggacccggatccccgttgctatgcaaccgggggcgtcgtttccaggcaacccgggaggcgcacgtttccggggagaagagggttgcggcgaggttccgaggtccggcagaggtggagcggctcccgggcgtggggaccaggccagcgccaagcccgagcccccgaaccccgacccacggcccagcctcctgcagcctcggctcgagcccttcggggggccccaaactcatgggtcgcgccacgttccttgccagcgacgctacccctcagcgcttggcaggggacgcgccgttcgaaatagcacatgccactgacaccctgtctccgggaggctgcgccccggttagggcgcggagcggcagggaagctgcccctttgccgtcgccctgcccccaaacagttgctgggcagcagctgtcaggggtttagtgggagctgcccccaacctgccagggcgctgacttcattctctgcagtggcggcttcgccttgtttaggaccttcctttagactcagctgtgcttctcgtgtggctgctgtatatttggatctactattaaaataacctccctcctcacctctccatggctttctcgttcgaccctcacggtttcttggcaggttgctaatattcatttaataaacatttattagtcatctttcctactaggcgctggggattccaacatgtcaagtctaaccgggagtcgctcggtctactggggaaggcaggttgataaactgctaaattatgctacgatatatagtcagtggtaatgtgtgtgctgcaacatttctatagatgtttagtttacaaagcgcttgctgcagaaatatcttaactccttacagcaactcttcacctgggttcactcccttttacgtttgaggagactgcaactcaggcaggttaagtaacaggcgtaaggtagtagcttctagtccgtggcacacttgagcctgggacggaagtcaggggtcctttgtacactgctgcacttttgaagctttgcttagacttttccctgagctgctggctatgcatccgaaattcctgaggagctttgcaaaacaaagggctgagtccctctctggaagagtctgagtgagtagccctgggtggggcagacgtccttgtttaacaggctgcacaggcagttccgatgggcagccaaagttgagaaccgccgctccttaggggcagctatgagcagcggcgggacagtcagagccggtagagggcactttttgccgcccctcctgccacctggtgattcatagcatgaaatgaaactaacaaaaggaaagagaagaggaggaaggagccttgattgggaggggggggcgcgaaatgccccatcctacccttgtagcaaaccacagctaaacataagcagtggcgccttctcactaacacaataagtaaagctgtttccccagccaggctgggctctccagacccacctgagccatattgcagctgccgaacagaagtggcaggttttgtctcccaccttttgctgtcctctcatacctcttggtacaaaaccatggcctgtaagcccagaaggcagatggtctcctggtatgtgttccctcggaggagtctggatgtccttccactttgagcttgttggtgaacttcagctccatgagggcagggactatgtccactatcaaggcagcatgcgggtatgggacaagcaaaaaggcaagattgagatcctgggtactggagtcaagtcccagctctgctgtgtgatcttggataagtcactcaacctctctaagccatacttttctgagtaagatgaagagggtaataataccttaaaagattgttgttagagttaaatgaagtgatgaaacaataagcactctgtgaattataaagcaccacacaaaaattattataacatatgtatatgtatagatatgtataacatttgtattattatgagttgttaattgagtgcctattatttgtctgaggccaggcattgcagaaggtgaagaagttttaagacatgcttcctcctctcagaggctgagactgtttccatgcctttagtaaaactatttgattaggccaaagtgaggaggcctaatagcagtgagtccatactgcctgagattcacctggaaaaaaatgagaaggaatcctattaaagaaaacaatttgaaaaagcagaccagccagccaatctctgcactcattatctccaaaggatacactacacaatcctgttaggtttggtatctggtgcacttcagaacatcagtctgcataacgatgccagcctcactgcagagggcttatttcaaggtctcctagctccccttaactggggcagacagccactggagagttggggctggcacagaacaaggcaggctgctgtgggaggagcagcttatggcaccctgacctcctagggctgaggaaacgatatttgatccctcctggtggaggtccttggataaaggatccaacccaagatagcaaccctgctcttttaagtccccaacatggttatgacccagatagctcaggaactcacctgtgctttcctcatctgcgaccactggcaggcaggaaccatctggttcttgatttgtgccaaagacagtagaaggctttcccagcctgagggccttctacatgaattgcatgtttttcagccttgcttgaccctccaggcttctggaagggcttagagcagctgtttctggaccaaaaagtaccctaaatgtagtatttttagaaccctttcctagactctcctccttccccctaagcaagactaggacatcattctcttccttctccatccctcatggctctggatttattgtcaactccctgagtgcctgtgtaactgcaaaaagttcaaaaacctgactgctcctacctcaggggcatggcttagcctctgatcatcaggtctgaatcatgaaaactcctggagctacaggttcatttctgaacctggaggggaacagggaatttgctggcgctgtctgacatttctcaagcacagtggcaagtagaagttgaacttgtgtactttttcttggctgatccttacctgcttcaatgagttggcacttgttgggtcttaacttgtctgtggcattgtgttacaagaccagagcacaaagcacaaagttgttaggtaattttcaccagtaattcactgagatgattggtagatgccaagtttattttaactcatgaataatctgttgtgtgacttttttttttaagcgtcttgctctcttgcccaggatgggatacagtggcatgatcatagctcactgcagccgtgacctcctgggctcaagtgatcctcccccctcagcctcccaaatagctgggagtacaggcacgcaccaccacacctgactaatttatttatttatatttattttgtagagacagggtctcctatgttgcccaggctgctcccaaactcctgggctcaagcaatcctcccacctcagcctcccaaagtgttgggattacaggaatgagccactgtgcctggcctgtatgactttctaaatcacttctgagacttagttggagacaatacagcagagttgttgtgtatgaggggtccaatgtcagaagtacctacattcaaatgctgatttccccagttaatacttaacctgcctcaattacttcagtaaaatgggggataatagcaacacctacccgatgggctgttgtgacagttaaatgagcgcggtggtgcatggcaagacctagctgaatgttagctttttattaatagtatttctttaaaggttgttcattatacccttgctcactgtcctcgtccattttctgcttcctataacagaatgccactgcctgcgtagtttataatgaacagaaattcattagggtcacagttccagaggctgggaagtctaagggcatggcgctggcatctggcaagggtcatcctatggcagaaggcagaacccagcacatgagacagagacaggaaatcaggccaaagtcatcctttttatcaggagctgcattcctgggataactaatccactcccaagataacggcattaatccattcatgagggctgaaccctcataacctaatcacctcttaaaggtcccaccttttaataccatcatcatggcaattaaatttctttcttttttttttttttttggtggagaaggggtcaaactattttactgaggggaatggggtgtcaaagaagtacttaggaccatgagatccaacatccttggctggactgggagctcccaggctctgcaggaggtgcaagaacagttaaatttcaacatgagttttgctcttcaaaccatagcacctccattgggggtggggaggtgaggtcactctgtatcagtggttctcaacttcatgcagtggaactgcctagggagcttttgcagatccaaggctaggccacacccagacaatgatatcagaacctctgggctggggacacagacatcagtacttgggaagcttccaggtgattccagtgagcagccatggttgagacccacagtataacttgactcctaatgaagatgggtggaagcagaagcttgggttcaaatcctggcctttctgtgtagcccagtgaccatgggaaaatgcttaacttctgagtcacagtttcttctcgtctgtaccagtaggggcgaggaggataaaagccacctcacatgatggtcctgcagagaagatgacatatgtgcagttattcttgtttgagcacataactgagcacttttctttataccattatatggcagtaatcctacttgtgtgctatttttaagttgttttttataccagctgtatcttaagtagattataagctccttgggacagagcctttatagagtcttataatacttttatgcctatagcacctaagatacagggacaggccttcagatttttagaactggcacaaaccttagagagatcttctcgccaactctaaagtgttgaataatacttgctggttaattaatatgcaagtggtaaagaatgtgaaagaggaacctgtgagtcagatggttgtgcccagcttcagttggaagtcccagtccttcctctcccagctaacagcactttctttccagggttagtttggtgcttgcttggggtaggggtggagaaggatgttgggataatcagagctgagagggtgagtgtgtctaccatggcactcagctcactgtgcttctctcctggcagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagaggtaaggaaggtagtccctgtgtgactacacacattaaggaaaaataaaagaagaaaggttggtaatggccacctcatcttagttccacatcctctctggtgcagagagccccaaattccacaaaaagaagccacacagcacttgtctttgaattcctcgttatttgattgctgtcctagggccttttagctccacccctatcctttcctggctcctgccctttccttgccagaaaggctgggaaatgagccatctttataagcccatgttactgggtgactgtagagtctcactttggtctaaatctgacctagaatctcgaaatggcaaaatatcaagtcctgaatccattccttcacctgcagaagtgggttgagcttattgggagcctaaggcagggttatctttttttacctggtggcatcccaagcatggtatcacatacttttgataggctggactgaagggctgagacaatcatttattaaatccataatatagtatagctgatagactcctttttcactggaacatcctatccctttacagatgttctccacgcaccttcatgactccctggacagctagcaggcctccagttttatagggtgactactaaaagtatttgattgtctccgtcattcacacacaagtacacctactactccctccaaagtatcccagcaaagcagttaaattatgtcccagatgccctagtttccagttcaggaaggagagacagcctgttggccatccctgtagactagaaggtggatgtggaagggacccctcagccaggcccaaggcccctaccctctgacccaggcctgtcaccactgggtgagaaacaggtctgagacattcctgcagttcttgcctggacagtggtgatcaggcgtgaaggcgaggaccgttgttcattatgaactcatctcgctccgtgctctttccacagtcttcgtcccaagtgttgtgggccatctcatcagccatttctgtggccttctttgctctgtctgggatcgccgcacagctgctgaatgccttgggactagctggtgagtgttcgagtgctgggtagtcagccagagctttgcctgtactttcctacttgtgggagttcatctttgtcagggtctagccttttccccaagctgcttaacccttcccaggattctgcagagacatggccaaagagcaagccaagaactaccatggccaggtgtggtggctcccgcctgtaatcccagcactttgggaggtcaaggcaggagggtcacttgaggccagaagtttgagaccagcctgggcaatataatgagacctcgtctctataaaaaattagccaagcatggtggcgtgtgtctgttgtcccagctacttgggagctgaggtgggaggatcgcttgagcccaggaggtagaggttgcagtgagccgggatcacgtcactgcactccagcctcggcgatggagcaaaaccctgtcccacccagaccccctaaaaaagaacttccgccaccacgtgccagttgttcacttcctatcaggcatcgtgctgagctgtagtatctcatttaattgccagccacagtacagggaggcagtagaattgttcccgtttagtaaatgaaactgcagctcaacagaagcaagtaatctactccaggcctcacagccagcaagaaacagagctgagattccaacccatatcactctgagtctgcgagaacggcttattcctttgcaatgtgcctagcacctcccacccttttagctcttgccccgctctcccctcaccacttctccaggttggctgactctgtgactctcttggcttccaggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 35847 - DNA, 15679 bp, Homo sapiens
gcggcggcggcggcggcggcggtggcggccggggagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacaggtaacggcccggcccaggctccccgcccccatcctccctcatctgctccagagggcctctcacgtacccctagccggcccccgccccccgcagcggggccatccgcccccagccaggtccgttcaccacttcagccaccctagtccggtcctcagccctgcaactgggccttcttctgtcctttagccccctcttcagccgggcccatccccctcatccgggccttctcctcccctaaagcccccaaaagccggaacccaaccttccaagcaagtccccttttttctttcagccccaccgaattgtgccccattccccaaactgggctttccccggcatccagattccccaaattgtttcctgtcttcctcaaatctttcttactccccttataagtcacttcacccttccctttgaattccctccctgatgaaaactgcaccccccacccagactcttctcatatcactgccccccgcaaagtcaacctccatccttcagttctcagtttacccccactcatcaccctccccccattctcttcaggcctagcagtccttacacagatgtccagcctcttcctcctggtcccatacttcagcttcatctttcccccaccttcccctctccacacccctctcccagttaggccccattttcccagtctcccagcgccattccttttatttatcaaacaccaggtttgattcttgtgctccatcctgttgccccaatggtatacccccaacactcttggaaacattcttaccctctaaacatcttttctcagctggaactcatccttctccttcccctcttaactgaatcccgtctttggatcattagatcacaggacccagccatctcgcttccagtgaaccttccccctgtacctccagtgccttcaaaccaagctctatattctggacactagatctttgcaatttcctccctcaaaacccgaccctagtcttcccccattaattagagaaaggctgcacatctttctcagaccgagcaccctggttttccaaacttgcatggtatatccttccccctgcagatagttcctcaattttcctttctctacatgcctctctttctccaagacaacccttctcacctatctctccctcaaattttaatatatcccatatttctgcctctgttctctgaaactgttccacaatttcctaattccccggaatttttaatcctagttgctccttatacatcagaatggctttcatttacaatttggacctaattctcttcctcattttttccccaaacttgttgctgtcctgtccaaaccgtgtctgaagctcattagttccccacaccagaccttttgtccccagatttggccttatggcctctgcctctcacttgggcctcattattttgcaagcagatccattccctgtaaatcttccttaaattgggccatgttctattcagaattagactagttcctctcaaatgcattgccttctttattgcttttctttgcatagagccctctaactgccactcaggattcctctcaaacttgggcactcttcttactgaaatagtctctcaactttcctttcccacttgttaacagcaccagccttaaatattccaactgggttttcagcttttcttgtatttcagtgtttcttaccctggcttcacatttgagaaatcagtcacttgggccttaccttcaaagattggtctcattggcctagagtgtcctgattattagcatatagttttaaagctccccaggtaattctttataatgcaaagctggggttaaaaaccacagcttccttcctgcagcttttcccatcctattcctgtagtgggtgtcagcccttttctactgacaaaggcctaattttcttcgaggaatatttttttttttttttttttttgagacagggtctcactctgtggcgcaggctggagtgcagtggtgcgatctgggctcactgcaacctctgcctcctgggctcaatttcttcagggatttcttagtctttctctctcaggtgctgtccagaagtgcccaagatacaatacctgcaacagcttctgaagttcctgtctgtactcagttctcagccattggccattttcttcccccaagtctcagactcttaactggtgccctccccctcatttcttctttgcatgcaggaagaaaattcactcgccgtttgataatttgttatggtcttatttgacctgttatccctgcctcccatgttctctttaccctacaacccatcagctgttagagtttccttttccaagactctccatgtccatcccctctgcattcccccctttcactccatcttctgtaacccagcccctcgggagctgaggaggtggaggcggatatagacacggagagtgctggatgcaaaggtgttacttgtggcaaaggcgccgtgtgtgctgaggatagatggcaggtatgagagagggcaggatgaagcacaggggtggaggggagcagagagacctacaacaaaacccactcaaggggtatgtgagatagacttttttttctgttctttttgtgtgtctgtagtgggggttggaaagtggggtggtctcagcagtcattctctggagtcctctggactgagctggtcgaaatgccgagtcttttgtaggctgagccctgagagttgagcaacttggaaccaacatgtaagagtcttcaccaactgtgaggttgaaagacctgagttctggctgagccagtgtgcttacatgtgaaaagaagagggggttgggttaacttgactcgaaaattctttccagcttcctaagtggcaaaacaggcttgcttgtctccagggcccttgcttagcgtgttggtaatttgaggggcctggctgtatgagaggcaggtggagagaggagccaactggcctgccagggcctgggtaggagctaggccttggatcaggctcctccacttggcctgggggtggggtgttgtgtgcagggtgtctggtttctttgagtgatggcaatcccatttccatagcgtgtttcctagattccttgggcctgcccctaactttctaaaaggaatcctggtagagtcctaactagggattctgataagagccggatgttcttcccagtcagtgttctcgagtgtttcatatccatagagtggggagctggctgggaatttagctcccattgggtgggggatgggattttcagcttccctggctccagtgaaaaactcaggaggtggaggcttggtttcctggaagaaatagttgcagaggagctggcactatgttttgaaaacaaggctcttcctttccagtgttattctgattggtacttccaaaatgtcagaattcctgatggtgggggagggaagaagatacaagtacgagcacctttattatcctttttgaacatgaggtttaaatccaaggaaatcaagcttcctggtctttttctccctggatttgtgggggcagggagacagtatctgtccagggcttgctttgtacctgtgacagtacagtatgtagagaagcactagccctggcttgatagtgatattattatcaatctgtgctgatgggctttgaggagaaacatttggttctgcaggtggttttttgggggaagggggcagggcataagaacatatcagaactatcagcatcttcactgagtggtttcctgggtaatggaatttctgtctcttcctaaagggtctggtttcagttattccttatttattgacaatatggcttgttgggcatggggtggtagggagagccagttttccaatgatgtgccttcaaggtcactctatggtaggagggttgggggagaggagagaggggagagagagaggagagagtcaaagaggagagagagagagacagacacagactctcctagtatagtcaggaatcccccaaaatcagagctatgcttcagaaagcagtgtgggctaataatagcaattcctcactctgccaagaaatccaaatttagcctcagagctgctcaaaaatataaaaaaggggactgaggagtgggatagagggatgttacaaatgtgcatttctagaaaaacaaaatgagtaattcatccctttttgaaagagtatgcagtgttgattcaagttggtgccatgatttagaaggttatgaagccaaagttacagaccaggccaggcatggtggctcacacctgtaatcccagcactttgggaggctgagacgattgcttgagcccaggagttcaagaccagcctgggcaacatagtgagatgccccatctcttaaaaaaaaaaaaaaaagttatagacaagaaagggacaagtaggcaggcaagaattttgtcacttaaagtgaacaaaacaggtagtgtccggttagcagcagtagtgtaaaatgctttgtataagataaaccttaagaaaatttcttagtcctttgatactatataaacaatgatgtaattctgtcctgggaagaggctggcactgtgtgatgaccttactctgcaaactagattgaggtacttaatatgtaaaagtaaagtcttatattaaagcttgattacctagctatccactcacctctggtagcatatgtgattgtgcgttcctttggcatatgtaccaatatcagctgtgtgataagcaaaccccaaaggcacagatattctagctatcactataactgtgtttcttgtggagaatcaaccaaaacccaattttgctttcagcctgtgattcagagtggtgatgtcattttctttataattgtgcttagcaagaagagtccctgtggaacgcagaatagccctagtgaaatgacttttgcctggcatctgcccaggggccctttctcagatggaaggggcatcggtagctggaaatcagcctctacagccacactagactggaggtggtcatcaccctctcacctttcttactttctattttgctaagtgatggcacatctttttgcgtagggattagtcatcaaagacattcctagtctcagagtaaaagctacctgtatgagggaagtgagggcacctttgggtgttctatgaggcagggcctgagacaagaatgggtcagaagaggttgagagggggaaatgaatgtagaactgtgttgggaatgtggttttcatgtcttcaattgataccaaaaggtagctaataccaaggccatctgactttctctgacaggtaatagaaaccagagagaaagggtgcagaattgaatgagcgaaggaggctactgattcaagtgaaacatgatcagaagtatattaaggagaatttgaattcaagtattttttagatgtagctaagtggaagttactcacagaattacttttatatggaatctcttctctgtgtactctgtactcttttggtagccatctgtgggggattgctttcaggaccttccccttaccaaaatccaagggtccattatataaaatagtgtagtatttacatataacctacatatatcttcccatatactttaaattatctctagattacttataatgcataacacaatgtaaatgctatgtaaatagttttagtgctctttttatttgtacttttttttattatgctgttgtttatttttttcctgagtatttttgatccatggttggtcaaatccacgaatgtggaacctgtggatatagaggaccaactgtatgtaaatcaaaactgactaaagacagctggaagtaatttttttttttttttttttgaggcagagtctcgctcttttgccaggctggagtgcagtggtgcagtcttggctcactgcaacctctgcctcccgtgttcaagcgattctgctgcctcagcctcccaagtagctgggactacgggcgtgtaccaccacgcccagctaatttttgtatttttagtagagacggggtttcatcatgttggccaggatggtcttgatctcctgactttgtgatctgcctgcctctgccttccaaagtgctgggattacaggcgtgagccactgcgcccggctggaagtgattctttaacagaagatcctttacttttatcaagagacttaaggttaattctaaatagtaagtaccctagagatttagaaatagcatttgaattataaaaattttatttaccatcatcattgcccagctgtacatctgctgcatacgctgcctgtctgtagtcagtgtgtgaaattgtaacctgctaagggcatttcagacaacagtttcacagacactttaaattagaggcagcaggatgtgatatgttagtagcactcatatgtattctgaggagtgtttccaagggcatgtcctatcactgagaaaataaaaggcactaacagattggctctaatcttccatctctcttccgaattgccttgtatgctggatacctgacaccttagtttctggcatgggatatatgtatttttttctcttccaaagcaggaccagcccagctggatgtttgggttcggtctgatacatttgattttccttaatcagcctgatcttttcagcctctgaaaaggactgagattctttttttttttttttgagacagtctcgctctgtcacccaggctggagtgcagtggcacgatctcagctcactgcaacctccgcctccctggttcaagcaattctcctacctcagcctcccaaagtgctgggattacagggatgagccaccatgcccagcctgtttcttaaatcatcctttaggtggttgagattaaacaatgcctgccctcaagtggtgtgaccaggaggtgaggaaggattggaaaaagctggggataggagccagttagaaacaagactaaactgaatatgaaacccaacctggtttggatcttatgataggaagacttgtgtttagaagtcactgtctgttgtgcttaaattcttccaggattcattattcctaatgagcttggtggcgtagcttcaataccatttgaacactaaagccattatcagaagagaaggccattactgggtaatttcatgccccttaatgtctttaactaccacatacgtacccatcccccttcctttctcacttcagaaatgacaggttttttggaagagaagcaatttgccattcacagcaagtaactaataacagatgctttatgtggacgatgaagataattattgtgatctactgtctactaaacttatcgcaaaccccagctgtttcttttagggaactggaactagttcccagagtgggggcttgaaacacccctccacccccactcacacacacacttgcttatctgcgcagatttatgggggaggagcagagagcctccaggatccttgtatgtgagaatggggaagtaaatgacatgttaccatggcgtagatatcttgcgtttatttgaagaggagagagatcaggaaaccagaaatatcacaagccccactgctaaatatgactagcttaaagaaagaaatatcacaagctcatagattagtgctggacacagggcaggcaggctccagggattacttctaggaagacaaagggtattatggtctaaaaaaaaatcctcactttattcttgtcttttcagtgagttggcccattgcttctgctgtttgcaagtaaaaattagctaagaatcaagatggtagttgggatgcagggcagaggttgaatgcagctcgctcatctaaagaccatttgaggaataattcctttggaagtaggagcctggcaccagaattctagaattgcaagggcttggtgattgatagggttattttgtgaacctaattaattctctgtatacaagatgataatctgtctatcccagaggggtttgccccatctttgggtagctccactgaccaatagaagcaaaccagctttctcccgtggtccagccctccttatgcccctgcaggaacctcagcacagagaagtgatcattggggaatgagaacggaatcatatgatgtggtgcatgtgtgtgcatttgcttggggaaactcccctcaccaaactcttgtcttattttttctagtctggacactgttattctgccccttaacacattggaagggggaatcacaatagctcattgtccccagcagaaaataactcctgtccttgaaaacagtagcatagtcctctgttaagccctttctgtttttttgtttgtttttgtttttttgagacagagttttgctcttgttgctccggctggagtgcagtggcgtggtcttggctcactgcaacctccacctcccgggttcaagcgattctcctgcttcggcctccttagtagttgggactacaggcacgctccaccacacccggctaatttttgtgttttcagtagagacggggtttcaccatgttggccaagctggtctcaaactcctgacctcaggtgatccatccactttggcctcccaaactgctgggattacaggcgtgagccaccacgcctggccgtttttgttttgagctgaagtttcgctctgtcatccaggctggagtgcagtggcacaatcttggctcactgcagcctccacctcccaggttcaagtgattctcctgcatcagcctcctgagtaggtgggtctacaggtgcacaccaccacacccggctaatttttttgtatttttagtagagatggggtttcaccatattggccaggctgctctcaaactcctgacttcaagtgatccacccgtctctgtctcccaaagtgttgggattacaggcatgagccactgcgcccagttcagccttttctgttaacagctgttgatgaggccgagagtggaggaggtgaggatgacctgaggttttccagaggagggaagaggtagatatgtggttacacccctagattttttttttttttttttgggggggaggaatctggctctgtcacccaggctagagtgtagtggcacaatctcggctaactgcagcctccacctcctgggttcaagaaattcttctgcctcaggcttttgagtacctggcattacaggcacctgccaccacgcccggctaatttttgtacttttagtagaggtggggtttcgccatgttggccaggctggtcttgaactcctgagctcaagtgatcctccctcctcggcctcccaaagtgcacccctagatactgatgctgctcctcacccatggacacttccctgggaaatccatttctcaaagaaatttccaagtatacttgtaggcccccagttgaaatctttgagagaacagaccctaggagctgagcagtgacgggtttggacttgcattttcagctggagtgcagatacagttctgctaataggactgcccctttggttactgtaccattgccatgttaggtgtgaattcagttttgttgctcttcatttagaagaatccaaaattggcatgccatgctatataaagcaaaggacagtgtgaagaatagttacctcacaccgttttacaatggctttcagggaaaaaaaagccctgacttacagcatttggggactttcgcagtgtaaatactcctcctttggccaattcaggctaccaacatgacatcattaaacacatatttggcaagagatgtgcacgattgtgtgagctggccccagcacaccactgcaatacccgctaaatgtatccagtgcattccagctgctctgaggctgatgtgtggtggctggggaacaggcctgttgctgagtcgtggtgtgtacacacacacacaatttacctccttctctgtttcacttgcccttggcctagggaatgaactacatctcagtctaaggaaccactaaattggattcaaagacagttgagcagatctacagccctgttgggtccatccgaaaatcaaggtggccagtaaggtgacagctcttttaggagccttttacctgctataatctgtctgattattggattctttactcaggtcatagcacgtatcctcctctcccagcacatagcctgcacccagcacatctgagtgtgtgttctgaccacatcactattatgtgacctcccacgctcaggtcacgaaaggatcagcaaagaagggcaagaaggcccagcatttggtgcataccaggggcaaatcagacatcacagtattctatgtactattgtgtacctctgctctgggagccaaatccctggatttagttttattcttaaccattgagggatttggttaaatgatttctcactccagctgggtgtggtggctcatgcctgtaatcccagcactttgggaggctgaggccagcggatcactggaggtcaggagttccagaccagcctgaccaacatggtgaaaccctgtctctactaaaaaatacaaaattagccaggcgtggtggcgcatgcctgtaatcccagctacttgggaggctgaggcaggagaatcacttgaacctgggaggcagaggttgcagtgagccaagtgcgtaccactgcactccagcctgggaaacgagtgaaactctgtctcaaaaaaaaaaaaaaaaaaaaaaagtttctcaccccagttcctttgctcagaagggggatggggccatcactggggaagtagccttgagagttcctcaggaacagggtacccagaccatatgacttcccctctccagcctgtaactgtgggcctttttgattctgccacataggtggttgaggcaccatagggaaatgaaaagagactggcacagggtttgaggcttggcaggtaagccaggacctggtgatttccaaggtctgcccagtgccacagtgatttgttagaagattgctaggtgctcctccggtcaaataaacccagctggagtcccttggccctcctgagacttcctccccatgactttgcaacacggtgggttccccttaagacagcagcgtagttctggaagctgaagcccacaggactggggcagctgggagcgttcataagccttcccttgtttagagagagccaggatggggtgggggtgggatttgagttatatctttacatcttggccgggcgcagtggctcacgcctatagtcctagcacttcgggaggctgaggtgggtggatcatgaggtcgggagttcgagaccagcctggccaacatggtgaaaccccatctctactaaaaatagaaaaattagctgggcatggtggcgtgcacctgaaatcccagctgctcgggaggctgagacaggagaatcgcttgagcttgggaggtggaggttgcagtgagccgagatcgtgccactgcactccagcctgggcgacagagcgagactccgcctcaaaaaaaaaaaaaatcgtcaagtcttggtgtttactgtctcaccctctctgtctcttgcagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggtaaggaggaccctgggatggaaggctggggttggagctttctcagactccactgtgctgctgctcaaggggaataatcactttcttagtcttctggctcttagcctaggccagtggggggactgtgaaggactctttcagctgaggctgttgcatggcttattgggaatactagaggagagatatcagcaccatttgttgccttttaatctgctgtaattgaggcccagaagttagtttagcttctcactaagactgggatggaaggttagcaaggcagctgaattctgggcttttgagattgtgcccaagggagataacacggaccctgcagtccacttggaatcagactttggctgactggggctccagccaaaccctcatacataccctcatttgtttttggtatttccctttctgacagggaaggaaaagaacatggtgttgggggaaagcgtgggctttcgagtcagggagacctgggtttgaatctcatctctgccattcactgtctttggagccttgggtcagttgcttcattattctcagacttaaagtggagttgttaattaccatctcaagtgcttgtcatgatgataaaggtaatatatgggacagcactttgtacttggcacctagtggacaatttaggtaaatatttccctttctgttttgctagcttttaccaccatcaactggtcttagtgcctggtgagtgacagctccttttagccatcatgaagctctgcgttttcagcatggcctctatcccacgctaccctgacactggcctaaggggactcccagcatcgcctagattagggagtggatgatatggccagaagcagtagtgacctggtcctctgccctgctttccttcccaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaagggtaaagagccaaatgctggggagggaaaggaggtcccattccagagaagagtatatgtttactgtgggtaacagaattgtaggggagtctgtgccttctcccttagctctagactccccaagcagataccgttttgtaacaggttatttttagccagtaagacaggcctgctctaggttataattaaagcagattgttatcacattaaccaaatgcctgccggttaatcgccccatggttcactctgacactaaatccccctgtagctacacagtactgtagtttaaaaggctaggaagcaaaaagaagtacttaggcccatcaccaccttcctagacctccctcccattcacaccccacccaggaagctcagaggtaagtgggatttcattggattgggcaaagaccctccaagcagccaagatgggtaagaaatgtcctgaggacagagttcctgagtggtcccagcctcttgagaaaatccttttaggcagtgttagagcccagagtgtccctctcagtggcaggtgatcatatcagacttggcaatctgtgggacacctgaagaactgggttttctttctaggccccagactctgtcttgtggacagcattagttaagatgggtagtgttactttcagatctcctattgcaggaagagaaaagttagtaacatttttctcaggcgctgtggctttttttttttttttttccaaaattcaaggctcttggggtcttgacataggaatcttcctcctggagcttctgaattttttttttttttgagatggaggctcactctgtcgcccaggctggagtggagtggtgcgatctcggctcactgcaagctccgtctcccaggttcatgccattctcctgcctcagcctcccgagtagctgggactacaggcgcccaccaccacgcccggctagttttttgtatttttagtagagatggggtttcaccgtgttagccaggatggtcttgatctcctgacctcgtgatccacctgcctcggcctcccaaagtgctgggattacaggtgtgagccactgtgcccagcccagagcttctgtatttatattgctggttgtaggcctcagaaaagcctttgggttggtaggggtgggggtggggtgtgaatgggagggaggtctaggaaggtggtgatgggcctaagtacttctctttgcttcctgcagattgttagcactgctagagtttgctgaagagaagatgaaagtgaactatgtcttcatctgcttcaggaagggccgagaagacagaggtgaggagtcagagtggcctgagccttacagcccagacagtggggcctgggggagagaagggagcacctccaggatgaggtgggactcttgaatttgcctttcaaaccctgggaaatcatggcaggagggcaagtgcctgaagggctcgtaaaagcctagtgcttatttgttccatctttgtttggggttttgatttcagcctaccattgtgtttctcatcagacttttttacactctgtcttctgcagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 35848 - DNA, 3040 bp, Homo sapiens
gagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaaggtaggccagggagcgggcccggccggcagcagccgttgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaacccagcgcggcccacggtgggcgtcctcccctctcccgctccgtccagcaagatcttgctggttttgcgcgtgtataggtggagggtggaggccgagtcgggatccgccaagagtgggggaaaaaaaggaaaagaatcaggctgggagttcctctgcggctcgccccgagtctgtcttccccttccgtttttcatcccttccccgctcccctccctttggcagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgca

SEQ ID NO: 35849 - DNA, 115246 bp, Homo sapiens
tctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccgggagctgctccttcagccgctccgcgggcgtcggctgcggccggggcccctcggccgccccacgcctccccacgttgccggggttgtaggcccagtctccggcgctgctagcagccgcggagtcctccctgtgtggggcgtgtgtggaacttttcacgtggggtttcgctacactttgaaaatttacccagcctagcttttagggtgatgaaggggctgccctctctctctgcccccctccccaggaaggtctatgccatcaacctgcccccgacgcagtgacagtggttccacggaatgctccgtggtcataaactagtaacattgggtgtatttatagcgtctttcatcctacaagcttcctaagcactttacaaactcttgtgcaggattgcctcgccactcggaggaaggccgggtgggggggaagcaacagagagcaaaccggccaattggttctccatttctcagccttgggagcccaaagaatgagtgtagtcgccttgcggagtagctttgtttcatcgctttcagtgacagcaaacgtgttctgctcagaaactttttcttttttggcattacgttgagtcgtacccttgcgatgtttagtatataggatataactttgggtgtcaaatctggttcagcttccccgtggcaagcaattaaaatgtactgttaacgaactgggcatacttgcctatgtcgctacaataaaaggcatacgtcaagacagacgaactagcaatcggacagaagattttaaaaagtaaaattagagaaagatcttggtcttcccttcttagattcataaatacttcatatgatgtaccagcgaaagagggggatttgttgtcactttttaaagcatgcttttcctgaagcgcagttgcagtgaggaaagacttaccttgatgtgattgccccagttgagtcaagtgatttagtttcagagaacatgaggacctctctgaattcctaaaatttaaaaggatacacctcatgcagaattctgaaattgtaagaacataaatactaaagtcagtgtgcgaaaacctctgctttgtgtaaataggtacgatggaatttaggagaataagtgttttgataataattaaagattttttgaatgtttcaaacttttttctaagtaaacgtgagaaatgttgacaagcgagtactaacgaagcttactagtatgttttcccttataattgggcagagctgggttatgcatttgtgagtgatattaattttcctactaaattctgaccactttagagtttagaattacttagaattttatgaagttaatagttgtatacaacagattttctttttttttgagacaagagtttcgctcctgttgcccaggctggagtacaatggcgtgatctcagctaaccgcaacctccgcctcctgggttaaaagcctcctgagtagctgggattacaggcatgcgccaccacaccgggctaatttcgtatttttagtagagacgaggtttctccatgttggtcaggctggtctcgaactcccgacctcaggtgatcaccgacctcggcctcccaaagtgctgggattacaggagtgagccaccgcgccaggcctatatacaacagattttctagcagtgtgtgcagccttacactactcaattcttgaagtctcatgttctaaataagattttttgctaaaatgtggagtaactcaaatttgacatcaactcactcaagttaatggccttctgattgaccagttgtacgttaatgtatgtgtaattaaactctttgacctcttcaggtttccctgctcttacctgttttgccatcatttaatttgttcagcaaatactgaatattatgtgccaggcactgttctgggggtctgtcagtatagctagaaagaccaagatccctgccttttggagctaatattgttggggagaagaggtgggagagaatttcattattcctttagctgaccagtataataacgttgtgtgatacgttaccacatagtactggaactgaatttttttttgttagcttcgttatgattatgagctaatttggatccattctgtctataacttttgcaggtttttctgaaaaccttacatgaagtaagtgactagttttggtattcagtagttaatagctgctgatttctaaaagaatttttcattactgtttaataagtattaataacattcctaagtgattcccattggaaagaactattacagtttatggccctttgttacagatagatgtatatctcagtgttagggtgtttcatagatttatcttactaaccgtgtgcttatagaccttcaaaattcctgtcttccagattggcagtcttgttcataactacagactgcgtgagttgctagtcaaaagtagttaatacctagtgttccgtaaagaaaaaatatggccgggcgcagtggctcacgcctgtgatcccagcactttgggaggccgaggcaggtggatcacctgaggtcaggagctttgagaccagccgggccaacatggtgaaatcccatctctacttaaaatacaaaaaattagcggggcgtggtggcggatgcctgtaaacctagctacttgggaagctaaggctggaaaatcgcttgaacctgtaaggccgaggttgcagtgagctgagatcgcgccattgcactccagcctgggcaacaaaagcgaaactctgtctcaaaaaaaaaaattgtttatggttatacatatgtacatccttaattgtttatggttccacatatgtacatatttaaaaattattgtattttacatctgttgtttggatgtatacttactgtaatttaagggaaactgtagtttcaccaaaagtgtcaagcactcggccgggcaaggtgattcacaccttcacacctgtaatcctagcacttcgggagaggcaaggcaggcggatcacctgaggtcctgaggttaagagttggagaccagcctggccaacatgcaaacccctgtctctactaaaaatacaaaaatttgccaggtgtggtgatacacgcctataattccagctgctcgggaggctaaggcacgagaatcacttgaacctgggaggcagaggttgcagtgagccaagatcgtgccactgcactccagcctgggcaacagagtgagactgtctcaaaaaaaaaaaaaagaaaagaaaaattatatatgtttaagatgtacatgatgttttgatatatgtatacattctgacatgattactaccatcaagctaacacataatcacctcttttttttttttttgagatggaaactcgctctgtcacccaggctgaagtgcagtggcacggtttcagctcactgcaacctccgcctcctgggttcgagcgattcttctgcctcagcctccccaagtagctgggattacaggcgtgtgccaccacgcctggctagtttctgtctttttagtagagatggggtttcaccatgttggtcaggctggtcttgaactcctgacgtcgtgatccgcctgccttggcctctcaaagtgctgggattacaggtgtgagccgccacgcccggccaatagttctgttttttatgtctgtgtgatgagaacaagtaagatctactgccatagcaaatgtaaaatatgtaatatagtattattaactgttcttaactgtgctgcacatttgatctccacaatgtattcatcttaaaacttgtatcctttgaccaaaatccacgcccccatttctttcattccccagcctaggccttagagcaagactcttgtcttaaaaaaaaaaaaaaatctcaagcactcatctcagattgttttacaaaattaacttgtaaaaaaatatagaattgtgttttgagattgttttcattgcaaaatagagtggtaattgaacttactggatattttatagatactactccagataaattcccatcagtaatatcagattctttttagtgttttgagtgcattttttttttcttttttgagacagagtcttgctctgtcgcccaggctagagtgcagtggcacgatcttggctcactgcagcctccacctcttgggttcaaccgattcttgtgtctcagtctcccaagtagctgggactaccggtttgcgccaccacgtctggctaatttttgtattttaagtagtgatggggtttcgccatgttggccaggctggtcttgaactcctgatcttaggtgatcagcccaccgctgttacgcaaagtgctgggattatagctgtgagccaccgcgtttcagccttagtgcgtattttaagtataccttcatcattgtctgtagaagttataatacacaacagtttaatgcacaatttgcatttttaaatagaccttttcctagaagttctttttaagatggaagacaataaggacgtttctgtatttgtaagctgttgacaaaggaaaagtttattccagtttataagctttcccgccttgcacaaaatgtatcatttcacatctttttgataatgtttaaattttaatttgtatgcagaggaacaaggaccacaaaactttttaaagaaagcaggctgtaattgtgaaacttctggaaataatgtgggtctggatcaaataattctgccccagggagtctcttccttactcctgggctttgttccactatgtaggattagttgctttcaggtgaaccttttattatctttatctttgaaaaatcatttcttaccatttttactgtctggggttttgcccacatgggtttgatgagcttgattagaattggagaggatacgtttgaatgaaaatgctgtcctttcctgtatcaaacggtaataaagcctttcttggcctagccttcagagtttgggaaacctgttatgaaggtgactgtctccagaatgtaatcaggctcttaagatctctaccctggggtcctggaagtagcttcagttagtttataaaagcttgctaactcatcaggagaaagagtgttatgataaaatgcccactccctaatgctagaggaactccacttgtgtagcatggacagcaactgtttggaagtgattgttagctggaacatacagggcgactcacattagtgaaggagttttatgttcatttgtgatatacttaagaacaggaagagtcttaaggacagatgggtacagttaatctttttttttttttcttttcttcgagctacagaaatgtttgccagatttgagggaacagctttcatcttcatagtaggtttctctttcttagggaaggtagttgttggcatagtactacctggactggtacatagaggaaagctggatggtagtcttgcagatcacactgagcagagaattaattataaatttgcttttcatttttcatgttatgaaacaaagtgaaacagattcattaaagtgttacttatacttaaactaatactgtttatagttttgggacagccagtattgtcatagctgttagtactactatgactttagaagttagaaaaataaaagcatacggttgttattaacaaagtatttattttgtcttgtctttctagatagcagttcagaggaacctggaaaattattagtaccaatattgaattagaaactatttaagtaatatgaaatataatgtaaaaatttggctttttaagtaatacataaatcacaaacttgattcaaacaaattagagaatgcttcatttgtttgtacatcattcattaaatgaagttaagggatgaaagcatttgtccagttcaggaagattatatgattaaggctagaaaaagtggtatgccttttttttatattatacattgggggactttaaagggaattttttgttattttcattccagagtacatggatggtctttagtagtcctgttaggtttatataaaagttactagacaatttgtagttttaaataatgcaacttttttttaaaagtagttcttgttagcccattgtaaggtcaacagaatgtaaaggtattactagtaagaacaaatcactgagttaacacatgaattacaattagttattagtctatcagtgtcttgtgaaaactattcaaccatagtctgttaaagcaatgaatttattttagtagcttttctaattataacaatgatgtatattcctggtagaaaaattgataattatctaaatgtacaagtagggaaataaaaaaaatcacctgtaatcctaccacttggaaacaaacaacattaacattttcatgtgtttttggaattttaatttcatattgttggctgaacagacagtaaaattaaggtaagataatcattgtatatgctgctgttaaaaaatttcttactgtaaatttttgaaaacatagtttttaatgactatcatacttcagtttgcttaaccatttccctattgccaaatattttggttgattccagggagtccatattttttctgttaaaaaagattgcaactatgactatttagacacataaatatttgagtccatctatgattatggaattattgggctgcacgtaactgaaatatattacctaattgacctccataagggtaataataatagctaacactttctaaatgcttatcatgtactctgcatatctaaacttaatcatttgagcaaactctattgaatactactattatctgttctacaaatgaggctttgagaggctaaataatttgcttaaggtattcttccaagtggcagaactaggattctgacccaagcaatctggctctaaagtgagcactcttaagaattaattatatttctcaaggttgtatccgtttaacttctgtgtagcagtatcttacccagcataatgtatgtttaattttataggtgaaaaaatagtactttaatgctttaatttgcatttctttgactacttaggagaataaaactatgaatagtctgtagagaattttcatttacttttgcactggagtattcaacatatgaatatagggatgtgactaaaaagtaaagagactgaaagcatagtagttaagagtgtgggcttgaataccagctccatgtctttctagctgcatcacctttttttttttttttgagacagagtctccgctctgtcacccaggctggagtgcagtggcgtgatctcagctcagtgcaagctccacctcccgggttcacgccattctcctgcctcagcctccctggtagctgggactacaggtgcctgccaccacgcctggctaatttttttgtatttttagtagagacggggtttcaccgtgttagccaggatgatctcgatctcctgacctcgtgatccgtctgcctcatcctcctacagtgctgggattacaggcgtgagccaccgcgcccggcctctagctgcataacctttaacaagttacttcttgtagcctcagttttcccctgtgtaaaatgagactgctaatgagacccaccttacaggtttgttgtgtgataaataaaataaagctttaaaatagaacttagcagatagttaactattattataccaatatttagccacgattaggccaatattaaaattggatgttgtttttgcaagcagttacatcgaatgccatacacttattttagcgatcctgtcattttattgtacaacttctagaacttaagttttgaaaagcctgcagagccagtttgtgaatcgttctaagaaagcattctcaaaggatatgggtttagtaccactgggatacttaaagaatcctgttggctcttgaggggtggcttcaaaaacagaagttcatatatgattcacatgtaatccttagagtaagtgtgtaacctcttgtaactttattgaaggaataaacactcatttggtttgcatgttctataatatgtacgttaaatgtgcatctaaaaacacatctagtttttcttttttccttcctttcctccctttctcctccttctcctccccccccccccttttttttcactcctgaactaggttaggttgtggtccctgtccaaagcttatgccagacatcgttttgaaccatgcagcatttagcatagtgtgagtggttagtgaatgattgattacatgagaaactagtcctctaagccaaaccatagtaattgataaattcagtgagtcagcgcaaatgatgctctgaaatgtttgaagtttttgtaactctaagtgaagtcttaagatgtagtagagggtcgttaaagatcatgtggcacttctgtatgtagcagggtagtcagcctagtctcctggaaaaatgagttgaaattgtcagtgaccctgaattgggagttagaagacttagtctgcggtccagtctttctgtttactagctgtggtctacatttcacttcctccaccatgactgttcttcgcatctcatcccttcctgtcacactgttaaattgtacactctggtcccctatttctcaggcttatctttttgaattgaggtttctattacagtccttgaattattgggcccagatgtggtttattgccacttccatcatcatcttttttggcttgagaattactctcctgctctctccctatgaccatctgacttcctgaactcatgctccctcagtcattgaggagtttaataccttcctcacagatactatgttaatacattcctcacagatattatgtctagcctctattttaattttgttcattgcatgtggaagtcattcatttattcaatttaaaatacgtttattgtgtgttgctgctatgggtcaggtcctggatctacagtggcgatcagacaggcttgtattgcagggatcttcacgcttagagcttgtcatcctactagtttaaaaatcttcaaacttccattttgcattttatcctagctcttctgtttgttagatgtaggactttgagcaaatcacttagtgtcttgtctgttccctcttttgcaaaaaggaaaaaatgatgatacctacctcataaaattgttttaaagatggagttaatacatataaagcttcttagaatagtgcttggcacataataagcattatacataaatgcaaggtgttattatttaattattctatcttgttgcttggttccttctcacgttaatgtgccctttgatctcaggaagacccatttattctcccaagccatggtgctgtcacttccacctatgttaccagttgcccctttcttactacctccccagaacaaggccagaaatagcagcagaaagcatcttggatcgttctacctatttgcccccactgaacatattttctagctactcctggagaaaattgcaagacagtggtctctaatttagctggactctcagtgcctctgagcagtttcctttatgtccctggtcagcttcctctcccctttcttgcctgagctattccaaactttaatcattgtccttaagctatctcttgagaattctcaaattgctcttacttcaagaaacctaactactacatcagtgtgaaaaggaatgtaattaggtgaaagttcgaagttcattcagcattcttccctttcaattatattatttaatctgcatctttattcattctcgactccttccctctggtctcagagaaggaaaatgtctttttcctgtcttctgcattatagtaactacctcctttcacagccaagattcttgagagaggagtctctatttccttttttagagcataattttcttgaggaggcctcagtcttttttatgactttgatcagtacagcagtacgcacccagcatatagtacacaatgttgaataaaggaactaacagactctttaagtttgtttcctcctctttaagatgagaactacagcagtctttcacaaattgtgaggattaaatgaaatcatgtcagaaaatgctaatagtggtatcactatgacatttaaaagaatttcccaatcataaaatcaaaattttcaactataattctgtttcatgtagggcagttattttcaaacgtttacagggagcctggagggtgtctaggacccaggaggcctaggaagtgttaagtagaaatctttgaaagctccctctgtggtccttgagagcagctcctgtgttaccatttgtatatggggttctgtaaaagatttcattttaagaaatgctgttaaccattgctttaaaatcactagtaataattattaatgaatcttttttaaaggtgaggagaatactacttgctcaacttgataacggttaataggaaattgagaactgatcctgtagttgccttaactcctaatccaaatctgttgctactagacagcattcttttttttaaattcagttttaaagttgaaaatgtaactaagcaaaacttcctaatttgacctccatttagtacttgtaatcattgagaaaggattggacccaaatttactctttaaatgagaaatgttactgctgagcagatgaataaaacgacttcaaaggggaatttttacctactttaagaaaatataagattccttagagatactttcttataaaagcaagccatcattgctaagaggaattccttcacatatgtgtttgtaagtcattcttacctaaaacagctcttaactgagcaacacttagcctcttctgtttgccctgtcctctccaaagtaatggtgaaaaattcctttttctttttcatctccaattcctttccatttccactagaggttgccttgtaagattagtgacaacttgttgaatgtctgacttgtggtaggctgttttagatacttttaactaattatctgaaatcctgaaaacaattttaagtataatgtggttactcctgttttaaatctatttgggtctcagagaggactagtaaaatatttatgatattacatatacgcctagagaagggcagagttgggattcagattctaggtatgtctgactgaaaagttcatgttgttttcattatacagaaaattaattctaaggttaccttttaaattattagccaggggcagatctggggacgctgaagcttatacaatgcactactctctttacaaaaagaatctaccttcaggttccaggagttggaagaagccttcgtaagcttccttcgtaagcttaagttttactggctttaagtaaatggaccatttataaaagttatgaaaaacttgggaaatgtgtattgttcagtaacatttgaatatataacttgtttaaggggaccttagtgtgtattgacttgaataaagcagtcaaaagcataacctgtaagaaaggcttattattactagttgacctatttatgagttaacactttgctactttaaattgtaaggccgacgacacacattaaaaaaatttggttaatagaaatttaagtatatacttagcaaaaagtgattccttgaagttaatatgtctaaaatactttgatttttgattttttgtctttaagaatatactaaagagatagattaaacagtaaaatgtattagaaatacaaagattaaattctctagtaataatttactacttttggtgtacgcaaatgcaacatgaaagaaataatgcttttttgatgaatgctatcactagccaaataataatttgtgtgctcttgtgttagtattttaatttttgagggctaaaagtgactcttgaaatctttttgtggtgctataacaaaatcctgcagactgagtaatttataaagaacagaaatgcattttctcacatttgtggaggctgggaagttcaagatcaaggtgctgcaggttctgctgtctggagagggctgctgtctgcttccgacacgatgtcttgatgcattgtcctctcggaattctttggtggggacgaatcctgtatctgcacatggcagagacagaagggcaaaaaaataaactctctgtcagcctcctttataaggccacctaatcccattcacaagggttctacccttatgagttaatcacttcctgaagaccccaccttttttttttttttttttttttctctcactctcacccaggctggattgcagtggcttgatcttggctaactgtagccatgccctccagggcctaatggattctttcaccgcagcctcctgggtagctgggacgacaggtgcaggtcagcagcaattttttttttttttttttaagagacagggtttcactgtgttgcccaggctggtctcaaactactgggctgaaatgatccacacactttggctttcaaaagtgcaaggattacaggcgtgagctgctgcacctgcattgccgtaccttttaatactgttaaattgatgattaaatttcaacatgaattttggaggagacacaggcattcaaaccgtggcagagacttttgagagaatctgttctttctcaacagatgagcaaacaggggtctagagaaagtggtttaccaagggatacactcctgacttgaatttatggaaggaccatgaccagaagcttgatttctggttaaaagctcttttctctttagcagactgaaacaaacatgtagccgtaataactcaatgttaacactggcctatttaattataaaatgatttctcagtattgagcactctgattatttgagttgacatggtaccctggaaggacactcagcttaggacacttggactccttcattgctctgtgtgatcttggataagcttccttagccttagtttcttctttgtgaaatgaagaggttttaacttggggttaccttaggcttattctagctccaaaaatttcagtaaaagacaattgtgtttatacataaatctaggcaccgactactagtgtcttttcctgtggcctttgtttgaaatattttgtgtgatgttgcaaaaattacttactttttagtcttagatttttctttatgaatggtatggttcagtgatgatggttaagttctaatgtgaagcagtgggaaagttagctgtgttcttgtgtacattttttttggtgagttgacagttgtaggaaagttttaaacagacttatagcagatttttgtaacaattttgtgtcatagaccttttgctgtcatatcttatttgattacagttagaatcattcaaagacagagcaaactatggcagttcggtattttgtatgtttttttcctttccctttgggttatgtgtaattgatttaggtacaatcaatttgtcattgtcttacagtttatagagtttttatacattatcatagatgaatgtgtaaaaagtaattttatatacatgtgacccatgtataaataaatagtagtgttaaatagtataaatagtagtgttttggatttcatagtatattgggaaatacaacaaattttattttgaagtgttgattttagatataatcactaattttcttaatatagagggtctgtaagtacaatgtttgaattctagttatgatgactactgtgttttttggataaaatgtgtttaagggagtcctgtaacatctctatttttatgggtggaaatagcaccaatagtaggacagtgacaagctttttacctcagtgagagtacttacattattgtatcttatttgttgtggtcattatcacattttgaaatgttatacatacctttttttctatatatgcaaaagtcattcacagagatatagtcgaaagagttgttagtacttttagctcaattgctctgtgacttaaatggacttaaataggctaatctggaagcttgaccttgtgtctttgaaaaaattgtttcacatttcccacattctcaaattgagttttggatagcctactcatattgaggactgaaatgcaaatcataattgaaccttctattgatgatttaactttctcattatgaatgttactgttctgtaatgtaatgatactagagcccaattgaatgtcgatcaggttgtgatttcatggaattgtcccatgctgctgtgcttttctaattgataatctttttttttctttttccttggcatcagctctttttttggcagcactcccccactcccatctgttctccactgtaaccagagaaaccagttaaccaaacatcagtagtttttacattcagttttaagtcactaatcaaggctatatgtctcttctacataggcaaggaagaaacaaacatatttattgagcaagtgctgtgtgccagatgctttcacagactttcttaattaccccacagtccaccgtctcacgtttctctggccacaagcaaatgaggaaagtgagctttgaaaggttaatttgttcaaagtctgtttgaatgtgtcccactgggctgtttttctcaaagcttggatctttggctacatttttgatggttgatgttgcttaaggaataattgatggataaatggtattattgcagatgtcataagtagttgtatactgtttggtcatcaaataagactccttatcattaactgcaaatggactgtattcagatcatttttttttaatattatctatacattgtgccacgcattgtaaggggtacaataacataaagaccttatctactgtgaggtgcttacagtttgggagggagcttccttatgtaattaatagtttagttgtatcagatttaaaaaatactgccattcctcagatgcttgtaccaaagcttttttttttttttttttttttgagactggagcttgaaattaagatcaagtattttcccttgtttattttttttctagctgtgtcattctgaattgcctggaatttcaaattctcaccctttcccccacccaccctgttctaaattttttcttgtagaaaattattcacagaggactaaagacttcttgtcctttgtatgtagtagatgttaagaattcacttcttttcatttagttttaatttgtctcatgatgtagttctctcagtaatcacagaaccttcaagatgtgtaagtatataatagactgacatcctttcaaattcaggcattttgaaggttatattttttatatcatctgaagtaatgtaaatgaaaagattttgctttaaagaaaacaaagaccattatagatttatttttgttattgatacttttctgatgggaaaattgtaatcctggattggagggaggtaaggaggcaaagatcactttcaaaaattaaattcttgacttggtttttgaaagtcttactaaactataaacatttaagaatccttaattatatttttcctttaaaaaagcttttgtttctttttctgctgaatgaatttaatttgcttgctgatcattttgtaacttggccttcttggggaagggtcctgtatacatctgataattagatagcaaatattacatgtttgtgtatatagatgataaatgtgtgtgcagtttattttattgttttgctgacgcattagttgctagatcccttagtgtatttgcagttattgcaacttaatcagtttatcaatgggattaaagccctgctcaagtaatttagaatgttactttaaaagaatgttacttctcttttaaaaaatatattaatacataaagttagagcctttaaattttattgctcctggaatgaagtatagcttaaagtttttattgttaacatattgatgaggtgagagttgaacatttaggcatttaaaaaatttttcagtagcagttaatgttgcttctgtgtcagggatgggcaagtggaaagattaaagctcattagtaacataattattttgccaaggatgttgacgtgcatttgatgccaagacccgatcatgtgtatgtattaatctgcacttgaagcccatttcatttgatatgtagtttttggacttatttgatttagggaaagattgtagcttattgatctgcttctgaagggcctatttcgtctaccctttttttcccagttaatatttattagtaaaattaatgattaagcagccttctgggtgaggcctttaggtgaatgggaaaaatctgaaaatattgcttgatgtaaaatttaaaagtgtgttacttgtacactacttctgttagaaaaagatttgattatttaaaaattagattaattgctgagggtaaacacattcaaccgttttcctgtatcattgtgccttataagtaaaaagtttgtgttgtcaaaattacattggtataacatggataaagtagtattcattcaacagacatttgtttacaaccttctgtgtggcattgaagaaaaatgcataatctcttaagctcatagtctagtggaggaagatgcatgaacagataattcagctacatgggagtgtagtgatggttacaaactgtcactagtagttatagactatcaccacattcccatataaacgaaaatacactacagtttatttagtgtatagttaagtaaatacagtttacactataaaatatcacggaagaactgagaaggagttgttaactttgcttgaggagttcagtgaaggattcctagaggttatgacacctagctgtgttcagaagatatgtgtaaagaatcagataaagaaaaggcaaagcaaaggaggaccaaaagcaggggggaaaaaagacatgggaactgaaataagtggggaggggctgtgacagtgatggaaatagagtgagaaacagcaagttgtatatttaagaattcccattggtttaatgttgttgggaaatacatgtcagacaggtgtggataagtgagcataaactaggtctgtgcctactatgctaccatagaaaggttttgaacagggtcatggtgtgcctatgtttattttgattgtgattttgagggaagtagattccatgaggttggagttcatagtgtttggaaggctcttgcagtgaactaggtgaaaggtttttttttttttgagacagagtctcactctgttgcccaggctggagtgcagtggcacaatctcggcttactgcaacctctgcctcctgggttcacgccattctcctgcctcagcctcccgagtagctgggacgacaggcgcccaccaccacacccggctaatttttttgtatttttagtagggatggggtttcaccgtgttagccaggatgatctggatctcctggcttggtgatccgcccacctcttcctcccaaggtgctgggattacaggcgtgagccaccgtgcccggccgaagcctagaagttttaacaccaccctgggcaacaaagcaagacccccatctctacaaaaaaaattaaaaatattagccacgcatggtggcacacaacggtagtcccagctgctcaggaggctgagacggaaggatcccttgaacctgggagtttgaggcggcagtgagctatgattgcacctctgcactccagccttggtgacagaagaagaccctgtctaaaacaaaaacgaaaacaaagagaaaaacaccttgtgactaatcatcttcgtgtgagcagtttctctctgtagtgtagtaaaaagttttcttttgcggttttcacatatttttcattatgtttagtggaaaactgtaaacctggaataacacgatggaacccattcgacgtgcccccagtgaacctggaagtgctcccaaaaagcagagaaaagtcatgacgttacaagaaattgttgaattgcttgatgtgtactagattaagttctgcagctgtggttacctgccatttcaaggtaaatgaagccaggaccattgttaaaaggaagtttgtgaagccatcgctacacctgtgccagctggtgcaaaaaccttgtgctttttgcaaaatacttttttatctcatattgaatatgcagcttgtatgtgggtgcaggattgctgtaagaaaagtatacctactgattctaatatgatttaagaaaagcaaagtcattatatgacaaagtcaaaggaaggtgaaggatctaaagctggagaatataatgccagcaaaggatggtttgatacttttagaaagaagtttggcttaaaaaatgtcaaggtaataggagaagcagcttctgccattgaagaggcagcagacaagttcccagacaccatcaagaaaatcattggagacaaaggatctgtctaaacaggtttttgatgtagacaaaagtgccctattctggaaaaaagtgccacaaaggatattgactagtaaaggagagaagcacatactagggtgtacaaggcaggaagggataagctaactctgctgttctgtgcaagtgcagtcaggtttttgatcatggctgactttatctataaatctactaacccctgagccttgaagagaaaagataaacactagctgccagtcttttggttgttcaaaaaggcctggcctggacagtgagaactctttttccggattggttccatcagtgctttgtccctgacgtcaggaagtaccttgtcagtaagggattgccttttagtattttttctactggacaatgcacctagccacccagaatctcatgagttcttcaaaactgaaggtgttgaagtggtatccttgaccttaaagtgtttttaattcagcctgtagatggggaaggtggggggtcaataaggacctttaaggctctttaaacgcagcagtagtaatctatggaaaagattgtcattgctatggaagagaacctcaatagagggaacatgatgaaagtctggaagggttacaccattgaagatgccatcattgttaaaaagccataaaagccatctagcctgaaatgatacattattgctgtagaaaactgtgtccagatgttgtacatgacttcccaagatttacaacagagccagtcagaatcacgaaagactgtggtaaagtgaggagtgaagggtttcaggatatggatcttgaagaaattcaagagctaatggacatcacaccggaagatgacttgatggagatgagcgcttctgaaccagtgacagatgatgaggaagatgtagaagaagcagtgccaaaaaccaagttgacattagagaatctggcaggaggtttctgatactcaagaatgctttgacttttacgacatggactgttttatgatgtgggcactgaaacttaaaacaaacagtggcaaaagatttgggaacagatagaaacatttttagaggaatgaaaaagcagaaaagtcaggcaaattacaatgtgtttttgtgaagttacagagtatggctccctctcctgcctccctttctacctctccctcctccatctcttgtgcctgtgccacccctaagacaccaactacttctcttcctcctacacctcagcctactgaatgtgaagaccagaaggatggggacctttatgacaatccacttccacttattgaataccaaatacattttctttttcttacaatgttcttaatattttttctctttattctaagaatacggtgtgtaatacatgtaacatacaaaacaggtgttaatagactgtttatgttattggtaaagctttgggtcgacagtaagctattagtagttgggggacttaaaagttatacacagtattttgactgctcaggaggtcagtttttcctaactctcacatggttcagtggtcagctgtattcgggatgaaaaaatgggaacatatttgagaaataccttggggttaatgtcagtagtacttgatgattggataagaaggagatgagagataagaaaaaatataaggcttatgtttctagcttgtataattaggtagtttatattgccacaactgaattagagattacaggaagaaggtttgggcaggtttggatggtgagttgtcagggatttttgacatgataagtttgatctgtgtctggagcttttgattggagatgtgtagcaggtggttgaaacaagagttttagactttgtggggaagatctgggcaggcagtatagatttgggagccactaatgtaaatgccagtacagaagtccccaccccatccacagggaatctgtttattccaagacccccagtggatacttgaaaccatatagccctgagccctatatgtactgttttttcctatgacgtttaatttacaatttagaaacaataagagattagcaacaacaataataaagtaaaacaattataactatattgtaataaaagaacatgaatgtggtctctcaaaatatcttgtactgtacttaacccttgtgatggtatgagatgatacactgcctatgtgatgagatgaagtaaggtgaatgatagtggccatacttctgtagttttgagttgcgacagcaaaactagtgcagattctttttccttctccacagtttcgtggatagaagaagatgtgttcttttcttttctgagacagagtcttgctctgttgcccaggctggagtacagtgccacaatgtcagctcagtgcagcctccacctgggttcaagtgattcttgtgccctagcctcccaagtagctgagattacaggtgtgtgccactgcactcatctaatttttatatttttagtagagatggagtttcatcatgttggccaggctggtcttgaacttgtggcctcaagtgaactgtccacctgggcctcccaaagtgctgggattacaggtgtgagccaccaccctggcgagaagatttattcttaacatagatcttagcaatctcagcatacctttttttttccttattaagtagagaactttcaccttttcacttaaaggaagcactttattgcttctctttggcatttctgaattgtcagcatcactacttttgtggtttggggacagtattaagtaagataaacattgcctggacataagcattgtgattttgatctgataaaccagatggctgttaagttaccaagtttttaatgggtgtggggtgtgtaacatagtgtggaaatgctggacaaagatgtaattcaggattcacatcctgagtgggatggcatgagatttcatcatactacataaaatggcatgcaatttaaagtttatgaattgatatttctggaattttttatttaatattttcaggcagtggttggttgctagtaacttaaaccaaggaaggtgaaactgtagataggaggactgttgtagtttatcttctttaagatatggacaaacttaggaaatctgatagaaattagggacctactctccagaaaagaagtgcacacacagtatacttggaaagttttgtttattgttttaggaacctctggaatccctcttaagttttagaaccctgcatgtacggataatagatgtaaccatgacaatgaatgaaaatacatagagacccagtagagagtgacaagagccaaggacagagttctcagggtgaaaatgatttaaatggctctggaaaagtagtatacaagagatgtaggggaataatgttttctaaaagaaagctacgttatactgaggtgcatttatcatagtgttattcttaaggtgcctttgttttagctcatatctgtatatttgctaagcttgaaaaagctatatttctttctgacatttatttgatgactgtcgatgagcgttcaagagattctatcattgggcactttcctttgttgatgcatgagggattatactgtgctctgggctgtgttaaatctactgacgttctcatttaatcttcatgacagccctttgagatagatgctgttattgaacccaggacttaattttctcaaggtcacatggcttgtgagtaacaaagctgtggcacaaacctaaggctgtctgacagcaaaacccatgttctctaccagtatactaactatgtttaccaagataatcagtgactgtgatgttactttaccatattagcacaatggaatgtgacattagtccactgatttggactaggttttgggatatataagttctaatcccagctctatgattttgggtaagtcatttaatctctctgggtctatttttcattgtcgtcgtctttttttttttttttttgagacaaagtcttgctctgttgcctaggctggagtgggctggcgcgatctcgccttacttcagcctctacctcccgggttcaagcgattttcctgccttagcttcccctgtagctgggattacaggcacgcaccaccacatccggctattttttgtatttttagtagggatggggtttcaccatgttggctaggctggtctcgaactcccaacctcaagtgatctgtccaccttggcttcccaaagtggtgggattacaggcgggagccactgtgcctggctcttcttctcatttgttagaaaaatttttaaccttagctatcaccagaaggaacattttttcctgcagccccatcttttatctatcaataaggcattaatttaaaaagaaaaaaaaaacgcactacatacaaccttgtgtagtaaaacagctcttgatgtatatatgtgaaaatggttatgttataataatgtgagagtacttttacaatgtttgaagcctcttggttttatagttttaaaattcttcagcttctagtagaaaaatttagtaatttactctgggtagagacattttaatactttttctggctttcagaggatcttaggttatagagcctgtaaagatgatttgatgttttgctcagctattagcagtataggtatctttgaggcttatagttgacattaacttttctcttttttgaaattgttctgagtattttgctttatctatttgttactcaatgtcaagagatagtgtcttagtttgctttattagaacctcagcatatgtagtcaacaaactaaaaccacattgcacgtacgtagctatggtatttgaggccatcattattacatggccttgaatcttctgtttgtgaaaagttagccgcatcagtacattttatatggatgacatcctatcaggatatctgattaaaaagaggtagcagtataggtgtaggggtaaattcttttacagtcatttgataaaagtctctgacagacttaggtcttggataggatttcggtaaaagaaaagaaattgttctgttaaagttccttctcaagctcttcagaaaagatcagaataacaagattcagtttgagtcatttgcttaaggatcgtcttgattgagagttgagctggtattttactgccagggtgactaaaataactattttgcctactccttcctcttttcacattcatacacatcagacgtgacttggagaggattccactaactcagtaatttttatccagttcagatcagaagtttgtgtgaagctgatcaatgttgcttaggttgtaaatgcagaacttggagattttatgtggcatttacaaaggggtcattagtcatatattagcagaaaatcagtcaccgaagtatgaatccttgttatgtgccatatactgttttagaggctgaggaatttggcagtgaaaaaaagatccctgccttcatgaagctgacatttggttgtagagagggagaccaggaaaataatgaagaatgtgggttggagttggggatcagtagtgaggtgaggctgttactgtaaataaggtgggcatttaaaacttcactgtaagatgacagttgagtagaggtttgagccatgcaggaaactgagggaagaacatttcagacagaaagaatagcaaatacgaagacactgaaatcagcttgtttgatgtatgccagggagtgcatggagcagagcgaacaaaaggaaaaaatggatgaagttgagagattatcagatcgaataaagcttatagaacattgtaaggactttgacttcaactccaggggaaatgagaactcatttgagagttgtgagcaaatgagtgacatgatttgatttatgcttttacatggtcaccctggttgcctgatgatagcaggccaggagtggagatggagaccagttggaggtggtggtggttttaccaggatagtagcagtggaagtggtgagaaagagttgaattctggggatacattttgaagttagagacaacagcattttctgttggagtagtagtggggtcagagagtagttaattatgatcacaagcattttggccggagcagctggaaggatggagtggacatttgttcagctggaaaagacttcaggggaaaccaactgagggaaaagatgaggagttctgtttcaggcttggtaagtttgagatgcctactacgcattaaagtggaaacattgagtaggtagctggatatatgactctggcatgtacagagggggccagagaatgtatcaattttaagattgatttaaaaccatgagaatagatcaactccacctagaaaatgagtgtgactaaaaaaaaacaaaaaacaaaaactgagtgtggctagataagaaatcgagaacttgagctttaggattggaggtttaggtgataattaagagccagtaaaacagatgaataggagacagaagtagaagaaaaacaagagattgtagtgcttggaagttaagtgaggaatttgtttcttttttttcttcttcttttttgagacagggtcttgctctgtcatccaggctggtgtgtagtggcgcagtctccactcactgcagcctcgacctcccgggctcaagcgatcctcccgcctcagccccactaaggagctgggactacaggtgcatgccaccatgcccgactaatttttgtatttttagtagagatgggtttttgccatattgcccaacctggtcttgaaaccctggactcaagtgatcctcccgctttgactttccaaagtgctgggattatgggtgtgaggcaccatgccttgccaaatttgtttcaaggagtaggagtgatcagctctttcaaatgctgctggataggtaagtaagaggagaactgagactttgcccattagattttggcaatatagaagtcactggtggccttctcaagagtagttgcagtgaaatggtagagatgaaagccctactggagtagattcaagatataatggaaagatggaacttggagacagtgcatgtacaatctcctcttcttgcctgtgattttgccataaatggaaagagagattagatggtgctgaaggaatatatgggtttgtgaggatttgtttttgacataggaaactgacatttttttttttttttttttttgagacacaatcttgctctgtcacctaggctggagtgcagtgttgtgatcttggatccctgcaaactctgcctccgggctcaagtgattctcctccctcagcctcccgggtagctgggactataggcatgcgccaccacgctcagctaattcttaaaaaatttttttgtagagacagggtctcactgtattgcccaggctggtctcaaactcctaagctccagtgatccttctgcctcagtctcccaaaatgctaggtaggattacaggcatgagccagtccatgtggtgaaactgacagttttcagtatgaatggaaattatctaccagaggaaaaattttgatgatgcttagatgtgtgattactaaggggaggagttttctttctttttttttttgagacagagtcttgctctgttgcccaggctggagtgcagtggcgggatcttggctcactgcaagctctgcctcccgggctcacaccattctcctgccacagcctcccaagtagctgggactacaggcgcccaccaccacgcctggctaatcttttttttgtatatttagtatattttttgtatatttagtagagaccgtattagccaggatggtctcgatctcctgacctcatgatccgcccgcctcggcctcccatagtgctgggattccagacgtgagccactgcgcccagccaagggaggccttttcaataggtggtttggcatagaactagagatttacttgtcaaatttcattctgtataatattacattgggttcttgttaaaatgtcgattctgtttctgtaggtctggagtagggcccgaaattctgcacttctaacaagttcctaggtgttgcttatgtgtctggtccttatgctatacttcgagtacaataacttggcactttgagcacaagaacctagcaggttttattggcataaaatcaggtcggttggtgtgtgaatatgatgggaatttgtatagtgtctcatcgggttgtttttattttctcagtggaataggaagcagtcataatcatagagtgaggatggaggaggtggtataaaatcatctagaagagtagagtgagtagactgactagtggaattgtggggttgcatgaaggctgcacttaacgttagtggttatgaatttaaactcagatggaccaaaaatatgggcatatgttattctttgttttctttcagctatacggatatatgtcaggagtatgtgggctgttgggatttaacttggcaagtattttggtgggagagagataaggggtaagtgacttacgggtatataaatcattatgattttatttaaagtgaagagttctgctccaggtaagattggagggaggtcttaaaagatgagaaagtgcttctaacagatctagaacctatttttaaatgtatcctttttttccccctgttaaaataggttgttaatgttcttatgtgtcatagatttataatcatatctatataatacaatatttactatatatggacaaatatagaaagactttcaaccattggttttttttttttttttttttttgtctcttctctctcttggatattacagatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtatcaaactttaaaggactgttgctaatactatattgaatgtagaaaatcctttataccatattgcactttgaccggaagtgttctttttaaaggtgccagaagcctatagaaattactaattcgtgactgttaataagcactcatgaaaaatttataatcagctaaatcgaaaatttggatatttgagagatgaagtttgtgagctataataaatgctttctttaaatcataatgaagcaaactcagtaattcacaaatgcttattaatatgttaattacaaggaatttttttccttaaaatgatttaatcagcccatttttactttctcatttttctgtatatttgaaaacaataaaactacgttgtttaaaatatatttctaagatggatcactaactaaaattgactttattttaactgagttctgtggtacatttgaattttttttaaagataaattattgttgggctgttcacattattaaaaatggttctctgatttcagaaagatgtatttttttagaacaaatgtttttatagagtgaactcttccaatgcatgtaaaatgtaatttcatttagaaaataaattttattacaatgccttgctttaagattgtcaaataaaatgtgaaataccacacagactgataaaaacttctcatagtctttatgtggtattggggtatttattttttaagttttattttgaaaaaaaagtttcatgaatagcacgatgtgaactcttgtgtacccttcacctagattcaccagttgtttacattttgctacattttttttgccagtttttctattgatatgtgttataattactgttaccaatattattattgctgaaccattagagagtaagttttagatttcatctaccccaaaagactttgcaacatttcttttaagaataaagaaatcttacttaaccaaagaacaatgatcaaaatcaggcagtttaacaatataatactgttgcctaatacattccttattcagatttcaccaattgtcctgtttagtggtgatttcctttatagcaatttgttttctgatccaggatccagtccaggatctcatgttcagttcctcagcctttctttgtctttcagcacattgacatatttgaagagtataggtcagttgttttgtagattatccctcagtttttggtgtgtctgattgtttcctcatgactagtttcaggttatgcatttttggcaggaataatacataagtgatgttgtgtcctcagtgcatcacatcaggaggcacttgatgtcagtttatcccattattggtgatgttaactttgatcattggtgtccgccagatttctccactgtaaaggtaccttttttccctttgtaattcataagtaatctgttcagatatattttgacactgtatgaatatcctgttccctagaaactttcatgtgatggttttagcatccattgatgattcttgcatgaatcattattactatggtggttccagaacagtaattttctatttctgctctttcttctgtaatttctttctcttaaagggaattacatgagccacgcagttagtatcttatgaagcaaggtgattgtgtttttcacacaatcagcagttttttattaagtgcctattatgcacagctttcagtcataatgtagtggatgcaaagagataagatactatcctttcctggggtttttattgtgatgtgagagatggatgatacacacatttagataaccgtgtgaggcattatataattaagtggcaagtgagttgcataggcaataaatggcttaagaattcaaacggaggagaggttgccttgggatgtaagattttatgggaaagaatgaaattgaattgagccttgaaaaatatttgggatatatatgaacagtgtggtggaaggcattccatgatggcagatgttgtgaaattatatagagatgaactggttggttaaacttaggtggtaagtagagtttgactgaggcatataataattacagggattagtggattgtagtgttacaaagatggtttgggaacagattgtagaaaaatttgggtgccagactaagtaatttggactaaactgtagacagttattggaggtttttaagtgggtgaaaatgtgacagaatatttgaagatgtgattttaagtgggtgattatgtggcagcatattatgaggatgctataaatgtaaaattgagaggaggtttataaaatcaggagaagacctggaaagatctgggtaaagtgataggctagaaatgaatggatgatgtcagaaattctaaacttaagtctagacaaagattgcttactgggagaattatagtgccaccaattgcaaatactgtgaagtaatagtgggaaactgatttgaaatgggtagagaatatgataagttttgtttagattatattgaaaatgtttatccttggaagataccttagaaatcattttgcatgtgaggaaaattgagtgtgagatcatagtaagatgcccaagtagagatatcgtatgtttggagacacatagatttagagcttgggcaggaactcaaaattagatgtggagatttggcatttggtaacgtatactgaggaacaagtgttggagttcagaaaatgaagagcccagagccaagggatgaatcttaggagcaaactatagtaagtaggtgtgggaaatggaaaagaccaatttaagaaatttggcatcaaaaggacaagtggaagagttttgtttaaagctgctgaaggagagaagattggaacagctgagttattggatatagagagtatgggattaagaacaatggaaaagaagtaaacttggaagaggggcatgttctcattcgtcagaggttctatagggaatgataattaacacaattaacttttatttagcatttactgtgtgctaggcccagttctagtgcttttacatgttttaacttagctaacagtcacagcccaatgttgcagatactactattatgtctgttttacaaatgaagaaaccaaggcacagataattggtcatttgtccaggtccatatagctgttaagtggcctagccggaactgaattcaggcaatgtggctttagtctgagcccttgaattctctgtagatctgctcctaaggtagaatgatcaagttgtagtatgctgaaattcagtgtaaggggcttcaagttaatggacttactgtctgtaaacctccagtcctttaaattctaggaatcctttaaatttacttaataatggagttggaaataatatccctgagattctttatttctaaaattattatgaatctaataaaccatccatcttctgaaaacgagacgaagagacttggagtagcctttgtaagggatatactaaggaattggcaagtgcagaagaagatagcttcataggagttggcctgaatgtgtgctatgtcagtttttttaaaccttgggcacaggtgcagaaaaaaacatcagtagttgtgtgttagggttgagaagtggctcgtccaaagagtgaggagaagagagaaggccagagtgtgagatcagtgtttcggtgaccaagttttgggctccagtatggtcaattggatgttgaagatatggtccagtagatattgaagttacgtgagcagtcactccatgagaactctgagtttcagtatattataagttgcttaaagtggtcccatatttaaggttaactgttgtcttcctcatcttaagctactgtaacaaatcccataaaccaggtggcttaaacaaatatttctcaccattctggcaagtgagaagtccaagatcaaggtgcttgcaggttcatttttctggtgagagtccccttcctggtctatagacaaccacctccttgctgtgtcttcacagggcagggagggagagaggtcatgtctctcatgtatcttataatggttccatcctgttaatgagggtaccattctcaagatttaattgcctcccaaaggccccacctctaaatactatcacatttgggattagggtttcataatatgaatttgaataacacaaacattcagtccataacaattatcatttcagaatataggcagtttttataatatattcccccaaaacatgcattcaagttgattgtactaaataaattttaaaatatacagtatatgctaaattcttaaatttactttccttatacatagtcattaatgatcattgccggcatctgaaaatgttcttttatttattcttttctttcacgctcatttgaccagtcaatttttgactaggaaatgtagcaatttcagcatgtctgttcattgattatttacagtgaattaggttttgaagcctctgctagtttctgtgcttttgttttcatgtttactcctattttataaaacaattttaataatcatataaacacagtactactgtattgaaggggacactatcgaaagaactattaactgataggtaggaccatctgacatgtttgtttcctaaggtaggacctctgacatgtttgtttcctaaggtagtaagtctcagtttgttctactaaatgagacttagagatgttactgatacaatgtgcaaaagcatagtttgcatgaaaatcagtactgcctatctctgcattgcatcttttgactagaaggtgagatattctttcagggttctgtggtatcagaatacctatctttaatctcacagaatatacctttttttgttgttctgaaagcattactgtttggtctgctcatcagtttttaattcacaatgcttttggcagttagctgaactgcctgacgaaccatatatttatttattttaaagcaaagtgcttttagtgctatggtatacatagccaagacccatcttttcacattgaagaattccaaggaaatataatttttacatggattgagggctggtttgttatatagtttgttggtactttgatttcaaggtgaggatagtgaacaaagtcaaacattttggtaaagtagcgcaacacagactaccagacagcagatgacgggaggcttcagagaggacatctctttgggattgttgtagctgattgttggctttcaaaataagttcacaaaattgaagcaggcatagaaaatataagtactgtttctctaataaaagcacttctggtaggatattatttttcttgtctctggaagaatgtttcctttgaggaaactgacacccataggaatttagttcatttctcaagaccacaaggcaaaatttagggtgtaatgtggcctttgtacctcaccataagaaaaatcttggtttagaaaatgaaaacatttcaacttacacaggaatttgttttttaactttttttctaaataaagtaaaaaagcatagtaatggaggaaaaaagttctgcttttcagatttaaagacgtttagaatatatattattttgtcaaagtgtcaaaggtatcctgtaagacttttcccatcacagaattcagcattcaaaactgtttgccaggctctgtgctaggtgtaaggaatatattggtaaatagaatacatctgattcctgcacttatgaaacagatagtaaacaggtaaacaagtatttagttataaaatataatcaagaaaggacacagtgatagaggaaaaaatgataaagacaaccacataggtcaagaaagggctgtttgaggaagtgatagtgtttaaactgggattagaagaataagcgctcacaagaaaagtgggttgaagagtattctaggcaaagtgaatggctgtacaatatttttttctgtaaaggaccagatagtcagtatttttgtttttctgagccatacattctcaggcacagctcctcagagtctgtttttgtagcacaaaagcagcaacagaccaaatgtaaatgaatgaacatggcagtattccagtaaaactttactttaaaaaggcagcaggctgagtgcagtggctcacgcctataatcctagcactttgggagactgaggtggcaggaacacctgaggccagcagttttgagaccagcctgagcaacatagtgagaccttgtctctacaaaaaaaaaaaaaaaaattgaccaggcgtggtggctcacacctgtaatcccagcactttgggaggcccaggtgggcagatcacgaggtcaggagatcgagaccatcctggctaacacggtgaaaccacatgtctcctaaaaatacaaaaaatgagccggacgtggtggcgggcacctgtagtcccagctacacaggaggctgaggcaggagaatggtgtgaacccaggaggcagagcttgcagtgagccgtgatcacaccactgcactccagcctgggcgacagagtgagactccgtctcaaaaaaaaaaaaaaaaaattgccgggcttggtggcacacacctgtagtcacagtcgctcaggaggctgaggcccaggagtttgaggctgcagtgagctgttactgaactactgcactgcagcctgggcaacagagcgattaaaaaaaaaaaaaaagctggaggctattctttgccacttcctaaagacattgaataaaatcccatcataagtagggagctaagacttggtaatggagaggaatgggacaagatggggttgcagagagaagcagaagccagatcatatcatgccagaccttgaagccatggcagaaggctttgtaattaattatatgtacgttaggaagccatttaaggattttaagcaagataaataagttagagagcataagagttgaaataaggggaccaggaaggagtaatccagaaattcaggtgaataacagtgatgatttacactagtgtagtgacagttaagattgagaaaagttttaaaatacaagatatattttggatgtagaaagaacgttacctgctagcagattgtttgtagggaataagaaacggacaaatctaagatcagttttaagtttttggctcttggctaggctaggtgatttaattttctgatacggtggggcagacaaaggagctccattttgaacaggttagttttaagatacctgtaaaatttgatatgcaaatcaaattatccgagaagtttgaactggagatgtgtatttgggaattgtgaacatatagatggtacaggttgaacatccctaatccaaaaattcagaatgcttcaaaatccacaactttttgagcgccaacatgatgccacagtggaaaattccacagcttatctcatgtgatggagtcacagtcacagcacagccaaaactttatttcacagacaaaattactaaaatataacattaccctcaggctatgtgtataaggtgtatatgaaacaaataaatttcatgtttacacttggattccatccccaagatctctcattatgtatatgcaaatactcaaatctgaaaattgaaacacttcgggtccccatgcatttagggtgaggagtacccaacctgtatttaaagccctggaagtaaatgaagtcacagagacaagagaaaagagggcccaggattgcaccctgaggaatttaaacacttcgtgttcagatacattgaggattgcagtggagactgaaaagttgccagttagtggtacttaagacttagctctaatcttacattataagataataatatttgacaggtatttagcagagttacagtttttcacagccattttgcgtgtgtgtgtgtgcgtgtgtgtgtgtgtgcacgcatatatgtgtatatgtaagtcagatactaaagcacggttttaaatttagaaatagtaataattagttttgctacttttgggcatgttaagggtggagccatcttctttcattctcctttcataaggttcctatttgggattcaaacttgacagtttttaagcttgttgtagagtaacaaaggacttgccttttcttcttctaactcctgttgagcactttaatagtaagaaataacctagatgcagctgcagtgggaaaagtaataggtagaaaatagaactgagcattggtacttaattctctcactaataatcttgaacaaattactaaacctttctgggatttaaagtattaatctataaaatgagtttggagttggtcgttttagcccaaagaactttaaaaattatgattatgtgtcttgataagtttaggttattaagacttaggaagataatagtctctaagactgtttattcctgtgccatgtgttttgaataaaaatgtttcaatttttttttttttttttaatttattttccgagacaaggtcttgctgtcgcccaggctggagtgcagttggcgccatcttggctcactgcaatctccaccttgtagtttcaagcaaatctcgtgcctcagccttccgagtagctgggattacaggcgtgtgccaccatgctcggccaatctttgtatttttagtaaatatggtgttttgccatgttgtccatgctggttttgaactcctagtagcatcaatgatccacccgccttggcctcccaaagtgttgggattacaggcgtgagccacagcgtccagcttttttgttgttgttgttgttgttgttttttggagaccaggccttattgtgtttcccaggctggagtacgttggcacaatctcggttcactgcattctccgcctcccaggctgtggtgattctctcacttcagcctcctacatagctgggctaccggcacgtgccaccatgcctggctaaatttttgtatatttttttgtagaaacaaggtttccaccatgttgcccaggctggtctcgaactccagggctcaagtgatccatccgcctcccaaagtgctgggactacaggcgtgagccattgtgcctggcctcaatttttaattttcttgaagtcaggggagaaactttagttttaatatgggaagagctttattatctcaattttgtaatgcttagcagttttcttagatttaccttatgcttaatttcttcatctttaatactccatagtaataatcaaataacatggtaacctcataaatgaacctataaaaattattgaactttgaaagttggtttcttagaaaaatagctgaacaaaaaaaagttaacatttaaaattaacttatctttttagttattattggaaagaacatttattctagtggttttcaaagtttttctatccgtatgtcctattcttcaaataatatcttactccgattgaatgggaggaagccagaataagaggagcttcatcctgctcacctttcctttattcagaaaaccgcctgttgagcaaggctctggtgtgagcatttgtactatatcaaggaaagattcctgcctttgtggaagttacgttttagacttacatacttggatctacgctttgtagtcataatctgttctaagcacttttgttttaccagtggggaaattgcagccttgaaggggacatggtttcaagtttcaagtgactttcttttttgaatttctttgtaaactgcaatgtctttttgtagaacaaataattcctcaccatttatcttttgtacctagggtcttatttgctgaaaatgctgtctctgtgtgaactactttttcaatatatttttctccctatttctagatggggaagaagaaccagttttaaattttatatttgtttgtaagtaagttaagatatttatgtgaacatgaagttggtaactttaaggtaaactgtggactcttctttatgtcaattaaacagacttccttttataataaagcttttggagtgcttttccctttctaggcaaatattaattaatctaatggaaaacattaaaattaatgtttttaatggcatatatatatacaatatataatgactgcagtgagttaagaatattgatagaaacacttgggaataagattttccttagcaaattcagattcatttcagaggcccacagagattgagtttctcctatgtttcagccacccaaaaataaataagacatgattcttgccagcaagaatcccataattttagcgaggtaatcagatttgagggggagttactttgcctgaggaattcagggcaaggtagaaagaggaggtcacttttgattatacttaaagcattactcaagattcatcatgtgagcaaagccaaaatactgtcccggtagataacaaggagagaaagttgaatgagaaaaatggcaggtaggtatgagcgtagtgagatagatcagtatagatggaaggtgaacatgttgttcataaggatgaacaaaagcatcttcgaatgtttttgtaggaaatgaggatagtaaagtgggttgggctagattttgaaaaccattgtaggggatttgagtgtttttctgttggtggtgggagccattgctttttaatccttagaaaggctgactgcagtggagaagatgtagtcaggcatttaggatgagtgccattttcagttccttgttgctgcttgctcatctttagttttcatgctatcttgtcttgatgtttaacttaaaagttgctggaagtactcaacccattatgctttttgggatggtggtgacaggagtgagaagagactgtgagctaggtgtgaaaactgttaatgggtatgatatggggatagtgacctaaatataaatagcataatcccaaaagagacagagacttgtcggggatagtgtgtggaaaagggattattagagagtcaggaaaacagcaaccgtgggatatgaaggacattggaaattgaatggtttctacattgaaagggatggaagagaaatgatgttaggggagaggaggcttaaaagtgttgttttaacaagtttgcccatgttaagtatcagctattctgcttaagttgttaggtagactgtactttgagggcaagtacccccccccatcctatttctgttgtattttttagtgatattcttctgttactaagtgaataaatgaaggaggacctgttcatttatctttgtgtctcctctttgcatgtggttggcactcagttgtctgttgaaatgaatctttgagaatactaccagcagtcaaaatggaaaccaccttggttcatagccacaaatagctgagatccattttttttttctctgtgtggggtaatacctctccctactcgagttaattactaaatctgacaaccatttaaaaacacaggtgattatcgggctatatgcttctgtttttttgagattgaagtctgtctgtcggcttagaaccagatcatgttatcttgagaaaccatggtggttttttccatcgtactcgagaacaaaaatactggtagctttgttgtcatgctttgtgtatgttttcctgattaattctgtcagtgtgcctgttactaagtttaaccatgatactaatgctataataatagcttttaatgtatatcttaaccattgggaatagtatactttacaaacgataagtcatagtggtgtttttctgtggtgtactgtcatttttctttctgcattcctttccaaccagtaagtaaaaagctatcatttttcatagtagtattttgtactgattgagaaatcctgatttttctaagtcatactattttaagaccagtttaaaagcatatttgaactaagaatgccttttttaaaaatgtcaaattttatgtgatttttaaaatagtatttgcttcaacacgtagcaaattatctttatgtatgaaattgtgaaagtgtattgtcctaacacctgttctgtgttccttctttgaactttgtaacttttccgtagtgctatttattgtattctactttgtattgaggtcatttgaatgctaatattaggctcccccttctcccctctccctcagagattataaagtggctgaaagtgtcttgtatcccccatagtgccaagcaccctgttttgcctgctggaagcaaacataaatacatgaattgtcagtctggggaaatactttgtatacttttgaatgagtggttgatatctgataataggacctgatttctttaagagcttcattttggacacttaaagcaaagagtaagaatggggaatatttccactgagaatgaatttgattttgaaattgagaatagtgtgctttttgtgaaatgctgttaagttacattactatgtacgttagaaaattacttaatgaggaatcttctggcagcaatggagaaaattttttccctacagtggctatcttactgtttttttaaggatactggtataatttttctgatcactattgccatcttaattattaaagttaattaaaaataatgagaataacacagtctactgtatgaaaaggatagtgaattttatattattcaggaatctcatcattagttaattcttggaaagtttaaaatacctacaaaacttaaaattaattatcttggccttagtagaagcttgtttgagatacagaaatcttaagattgctatatgtattataacagcaacatctgttaaccaaatttatattagttgtacaaataattggagtttgactgcattaagaattcctcaaaatatgaggtaagagttccttccagtcattcagaaattctatcctttagaggaaaggaaagcaagtgtccttattcctgacctgcccctatttttgtatatgacttctgtaaaaatagcagaacattgcagtgtttctttttaaccttttagatcaggaattctcagggtgagggaaagagccatgaagcttttttctcaaacagttctgtcagctgtcctctataccttatggcttgtctcccattgggattcactttatctagtaagccacttttattgataggtttgtgtcataccactgtggtatgataaggtggaaaaattttgaaatctttaagaattatttaatggcattccttggaagactaaaattcatgtaactggcaaaatttataaagtgacaaacccctagaccacatgtgattaatgcaggactgaaaaaagtatgttttaagtggaaatttaaatgctatttttatttttattttttaactttttttgtatatgtaagaatgtttttgtaacattacttataatggtaaaaaactaaaagcaacttatccatcgttaataaagtgattgaagaagttatggcattaagtgctatttttgtaggtcatagtaaatgttgcatgcttttgtattatgctgtctttaacagatgaaacaggcaacatgttttggaatttagagccagaaagatagcaggcatccagtggctgtcaattattttaaaatagaagccccaatttaaaaaatcatacaaaactattataaatcatatttaataaggggaaatgaagtcttttctgcagtggtgctaagtaaggcattgcagtggaacatgatgtcattgatctaatcaaccatagtcacatcacaggtaaagaggtgctacagactagataggttaggtgacttgctcagagcccttagttagtgacttccctgggcagttgtctgcaaagaggttgagtatccctaatccaaaaatccaaaatctgaaacttttttctttttttttttgaaatgggaggggtctcactctgtcaccctagctggagtgtagtggcatgatctcggctcactgcagcttccacctcctgggcttaagtgatcctcccacctcagcctcctgaatagctgggactacaggcacacaccaccacccccagctaattgtttatatttttggtggagatgaggttttgccatgttgtccaggctggtcttgaattcctgagctcaagccattgtgcccacgtcaacctcacagagtgctgggattataggcattgagccgccacaccaggccaaaatccgaaactttttgagtgctgagatgatgctttaaggaaatgctcattggagcatctcagattttggattttcggattaaggatgcttacctggtaagtattatattccaaaatctgaaaaaaccgaaaatctgaaaaaatcaaaaatctgaaacacgagtggcctccaagtgttttggataagtgatattcaaccttagcagatttttattatcttagcttctgggtgaatgttaaaatactatagatttatagaatgacatacctttgagttattgtacctctgtgatactttttaatgtcctggtataattaggatgtgctccatgttattatgtctcattttatgtttttaatacatgattagtatttttttgatggacagtaatgccaagtataaatttctgtactttggggatttgtctatatttggacctaatgttgtcctgaatttggagacttgtttaccaaggaagtcctcaattttcagtattccatatcatcattgattatgtgactctgttttagtttcaatgaactttagaattaaagtttttaatttgttttagctgatgatttctttgttttacctagacatttaattaggattggctggctgggattttgccccaggcattgaaatgtagagtgtgaaaaaattttaattaatgattaaaaacaattatgtgtgttgtggggtatgggagaactgtgcacattatgtccttcagctctccagctagcccaagagctgctggcccagtattgcttccttgtcaatccatggagatatttgggaatgaaaactcaagggcaaagtttggaagcctgtagctcctggtcattcctgctgttgtctcctgtcatcctcctttccagctccttttgtttctctttaccagtaatttgactgacttgaggatgtgtatattgcagcttggacattaatttatcattaagcaggttttattatacagttgaaaaataggccagacacggtgactcatgcgtataatcccaacactttgggaggccaacgtggaaggatcactttgaggccaggacttcgagaccagcttgggcaaaacagtaagaccccttacctacacacgcatgcgcgcgcgcacacacacacacacgcacacgcacacagccagaagtgctggcacacacacacacatacacacacacacacacacaaaaagccagaagtgctggcgcgtgctgctgaagtcctagctacttgggaggctcaggtgggagcatcacttgtgcccaggagcttgaggctgcagtgagctataattgtgtcactgtactccagcctgggtgaaagagtgacaccctgtttcttaaaaaaagaaaaaggtttccttttgacagtaattccactttaatctttgctaaggatttaatttttaaaaatgcgagaaaagctatatccacagaaacaaagaatagtggtcaagtttgaattgttgcagagtggttcataaggttgatatactcaaattgtttaacaattctttcattgtttggaattaaaattgcttttatgaataaagcttgtggcatcatagcttatgtttatgataaaataataaggaaacagggcccaattttcaaataataattcaaatttttaaaaattagtgtataataaaattggcctttattttcatatatctctgaatttcagcacacataaagattcatgtaaccactgtcacacttgatatagaacagttgcttgaccccagtaaactccctctgttatccctttatagttctcttaacccctagttcctgacaaccactgatctgctatcttaacactatagttttggattttttttttcaagaatgtcatataattggaattatagtttgtaatcttttgagtctggtttctttcattcagcataattattttgagattgatccaaactattctatcaataatttgttcccttttatggctgatactctattgtatgaatgtaccacagtttgcttattcatttacctgtatacttgttgaaagacattttgtggttgtgagtagagctgctatgaacatttgtgtgtgatttttgtgtgaatgtaagttttcatttctctgttaaatacatagaagtagggttgctgggtcacgtgatgttatttaacttcctaagaactgccaaactgttttctggtaaggctgtaccattttgtttatggtagttctagttgttgcaaatctttgtcagcagttgatactgtcagcatcttttgttttagccattctgatgggtgtgtaggggtttctcatggttttaattagcttttccctaatgacttacattgttgaacatctgttcatgtacaaaattgccatctgtatatcctctttggtgaagtgtctgttcaagtcttttgctcatttttaaattatttgctgtcattgctaagttctaagagtttttttttttttaatatgttctggatacagtcatttggtttttctcctattctgtagcttctctctgttactgtctcagtggtgtctacagaacaaaagtttttaatttcagtagagtccagtttagcattttttcttttataaattatgcttttggtatcatttgcttaaaattatcagatgacattttcttcttacactttattgtaatctgacctttttctttggattactatggtgcattggacatgatatgatacagctaggtatttttcttctaaaccaaaggttaatattaaatgttaatcagtggcattaaaaaagcagggctcttctcactcataagtgggagctgaacattgagaacacgtggacacagaagagaacaacacacaccagggcctgttggaggatgggaggtgaggggagggaacttagaggatgagtcaataggtgcagcaaaccaccatggcacacatatacctatgtaacaaacctgcacgttctgcacgtggatcctgtgtgggtttttttgtttgttttttagaagaaaaaagcaggactcagaattgcataaatactattattacaataatataaaaacatactcatgttgaagaagttctgcaaagggaagagacagaaatggctagtgtgggagccagtggtttcctagtcctggatgttatatcagagtcacctgggtagatactttaaaattagggttgtcttttgatcttgtgtggtccccaaatatttcttcttctttcttctttctttcttcttcctccttcctcttccttcttccctccctcccttttttttttaaatataaagtttggtttttagagccgttttcagaataacaccaaaattcagtggagaggctggacacagtgtaatcccagcaccttgggaggccgaggcgagtggatcacttgaggtcaggagttcaggaccagcctggctaacaaggtgaaaccgttgtctctactaaaaatacaaaaattagccaggtgtggtggcgcacacctgtaatcccatctacttgtgaggctgagccagaataatggcttaaacctgggagacagaggttgcagtgagccaagattgcgccactggaccccagcctgggcaacagagcgatactccatctaaaaaaaaaaaaaaaaggtggaggatggaaggtactaagatttcccaaatacacccctgccccaacatatgcacagcctccccccctgtatgcacatccacaccagagtggtacatttattacaattgatgaacctacattgacacgtcatcactccaagtccatagtttacatgagggctcacttttggaatgaactcagtctatggttttggacatatattcactagtatagtattgtacagaatagtttcactgccctgtgaatcctgtgctctgcctacttacatacctatttttttttttttgctctctctttagttttgccttttccagaatgtcatatagttggatcatacagtatatacccttttcagattagcttatttcactttgtaatatgcgtttaagttatctctatatctcttcatggcttaatagctcatttctttttagtgctgagtaatattccattttctaaatgtagtacaatttattaatccactcatctgcagaagaacgtcttggtttcttccaagttgtggcaattatgaatgaagttgctttaaacacttgtgtgtggggttttgtgtggacgtaagttttcagctcatttaagaaaaaactcaggagtgtgattgccagattatatggtaagagtatgtctggtttcgttagaaactgccaaactgccttccaaagtgactgtaccatgttacattcccactggcagtgtatgagatactcttttgctctgcgtccttgctagcatttggtattgtcaatgttttggccattctcaaaggtatgtaatggtatcagattggtgttttaatctgcagtgtcctaatgacctatgatctcctcaaatgcttacttgccatctgtatatcttctttggttaggtgtctgtcaagatcttttgcctttttaaaaattgagttactttctaagttttaagaattctttatatattttggataatagttctttattagctttgtcttttgcaaatactttctcccagtctgtggcttgttttctcattctcttcactgaagtcttatttatttttagagataggatcttgctgtgttgcccaggcttgcctcaaactcctgggatcaaacaatcctaccccctcagcctcgtgagtagctgagaccacggacacactactgcatcgtacttaaaatctgtttgtaaaagctcttcgggtgactctaattttctgcctgatttgtgatccactgtgttgagctttctctttcttcctttgcaaagctagtaccaggcacagccatcagttctccattacttgcacttcatcttttttgtcacagctggtcccatcctgctctcaatttctctggtgttgctacttgttcttccatgtctctcccctcaaattccaactctttatctgtgtaattttagtataggttttctttaattatctgttcatacttaatccataggctgttttggttctggtactacctgtacagcagggttccctcccatttgccttgctggtgcagaaagtaggtgattgtgttaggccatgagattaacaatgttatccctcccaccatatttcccatgcttgctttctttttcaatttttttataagatgttaataatttgtaaaataaagatccttttttcacttaatgtgtagtttatgtgccaacttaaccatctttttaaaagcctattttaatcttcataatcttcatctcattcctaccattttattgtgtatgtttgaataaataatctgttcactttcaactaattttctacagaaatgttggaggaaaaattttttgttcatagagtaatctgaataagaagacattgcagcagtgtatctaaggcattcattttacttctttcagtcatgagtttgtgtgtgtgtgtatgcataattgaaaaataaacaaaattagctcttaattgtagctattttctgctagtaaaattcaccgttattggtcaggataattttttgaggtatgatgcaaacaaggcaattatgacacattgtactaggagatcacgttttattttgctgaaaggcaggtataaatatgatgacaaatatgtaaatacttgatatatttttttataaaatgtacaaatcagtgatttgaaagaacatgccttattttgtaacattaactttttatttaattggtcaattttttattcattcaacaaatatgcaggcacatttacgtgttccaaattcagggtgattttaatgtagttaacatttaacttaattttataatatagcggtatgtagaagttcatataagtccttaagaataattaatgggcttgatattctgatgtttgaaatacgtattttttttgtatgtagcgtagattgctcttgcattgtcatgattttaatttaattgctactcttcagtaaaggaatatgaagcttggtgtaaaattttgaaaataagcacgttttcagcttgctgggtttttgttgggatttgtatctgacaagtgctagatttaatgagttgaaacaaatgatacattattcattttgtataagtatttccattaactaacttgatatagttaacatttttggaggaatttctgggtgatgtaacttgaagtcatggagcttagtcttgtgaacaaaagattaaatatatgataaaattctaaattatgtggtacaggcctagtgatttttatactgtatatttagtagactagatatattgtctcatcattaaatctaataacctcgttttccccaatatgtaggaaaagattctgttttcttagtttgaatttattcttccacagtgtgttgtgtgtattttctttggcacttttagccacttgttcatattagatctgatacagaatggcattttatttatgtgtatttataattgttttagaggtgtctatatatctcaacatacattaaatagttgatgtttctcagaaagcaccatgacttcagctttttcccaatctgaaaaagcataaccactattagaaattctctatggtaaaggatatttggagataaaaaagttttgtttagtgtagagttattgagagtttagctggattatggaaggttggttggatttgaataactgtagaagttggcagtatagtcccaaagtgttacaggaacttggagacaaacacacgacgactttgtgataaaacaagaaccagagtctagattctgtttctgagtgaaatggtctttcttttgggcagatagcatagcaggaaagagtagtggtcaataacattttatcagagaggatggtactaagcttgtggactgtggaaaggaatttttgaagtcttgaatagtcttttattagggttggattggaaagacatttcaggctcaagggaactttatgtgcaaaagcaggtaatcctgaaagtgcttatgttggaggtgaatcatggcattggagggcagggatatgaaataaatggtgttatatataccaagcactattctaggtgtgggatatacacatggaaaagatagaaatcctgccaccatggagacatttacattttagtggaagaaacaataaacaaataaactaatatagtaggtaatgatgaatgctatgacaaaaaacaaattgtatggtgaagaagtagagctaggctttctttgaagtaattggttgggaaagacttctccagagatgaaatttgagcaaaataaagtgagtgggacgagccatgtgaattgaggcagaaggaatggcagagcacagttgctgtatttagtaaagaggccattgtagctgaagtgtactgagtagtttattatagagtgtttacggagtactaagcactgttttaagtgtattgctagcgttaattcagttcttaaaacaatcctacaagaagaatgctatttcacatataaggaaactgaggcacagaggttaaatatttatcccaggtcacccagtttgttagggagctgggattggagcccaggtaattgactccaaaatcagtattctcaaccattattcaaagttggggaagggaaggtgtagtaggaaattcagcagtagcatgaagccagtcttacaggcccttgtaacttactataagaatataggattttactctgacaatgatgtcaagtcactggagggttgggaaatacctaggaagttgatttatgttctggagatcagaagaggagtctgtactatacatatacatttgatactcttctgtgtataggttatagcttaaaatatttctactagcctataacatttctttgatttaaattaaagattccacttcattattttattaaacagatatgtgcatgcctgtatatacgagtgtgtggatgtgtgtgtgcaaactaatgaactcttctgttactaggtgcgagaagatgtactaaattcattgaataacaactttcttcaaacgctaaatcaagcttggaatgatcatcaaacagctatggtgatgattagagacatactaatgtacatggtaagtagagctttttaaatgttttcttcctttaagcagttaagcatttgaagttgaaggctgggcacggtggctcacgcctgtaatcccagcactttgggaggccaaggtgggcatatcatttaaggtcaggacattgagaccagcctggccagcgtggcaaaaccctgtctctactaaaaatacaaaaattaggtgcagtggtgggcacctgtaatcccagctacttgggaggctgaggcaggagaatcgcttgaaccggggggtgagccaagatcgtgccactgcactctcacttgggcaacagagtgaaactccgtctcaaaaagaaattaaacatttcaaaacacaatgactttctgtctaacttagttatagtacgtctcagtgtggaaggtggtttttgttttttaaatgaacagtactttctttgtaagggccaaccgaagcctatgtgaataaaaatctttatttatttatttatttatttatttatttatttatttatttatttatttatttattttgagacggggtctcgctctgttccccaggctggagtgcagtggcatgatctcggctcactgcaagctctgcctcccgggttcacgccattctcctgccttagcctcctgatgagctgggactacaggtgcccgtcaccacgcccggctatttttatttttatttttattttatttttctttttagtagagacggggtttcaccacattagccaggatggtctctatctcctgacctggtgatctgcccacctcggcctcccaaagtgctgggattacaggcgtgagccactgtgcccggccatgaataaaaatcttaattgttcacatacttagtgaatgcttagaatgagaaactgaaagggaatgatttaatttttttcttagtatttagcacttgtcctttaaaatggaaaatatggaaaaaaccatattaacatctccttaagagttgttaaatgacaatgagaaacaaaagctgaatattctcttacaagtttttaaatccttaattcttacatcttcagtgagagaggatgtcatattaatacaattattttttctgataatcatacactcatagctgccatctatttttcttaatagtatattattgcagtgcaatattgcagctagtcttgtttaaggatattagcttcttcacatgtatattccatttttcaccggctattgctgtattttgttttcatcagtcaagaaaaaaatcctgttcagcaagatcatttggaaaacactgactttgatctcagctgtttaataactttcagagagattaaattccagttaaaaaaaatttggtgctatagaatgacgctagattcattaagtttaattactgtatcactccaaaattaataagttaatgacttgttttacatcagtgtttatgtttgtgtattggatataattatttttcccaaagttttacctttttatatttttgtttctagtttttttagttttaatgtagtgatgagagcttgtcctagtttcttttacttggtagaataaagcaatgtttgggaagaatttccaatgagaacaaacagctgtaaagttttttgttctgctctgtgaattcagtcaggcctattacccctggttttgtaagggcttagtggcaagggggtcagggagaggccacttcacttttaagggatttgataaaaggtataacaaattatttagcttttctgagcattatttttctcatccggttataaattaaccttgtgttatcattttgaagttaaatgagatggtatgtgacaacatatattatctggcatataaatttgaaataagttagcttgttgttttcgaagttctagatatggtgagtctttaaatcgcatcctaactatctaacattaagatagaaaaccacttgtaatcttacggtttattcttttgacaaaagaagaactttaaaattttatacacacgcagactctgatgttatttttaaagtgtgttttgtttcagtcctcctcctccctttttttctttcttttttctttttttttgcaacaaaatctcaaaccttgaattctgactctacacatggtcaagaagttaattagttcacccctcaggttcctcatctataaaatgaaaataatattgggtagagtagtcatgaggcttcagtggaacaattcatgtaaaccacttgtagggcttggcccatagtaacatgctcattagagattaactggtattatttcttgtcccttcatcttttcatcaaacccattcggtagtaccacagtgctgcatgaactgaaaattcatacagggtagattgatgccactgtttcactgtttgtcgcatcacagacctgtggtcaacccttcacactgcccagcagtttcactctttttctttagtcagcttgctccagcagttatttctcttcagacctccatctctcccttgggtttcctcccttgtagtaaatgatcttactttctatttctcagagaaaagagaaagcatcaggtaggaactatgctcattttttgccgctaaatctagaactttacttgtattttctccccttttatgtttttctttttccctcctcttttagtggagggtggtgtcctcttctgtcaggccacatctcaacctgtgctatgggtcaatccctttctaccttgtcatgaaccttaagtattttagggttctacctttcatattggatcttactcaaccagcattaaacatgttcaagccactcactcaatcctcagaatacaattctgttaaattctctggtgaacccctgcactgtctcccaggatctgtcgtgtgtcattcataactaaatgtgttgtaagaaatgttgacatttgccatcttccttttctcatctttcatacactttgaatacattacagttaagcttctacctcaactattatgttaagttttgcccttactagtatcaccatggtatcttttcatctcagaatagagagactgctaatccccattctccttgtttttttttttttttaagcagcatttgccacagttggtcattccttcgttcttctaacatgtttccttgatttctgtaacaaagaactctctttgtatgcctcctacctaccttcttactgtttcttagcctctcctcctccttcaatgactactaactgcccccaccatccccccttaaatagaggcattcttggggtttagtcctagttgttcttctcatggtacactctcttcaccttatgtagcttcatgtgcctctgtgcagatgattcccaaattgtgtctctagcttcatttcctgagattcagactcatatatgcatttgtctagttaatggagccttcattctctgaagtacttcaaacttggcatgtccaaatgagctcataatcactatcattcagttgataatcactatcatactgaaacctgagaattattcttataagttctttttttctccctacatcatctgttgctagactctccagttttctctttattgtctgttactcaacatcaaaccaccttcatttctctcttgaaatattcagtgttgctagtcttacagtgttcactgggctcttctctgttttccatattgctcccaggattactattttaaagccaaatctgatcatgtcactgccctgttgaaatccttatctctcatcttggaattcttttacatatcttctgtctggaaatgtttctagaattttttttttctttaatgtcacttgctctacttattctttatgtcttaccttatatttctggtaagctttccctgacccacgtactccccactggctgcagttgctctcattgtacctagtactattcctttgcaacatttatcacagtcattaaccaactattcagtgtgtagtttgcccagtggagtgtatgaggatggaaacagtgtttgtgtactattatgtctttaatacctaccacagctccttgtacaaactaggcacttacatatatctttaatgagttggtgcagagttatattgtatgtttttttttttaaataaactacactttttaaaaatgcttattaaaaatatgctattttaggccaggcacagtggctcacccctgtaattccagtacttggggaggcctaggtgggtggattacttgaggccaggaatttgagaccagcctggccagtgtggtgaaaccccatctctactaaaaacacaaaaaatttgctaggtgtggtggtgcgtgcctatgatgccagctactcggaggctgaggcaggagaattgcttgaacttgggaggcagaggttgcaggaagccaagatcatgccactgcactctagcctggatgacagagtaagactcttatctcaaaaaaaaaaaaaaaaggctattttaggttcaaaaagaaagtgttgataccttcatgttctacaagataaattttttaaattttcatatccttcatttacttacattgcctttttatgtgtagtgttctaggcttaattaaaatctacttaaaagtacatttttatggggtttttttgtttgtttggttttgttttttgagacagggtcttgctctgtcgcccaggctggagtccagtggtgctgtctttgctcactgcagcctccgcctcctgggttgaagtgatcctcctgcctcagcctcctgagtagttaggactacaggtgcatgccaccacacctggctaatttttgtatttttggtagagatggggtttcgccatgttggccaggctggtctcgaactcctgggctcaagtgatctacccgcctcagcctcccaaagtgttgggcttacaggcatgagccactgtgcccaaccaaaagtgcattttaaaattaaggtaaaatttaatgtatgttgaaatgaactaaagtgtacaaaatgatttttgacaaacatatgcacctctctaaccgatacctcatttaagataaaatatgcttttaatttttcagaaatcaaaaaagtttttctctgtggacatctccacttttttttttgtaagacttttaccctcaacctagactcttaggttatattaccaactatgcaggtttcttgtggttactggctctaactattgggatttcagatcttaggcccagagcaggaggagagaagaaacttcactgtctgcccacctactacctaatcagctagctgacttttgtttttgtttttgttttgttttgttttgtttttttgagacggagtctcactctgttgcccaggctggagtgcagtggcgcgatcttggctcactgcaagctctgccttccgggttcacgccattctcctgcctcagcctcctgagtagttgggactacaggcgcctgccaccacgcccggctaatttttttgtatttttactggagacggggtttcactgtgttagccatcatggtctcgatctcctgacctcgtgatctgcccgccttggcctcccaaagtgctagaattacaggtgtgagccacaggcccggcctagctgacttttactcttaacaaggaggtgtctgtgtctaaaatgttatgcattaaactatgggacacactgcctcttgaaaatgtaaataaagtcacaggttacatggaggtaacgattgttcaaaatttgtcccacataactttgttgtttggcaggttcggtgttgcaaaaatcaactctacatctctcttgatggaacatgtggcctctagtttctgccactccaccccttcctaatgcttgagacttgcattacctgtttggctcctgaaagcattaagagtttgtaatccctgctttacttacatacgttaatttgattcattcttttttttttctttttgagagggagtctcggagtacagtggcacgatctcagctcactgcaagctccgcctcccgggttcatgccattctcctgcctcagcctcccaagtagctgggactacaggcacccaccaccacacccggctaattttttttttttttttttgtatttttagtagagatggggtttcaccgtgttagccaggatggtctcaatctcctgacctcgtgatctgcctacctcggcctcccaaagtactgggattacaggcgtgagccaccacacccagccgattcattcttttattaaagaaataactccatgtttagcttataagatagtttggtactggttaatatgtttcactttcagttttaaattattcaaatgattaatgattgggaaaagatttgacattacagaaaatttgttatatacgttatattacagcctgaattattgatacaatccataagtatttattaatatttggttcatttttctctttcaagctatgaaaatgaatataatgttaagggaaaattatagatagtattccatagactactcaagcaattacagttaatgtcaaagggaacaaaatgatttcctatcttgatcttctgttaagaaggctaatagaagaattgctgtgcaaaactttatggagaatttcaaaggtatttttgtgtttcttcttgaatttgtatttccagtcattttcacaaacagcaaaggtattctgaaaggtattctgcaaatacctttgcagcaaaggtatttgcagcaaaggtgttctgcaaattattctgaaaggagattagagggaataaattcaaaggaatggggagagagtaacccaagaaaggagggtcactgcttctttgagctatttggaaagtcatcaaggatgggtaaagagatgaagtggtgtgtaaaaataactttatgaagaggagagaagctgagaaactctcttttggtattctagtctccttagtaaggtagaaggtaggaccatcagtttagggtgacagaagcatgtgagttgttgagcccttaaggagtgtggtaggctactccccagccccctaatcccgaaatatgtccatgactaatcattgaaacctgggaatattgcctttatatggcaaaagggactttgcagatgtgattatgttatggatttttagatgagattatcctgggctgttcccctgggcctgatgtaatcatactggttcttaccagagagatgaaagagtcagtcagagaaaaaaggcgatatgattgtagaaacagactggagtgatggactttgaaaatggaggcgggggcactagtcaaagaagacagatggcccctagaaaagcaaggaaatgggtgctcctgagagcctccataaggagccagccctgccaacatctttgctttagcctgctgaaactgatttcagttttctgaattctagaatataagagaatagataaaccacaaatttgtggtaatttttacagcagcaataagaaactaatacaaggaaaaaaaatggaatgctcactgtgctgtgatcaactaggtgtaaataaatggattatctatagttgtgaggggataatttaggtgagttggcacaaattttgtatagtggagccagttagagtttgacctttttccagggtacttagcctcagagaagagtgttcaaaataaggaaaacccactgatagaattttccctcttgggtgtgggggagaattctaagatagtagcgtttttgaaatggttgctgtgggtctgtgctgttaaaggaagcaagtgaatctcatatggtccatgaaatagaagtattacgtatttgggatcagcagacctagagatctagtgagaatgagaaacgggatcgttcaagtgtaacaaagtaggagaggtgggaagaaaaagatgatcttcaatgccagagttatttgatgtcttctaatgatgaggttcaaggtttgcttatatcaatgtgtggctggagggaatcttgataaaatgcaagattaaaatttaggcatctttaaggagtgtgtcagattgctcattagtgtgaacgttgtagtgcaaatgttgctcatggtgtgaaccaaaggtaataggtggcaaggagcagagtttagatgaatactatacgctatttgctaaagctaccgtggagaatttgtgtgcctttttggaggccagaagataggataagaacatagagatgatggagtctgtgggtctgtgttttctcatgtacattttgatgattttagctctttaaaaagtttgttcacaatattctaggttgcacatttagagaattttgaaaataactatattctggaaaagcacagatagattaagaattttcctggcaccttctctgctttcagaatgatgtactagaagaaacaggatgcagtgacttttgggctatacctcttcaacattttgactgactttgcttttgtaagaaaggtctttttaagacaggctttccccatttgtgctctaatttttatagctatgactgaccagtatccagtaccccggcatctttttatagttagaagtcacatactaggccttatgtcaaggaaaccagggcatcatgaaatactgtaaaggttaagaatgtgcctgataataagggtttcttccttccttaaattcctgctgctttttaattttatttttcttgctacttaaaaatgttatttaatatttttcagcccctatctgaaacagattaatagaacagtaaacttttttttttttttttggagacttagtcttgctctgtcgcccaggttggagaatgataaacttgatcgctgtgccttgtgaactgttttctgggtatatgcagtgatgattttagcagtccatgacattaagtttaggaaggcaagtattcagtgtttacactgcctaacatgaagtagaccctgtggtcagaaatagagcacattatttgtttttcttttcttttttttttttttttttttttttttgagacggagtctccctctgtcgcccaggctggagtgcagtggtgcaatctcagctcactgcagccttcgcctcctgggttcaagcgattcttctgcctcagcctcccgagtagctgggattacaggcgcccaccaccacgtccagctaattttttgtatttttcttaaagacgggattcaccacgttggccagactggtctcgaactttcgacctcaggtgatccacctgccttggccttccaaagtgctggaattacaggcatgagccacagcgcccagcccggaaatacatcacatcttgatagagtaaagggaatgaacttgtatacataaagtggactctgacaatgtatatgggaagtttggagtagtgagaagaatgtttaatgtgaattaagaaactagttcctgctttgtcattaatttgctcaagttatttaccctctcaagactcttgttttcttatctgtaaaattattggacaagagatctgattcttatcttttgggagtcatagatcctttggaaaatggtcatatttcacgaactctctcctggaagaggcaggcatgtgtgcatgcacataccatagaacacatactttgtgcagtttcaaggggtttatgggtgcctgaaacctatctatggaatctgtaaggatatgttgattagattattttaaatgttagagcccttttagctcttaagttttataccatcttaaaactgaaagtgaacagctagatgtagtgtctgaggaattatgataatgaaggaagaaaacagagtagattaagttgatcacagtttctttaggaactcttcaagtaggttaatataagccttccttggctgagtctccccaacactgctactcaaaagagcaaataatacttttacctttggtgcgtgccaggcactgtttaagcactttatgtatgtttatttaatcctaacaatattattatcttatcattatttttgttatttttaagcaatactttaggagatcaataaaacaaaaaaatttattgtgtttctttgaaggtaaatgtttttccaaatacataacaacagatatcatttattacatacctgtatcactgtgccacatgttttaaatacttgaccttaaagttgaatgttatctccatttttgtgaatggaaaactgaggttagaaagattaagaatgaggttagagagattaacccgccaaaatcatacatttactgaataactggagtagaacattggatttaagcctttgaatttgcagtgtttgatttttgattcaaatttgaatttagaagttgattctaaagctcatggtcttcaccactgtgctctatcaatcacctcagtgcaaaagaattacattaattgactgtttagtagagtttatgataaacccagaattttaaggtgtatcacttgttccatatattgaagcatttagtttgtttacatttaaaataattactgatacatttgggtttaaatttactgtcctgttttttttttctgtctcatctgttctttattactttcctcagctttttttttttgctttctttagattaataagtgtattttattacccccacccccattagcttattatttacatgttattttagtagttaccttagagattatatgcattagattagttttttgttttgttacttaccactttctgggtagggcaaaggtcttagaacattttgacttcttggggtttttcccctttggtttttatacttttgatcctgggttgtttttgttttgttttgtgggggaaacgggcaagcatggtgttttaaaatttgaattccagtattgtttgtgaaaaattgtggaggccctgcatgataccttcctccaaagtaaatttaattttgttccggcaggcaggtaaagtacagtcagatcaccgtgatctagttgaggctagcttttagttagtgttggtctgttaacagtttgcctttatttccaggacatacctattcacagagcatagttcctctggggtctgaactgaaagaaagcctgaggtgtttgccaggttgccttctgaattaatgttcctagaattctaacagttgtctcttcagcacagatcttcagcctccctttgatagtttctgtttggattcttggtgtcatcaccccttgcttagggtgctgtatcagtaaacatctcagtgaaaaatttcttgcagaaattgcggctctttgtgtttctctcctcttcagaaccttgacatcttaagtcctagctgcttggtaaccaactccacttttgtctttctggttgggctcttatttccagtcctccaaagacagcaagtgactgaagggaaccagtgaaggctggtatggggctcctctcagtatgtttgccttttctccggaatcttggccctacaagtctaggttgcctttgttactcttgatgcttttaaacactgggggtttttggtttgtttttttaattgtggtcaaatacatataaaatttaccatcttacccttaagtgtgcagttcagagctattaagtgtacgttcacattgttgtacagagctgtcaccaccatcctctccagaattcttttcatcttgcaaaactgaaattctgtactcactaaacagtaactttccattttcccctccaccaagcctctgccagctaccattctaccttctctgtttatgatttgatcactcattacctcatgtaagtggaatcataaggtgtttgtccctttgtcactggcatatttcacttagcatgtccttaaggttcatcgtattacggcatatgtgagagtttacttcctttctaaggctgcataataccgcattctatgtgtagaccacattttgtttatctgttcatctgttgatggacacttgagttgttttcaccttttggctactgtgaataatgttgctgtgaacacgaatgtacaaatacctcttcaagatgtgctttcatttcttttgggtgtatacccagaagtggaattagtggatcctatgttaattgtttttgtaatttttgaggaactgctatattgctttccacagcagctatactatcttaggtttccaccaacagtgcacgagagctctaatttttccacattcttgtcaaaacttgttattttgtgttttgtgttttttttttttatagtaactcttctaatgggtatgaggtggtagttttttattttcatccagcttttatagttgttcttccaggggcgttggtcttacaaaagcttttctttcagtactaaaggtggaataacattttgaggtagatgttattttacagatgaggcaactgagacagatactaaggtcacacctagtaaatggcagacaagactgaaacagaggctatttggttcttgaatcagtgctcttaaccactgaattgtattgcttctctaatacaggtcttctttcctgaaagatagtcttataaattcattgctctaagacctcaaagtgtgattaactgttttttttccctctgacctctagattattaaatttgaagtagagaacagtgtttttattttatgatttattgcagtttacacaactttagagaaacatgggtttgatttgtccaatatcttggtagacaattcttaaatggaaattatttttaaataaaaaattttcacaactgtgtttttcttgttaaaatttttcagacccctgagaaggattgtttttttgagacggtgtctcacgctgtcacccaggctggagtgcagtggcaggatcttgactcactgcaagctccgcctcccgggttcatatcattctcctgcctcagcctcccaagtagctgggctacaggctcccgccaccacgcctggctaatttttttgtattttttagtagagatggggtttcactgtgttagccaggatggtctcgatctcctgacctcatgatccgcccgcctcggcctcccaagaaagattttaagaaaatttttactgtggtggaaactctgagctttttagtagtggctaagtccaccaggttttttgacaccatatcatatgcttctctaccaaatttatcagtaatatttttatatctagaaatgtttatctgtacaatttactaattcatatgttactggtgctgttttagaagtgtagtcagttactggtatcatggaaagtattgagaaagttctttaaacttcgatctaattataattagactttttttcccccactatgattctgcagtagaaactttttactacttttctgctcatttaaaatttttctatttctgtcttcattgtgttaaacctttttaaatctgtatttatttcatgatttgaaagtgaactctgaaaatattttattacttgttaatagaggattaccttagtgattaaatttggtaaggcaagttctaacatgttctgacagacttgtcatagagttatttgcctcttttttttttttttttaattttaaatgtgagtttaacttttcagggtttatctctagcttactagcagaataagtatttaatatttataaagatttttttaaccctgtttacatttgtcttttcgtattctcttttacagtagtagacaaaaacagttacagatgttcttagtatgaggataagaaactgaaagaagaactatttaagagtttgattaaccagcttgacagttagcttaaaagaccaactttcacagcaattcacacattgttaaaccttttttttttttcctaaataaatagctactgctggccatatgtgggaccaggcagaggatagatgaataagtactaataaataactatccttggtctattaggagtagtagtaaaagtactgaactactttgagaggccgaggcgggtcaggagttagagaccagcctggcccaacatggtgaaaccccaactctactgaaaatacaaaaattagccgggcatggtggcacatacctgtaatcccagctactagcggggctgaggcaggaggatcacttgaacctgggaggcggaagttgcagtgaaccgagatcgtgccactgcactccagcctgggcaacagagcgagactctgtctcaaaaaaaaaaaaaaagaagtatgaaactactggactttaaagcaaacatgttattaaaagctcccttaaactttgtaatagaaccagaggacttttgtatttatatttatactaagctttcagagttgaatgtgacccaaaggttagttttagaatttgttctcaaacacctgtttactcatagttacaaatgaaacattagataggaatgataaaataacaatttttaagttgtttctttccttgggtgcaccattgattttgcctagaacccatttatcctagcttgcttttctgtaacataatgactattaaaaatatttactaaactttttcttgcaggtaaattaagtagtaagagttaagttgttttttggacttaattttcacatttgtttttattttaactttttatttgatttgtttgtaatgccactccctgagtaatgaaactatttagcgcactttaagagacaccccttgactttgcataggtttagcttcaataggaactgtatttttgcattgtgtgtcttgacacctttgagcatacttttatgtgctgaatttgatttcttatacatcatttaactatttagatatgttggtagggtgaagaggaagaggcacatctttgccaagatggtggaagtagtaatatctgtggtcttgtagggccaagcattttgtttgttggtgtcctcgtgtcttctgggcatgcaaagagccctaggtcttgagtaagcatttgcaggagttttccatggaggtcacctggttgagctttccttttcttgtggcttagaaagactccatctctctccagtccaactcctggagacctgcctgtcctagttgatgttttaaaactggtggtgcttttgtatttttttatccagcctttatagttgttggcagggaagttggtcttaaaagctatttattttcaggactagaagtggaaatgagtggaatagcattgtgagatagatgttatgttacaaatgaagtgcttatgttacaaatgaagttggtttatcaagcttactgtatggatgaagtcagatgcagaaccagctgtgaaaaggggggcatgaggtgggtccccaccattggctcctgtctctcaccacaggtccacctagcttgtgaaagtttttgctcattgcaggcctgcttggccaaggaatagcaacccttgagagagaactgtaaatagagatttaaaatgtggtttatctctgtggtgatgaaactcacatccctttatgtaaacataatgcttgactcacattaggctttcgaacatgtttttcagaacattttatatttaaaatgcctgtttttggctttaaaaaggcaagtagaaaaagccaccaactttctatctctgctaaggtctctttagtagataagtgactaatgtcaaactcatactacattttggtcactacattttggtcaaagcctgggattaagacattttaaaatcagtctttaattttttttttttctcttttggaatgatttttaaaatcttgttcatactttgagtttgctagttagaggtaaccggagctgggacttttaaaaaatcttaaaaaatagacacataaaaattaaaacctcacaagaatttaaatgatattagaatcatatcatgtgcatatcacaagtttactgtgaatatatgtgtgcatttctgtttaacatatgcacacaaatactcaagggttatgcatctgtacccttaattgtacttgatggtaattaatcatacatgtcagacatttaatataaatgattatttagtattactattaatagttttatagagccacacttaagtttctgtgtttcttctccatttattagctcttttttatctataatgaaattttagggttatcaagtttttcttaatattatatgtcatttaattatcatcacacatcttgacagtctcaagttgaaagacaaaggcttagctcttacaccacagtaacccatggctttaaacattctgtgttctgcctacaccttccagcttcaggttgattttgtctcttacccgaaatgcttgtgaccataagtgttttcagattttgcattttggggggattttggaatatttgcatatacataatgagagattgtggggatggaacccatgtgctaaacataaaattcatttatgttttatatacaccttatatacatagcccaaaggtaattttgtacaatattttaagtaatttgtacatgaaataaagttttggctgcaacccgatgcatgaggtcagttgtggaatttacttgtggcatcatgttgatgctcagagtttcagagtttggagaattttagatgtcagatttttggattggggtgctccaaactatgtattctgatcacatgccttggcttcctttactgaagcatcattttcctctatacacagcattcctgaagaattcatcagttctgactgatgtctttctgcctttttgccagagggcttaagatagcagacattgtaggccataaggtaatagatttacctcctttagtagcgataccatcactatgcttaaagttgggacaggggaaatccaagccatgggagaccgatagcaaatagaaggggaagaagtagtgaagtgtacatttatttgatcctgcatgtatattattttttggtgagaggattttcataggaaatgatattaatgttttagagattatctttaccagccatttgttttactgagggccacaatgaataagtgacttaaggtcacatagccagttaacagtagagccaggatcatataaagaattcctaacttcacatcaaatattattcttactattagaggttttttattaaaaaatttaccataagtgatagatcccccttagaaaagtttgataatttccatacagcccagtaattcctctcttagaatccacccaagaaaaatgaaagcatatgtccacaaaaatattgtacccaaatgtttatagccaccttatttgtaatagacaaaaaatggaaacaacccaaagtatccatcagcttatagataagcaaaatgtggtgtatccatgcaatggagtgctgtttagccctaaacagaaggaaatactgttgtatgttacaacattaataaaccttacaaactttatgcttaatgaaggaaatcagacaccaaagattacatattacaggataattatatgaaatgaccacaaaaggaaatttacagagactgaaagcagaagtgaacaaaggacttgtcagaattgccagtactttctattctagctgcaaatcccgataaaaggttctctcactactgttaggctacttttccagtataatcttccatattcttcacttaccagttgaactttgtgcttattgaagttctgttgtatttttcaaacctgtgtattcgaattgtacttattattaatatataattaatattgtgtaaattgataaaatcttgtgaaaaaaataaaattttttatttggcaagctagattggatgctttggaaagacttcataaaagcaaatggctacatactggtttgaattaagtgtaggtaatttaagacattagagtgaaaatagtaaaaaaaaatctagaaggattttacattcagattacttcacaaatgcctctagttcatgcttcaccttaatgaaactgagctaggaatgctagacaatttattatgtatgagtgtttataagtacactatttgttttctttttgaaatggggtcttgctgtgtcatccaggctggagtacaggggctggctcattgcagcctctgtctactgggttgaactgattgttctgcctcagcctcccgagtagctgggactacaggcgcgcaccaacatgcctggccaatttttgtatttttagtagagacagggtttcaccatattggccaggctggtctcaaactcctgacctcaagtgatccgactgcttcggcctcccaaagtgctgggattacaggcgtgagccaccgcacctggcctgtatgtatacaatattgagcttcagtcacaggactcattttcaaagaaagtcctgatgtctgaatgaacgtttatatttttaaattaaaatgttcaggatgcaaatgtgtgtatatgtttaatagtttccctgttttactacctgtctttagccattcagatagtgtttttgatcacattggttaaaaggtattctcctgtctctggtgcttttctgtacaatatatacttatatgtagaacttagaaaaatcaaatgtgtaaaatagtttaagcaataatagtgattatttttataataaaagggattcttgttggtttttgaattattaaatttatgctagtttttattatgtacatattgttctgtgctgagaagtaaaacacgattagttatgacagtaggaaaaggttgggcctggaggtcatgtgagatgaaagaggaggtttacaggcggtggctcacacctgtaatcccagcactttgggaggccgaggtgggtggatcacgaggttaggagatggagaccatcctggcccacatggtgaaaccccgtctctactaaaaatacaaaaattagccaggcatggtggcgggtgcctgtaatcccagctacttgggcggctgaggcaggagaatcacttgaacctgggaggtagagattgcagtgagccgagatcacaccactgcactccagcctggtgatagagtgagacttcctctcaaaaaaaacaaaaaacaaaaaacagtgttagccatcaaaagcaaggagggaggctgggctcagaggctcgcgcctgtaatcccagcattttgggaggccaaggcgggcagatcacaaggtcaagagatcgagaccatcctggccaacatggtgaaaccctgtctctactaaacatacaaaaattagctgggtgtggtggcaggcgcctgtagtcccaggtactcacgaggctgaggcaggagaatcgcttaaactcgggaggcagagttcacagtgagccaaggtcacgccactgcactccagcctggtgacagagcgacaccccatatcaaaaaaaaaaaaaaaaagcaaacaaaaaaggagggacgtggtcagagggaaacttggaatttaagatcttgaggatggaagtgtgaagtccaagaagttcaaagtcatcaataagcattttgaactcatcaaaattgatgttaagatttcaaaaatgtgatgtgagcttgtgctgagattatatagaatgtagaaatgtgagcactgaagaagataatataaaaaatagctttccttgttattaggtgttaaaccatcatacaagatgaatgaaaggagaaggttggaggaatgatgtcatatgaagcaagaactgcacgtggagaatttaattaaaattgtttggggccgggcatggtggctcacgcctgtaatcccagcactttgggaggccaaggtgggcagatcacttgaggtcaggactttcgagaccaggccaactgatgaaaccccgtctccacaaaaaaataaaaagattagccaggcatgatggtatatgcctgtaatgtcaactactcagaaggctgaggcagaattgctggaacccaggaggaagaggttgcagtgagccgagatggcaccactgtactccagcccagacaacagagtgaatgagactccatctcaaaaaaaaaaaaaagtttggaaagttgattagtattattctggttacattgttaatatggtagagctctgttcatgttcaccttatcgttagctataacctgtagattcatgttcaagaatctggtgaaagatatgggctttctttccaaagtacttaagcgtgaacaaacatataacttaataattttagaaggctcacagacccaccaaagcccagagagatccttgctgagacgagaaaggaattacattactaatccttctgtgcattacaaaaaacagtagttttatttcagtgtattttgctatcaatatggattttcaaggaatgcacaacacttctggattatctgtgctttataaactgagatatctgtaatcatgttggtaagaacttgaaagtaataatctgtttgaagtgacagtaagtagaggtgttttaattatgtaatacttaatgctgctctattttatgcattaaagccttttaaatatttatcagtaacaatcaatctaagttgtataaatccgtactttattcaactctcagttttacttcaaagaatatgatcttcaactacagtatttaagaacgaaccatgtttgagtatgctgtagctttggggagaaagtgtgctaccttactatttacctttttttactctgtttttttcttcctggctatgatgcttactttttaccctttttctttaggtaaatgggccaccatttatagccattgtcaattgtaaaaacttaactttatataacttgagaggtgctggaaagttgcacattgcttaagatcatttgaagtgtttctcacctgaaaaatgattgcttttggaattttatttcctttatttgttattgtagcacacaataattattatgctcacaagaactgtactcatatttatatgactttaactgtaggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacaggtaaaatttctctctttactcttgtggttttggttttagtgattatatcttgagaacgattcactgtcttagttttattaaaataaataaaagtttgaatgttgagcacattgggaaaatcctcagaaacttagtatcagagttaacagttacccaaaatttaatttgaaagcacacatcttttatatttttagaagagactatcctaagcttttatttaatatgcttttcagctagccgtcacttttggcttttcatttatttttcatgccagcatttttttctttttttctgtgtaataacatttgtatttttttttctttaagggcttttgtctgtccttcattcctaacatttttgaagaaaactattgaacatagtctaaaatgactaagaactcctgtgccccttttaagtcagatttcatcccccttcataacaatgattgcagtgtcattttggtgatgctgcagctaaagtggcttgaaatgcatgattttttttctctccttatctgttttcagaacagctgttggatgaaaacgtgtaaagttctttttatttcgtctttggtgcttgatcagcattgtccaaaatccatgtagtgcaaaaagttatattgcccaggagtagctgtatattggacccatgtctggcagtacagcttaatctgcctatctccctctctcccttcttccagataaacagcctctctgtgttttcaaatacatagaaatatttagacattttagagtaagaacaccttgagagaaatagctgtgcagtcaagatatgctttccaacttaaaattaggctaaatcctttcgttttacatgagtggcctattggagattggtcacttcagtaagagttaaatgtcctgaagatatttttacctactcctttttgtaatttttatgtgaatttttaaatgtaatttaattatcaagtgataataacttttttcgacagaggcgcaataagaaatgcttgccagatgttaatgattttaggtctcgaaggaagatcagtctatgaagaagattttgaggctccttttttggaaatgtctgcagaattttttcaggtaatccgtgaaaatgtaaataaataatcttttaagatgttcttaatgttatttaatatagttactaatttaactattttgaccttttttaactgagacccattaagggaggggagtatgcaaaaaatgcccatcagcacactacctcacattctgaccattccagttaagcaactcatcgataacaaattgaagaggttgaacttacacacatggtttttaaaataacagagatgacccttgaacagtgtggggcatagggatgctgacgcccctgtgtagtcaaaagtccacataaaacttttgactccccaaaaacttaactaatagtgtgctattgactgaaaaccttacagataacataaacagttgattagcatatattttgtatatgtattgcatattgtactcttacaataaagtaagctagagaaaagaaagtgttattaacaccattacacggaagataaactgtaatttactgttcactaagtggaagtggatcatcagggtcttcatcctcgccttcatattgagtaggctgaggaggagtaagaagaaggagggcttgatcttgctgtctaaggtggtaggggaggaagaaaatccacttcatggacctgtgcagttcaaacttgtgttgttcaagggtcaactgtatgttatgaaactgtaaacttagaaatatccttaactttttactatatctaatattataaattatttaagtactataaattcacagcagtacatcaccaacgaagtctcatctgcaggcttttagtcacttaaattactagtaaaacacacataaggatatggatgattctgtagtgcatatttgcctaaaggttgttgattaaaatattacaggccaatggtactattgatagaaattggcaacagtggtccaaaccaactaaattgctaaaagtaaagctaaactggtactaatctgtaatgaaatgatgataacaacaataattgagtactagtaaacataagatagtagttataaggtaactgtaacaaggcatttttcctgaaaaccgtaactacctgagcagttaacagtaggaattttgtagtgttgccaaaacagatgtattcgtaggaagctaaagtgttggccgggcacagtggctcacgcctgtaatcccagcactttgggaggctgagacgagtggatcactatatcaggagattgagaccatcctggctaacacggtgaaaccccatttctactaaaaatacaaaaaaattagccgggcgtggtggcgggcgcctgtagtcccagctactcgggaggctgaggcaggagaatggtgtggacccgggaggtggagcttgcagtgagctgagatcgcgccactgcactctagcctgggtgacagagcgagactctgtctcaaaaaaaaaaagaaaaaaaagatgaatagttatttaaaagctcttattttcaaactttagtgtacatgtttactctttgagactgggagtgggatggcactggaagacttaattaaccagcagtatgccagcaaagcttatgataaacatgatgaatctttctggttataattttacattaaaacaaatcaaaaaagaatgtcccactgtatcttggagtcagatgcttctaagcttttgaccctcactggcgtgtatatacttgttctgctattttttggagtacattggcacagtttgaaaaacattgcttacagataatgttttaatttagtattatgtaaataccaaaggctttaaaggatataattcagactatatcagtctttcgtgtaatgagaaattacacaaaatgctaatagtacttattttatttaggctgatttattataaacactgtagaaacccagctaaaagcaaaaacactcttttcttctatgtttaaaaaatatatatatttttaaatggcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaaggtaagtgttaccgattgaaaaataattaaatccttactctgccttatcgatatttttaaaattttcctacaattaaagcagataatatcagctttcaagaagttttggtgtgtattgttaatttgtctccattgttaactttaatgggatttccaagcttgattctgtcttactaacgaagattttagatatttctaatgaattgagcatttcctgtctttaagtctcattttacatttaatccagaagataaaaggtgtaatagtattggtgagcccagtgagctcctcattcattcctgtacttcctgtataccaaagggtgtgggctctctttagtcctacatactctcttggggttttgtgattctcttaaaaccttaagtttccaccttaagatttttgtagactttcctttgggatttagttgtgacagggtgctgaaaatgcaaaaatatttgtgtcttccatattgacatacttagataaattagattggtttggggaacactgaagttacagaatggaaaaggaggaaggaggagtgcataaaagtaaagaacatttttgagataactaacatttgttttttatagctatttattttcctggggtaaaagaaaaattgtgacaagtatcctagaagaaattacaagttaaaagaacaataaccatatcctctattcttagtttctgatgctttgttttaaaactttgcctttaccacttatatggtattaggaaataaaaaacatggtactttgttctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttttaaaattgttaaatgtttgtatatatgagaaatccctgaaaagttatatgtaatttaaaaaaacaaaaaaaaaacaaaaaaaactagagaggcttcctttttaaaagactcttcagttaaaccttttttgtaaaagccaaaaaaaaaaaaaaaacagaagtcatctagtatatttgctgtgttttctaaaattgaggtccaagtcaggggttggcaagcttttttgttgttgaataaaatggcttgtgagccacgcagtcatagtgagaaaatagtcctagacaataacaaatgaataatcctgtgtttctataagactttatttatgggccctgaaacttgaatttcatataatttttatgtgtcactaaatagcattctttacagtttttcctcagccattaaaaatgtgaaaaccatccttagttcatgagctgtacataaatagatggcaggctgtatttgccccacgggttctaattcgatgacccttctctaagtggtctctggtagactgggactttatgcaaagcatttgccctgcttaaacaaaatgagtattgataaattatgtaatgtactgtttaggtattgaatgaatgctttcttacctaccttaggggataggaaatgtttgatggagaggttgttgggcatacctgaattacagcatctctgtaacctgtgtggagatgtatgtaaaaggtgtcaggtatgcctatcatggcgagcacttacgtgaatgaaggaataccataatagtactcaccagagttctcctttatttagtaccttaggtttccaacaacacagtagctatctgtgattctaaattaaattttaaaatcctgcttttgtccaggcagggtggcaaacgcctgtaatctcagtatttttgggaggctgaagcaggtggatcgcttgagctcaggagtttaagaccaacctgggcaaattggtgaaaccctgtctctatgaaaaatacaaaaattagctgggcatgatggcacatgcctagtcccagccacttgggaggttgaggtgagaggatcatttgaatctggctggggaggtcaaggctgcagtgaaccaagatgatgccactgcactccagcctgggctacagagggagatcctgtcttaagaaaaaaaaggtgggggggttaatttttctgagcttccgctagaaacctggtggcaaaatatcctaattgtggtaggccctgctcttggaaaaaatgttgctcttgttgagaatatagcagagccaacttcaccattatgaagccaaattctcataaatcagaaaatgaaaaacagttttctcactgtgaatggaggataaattggattgattattagatgcagatagcactatgaaatgaagttcagaggtatctttttttttttttgagacgaagtcttgctctgtcgcccaggctggagtgcagtggtgggatctcagctcactgcaagctctgcctcccaggttcatgccattctcctgcctcagcctcatgagtagctgggactgcaggctcccgccaccacgcccggctaattttttgtatttttattaaagacaggggggtttcaccgtgttagccagggtggtctcgatatcctgaccttgtgatccgcccgtctcagcctcccaaagtgttgggattacaggcgtgagccaccgtgtctcgccagtatcttattattttattaagtgtatgtagaaataatgatatttaatttttgcatgccaaattattttcatttacttttacattccctttaccccaacatttaaatacaatgaaattgtagtaatttatgtacaactaaatacacaacatgtaatatctaagcaaaacttacaacaacataggattgaaatagacaagttgtgaaccattttgttagaagtatttggtgtgccacatttactgtagtatgtgtccatagattgttgcatttgtaatacctgttctaaatatgggaaacttggttgtaatttatgctaagtatgtgagaagctataaaattgccatgtgtaggttactatgggcatatattattaatggaaactaactaaaatttgctgctgaaagtcactgaaataaagtttagtaaaactttgtaaatcttgctttgaaatattttaaaaatgtatacaactttaagctctaaactactcttagaactgtagaccaaggtaggcaaattagggcctgcctggtgcactaccagttttgttaaaaaaaaaaaaaaaatcaagagtatttacacatgaaaatttatataaattttcagggtccatgaagttttatttgaaacatagtcacactgaataatttatgtattatctgtggctactttcttgctacagcgtcagagtagttgagtcagagctctatggctcacattttaaaatatttattatctgatactttacagaaaaaacattggtcagcctctgatctagaaactcttaatgccattttaaaaagttattgattgtaaaacttttaaaattatcattgtaaagttctgacactgtgttctcccagtaagttgttattgcaaagaaacactagacatatgggaaaactgtattttaaaatctgtattttagtcttgtgaaaaatgatattaaaaaatggataggatccagagttttcattctaaatttaaaaagtatagtgagatagaccaaattttgaagtacagatattggcttaggatgctacctgggaaacattagggattgctctcaggaaaatattgaagaagtggtatttatattatacatttcataaaaactttacctgaggtgtaatgaagtaaatcctagtatagttcatttgatttgttttcatgattatcagttaaacctttggaaatacccataagacttaaactggctttaaaatttcttcctcattacagggactaccaattacctcttaattagtgaccctttttgtagacgttttgtagtgtcattaggtctgcattagagttatgtaggataaagtatttatgaactcaaaactgcagttgccatgtttttgtgacattacttgtttattatggtttttgacatctcttccatgtaaatttaaatttgctaggacatttaattgatggtttcaaagcatctcatctaaaagttgtgttttataaattacaataataaccattaactagcctacttcttcatgttttcatatcaatatatgtatatttttaatagtcatgtggtcagcaaatgggggtaatggagaaataagcttctctcagtattatagcgtgaacagagattcgtgtttttttctttaatctttaatgtagccaatttgtgttttctgatttgtagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccaggtaagtaaacccagaagattctctgtgtttatgataaaggcattttgacaagtgctaaaaaggccacttttaccatgctgtgtattgtgtactttcaacttaattgtcccagtagtaaattaatatttgtaattatcctacatattttaggattttgcaaggtgtgcgtatttatatcagggagctaaaattcagctgctacttttcatttaacttctttgatgaagaccttgtttaaatagcctcaatagtgaatgtgaggttctttggtatgccttagtgtttgtatactgtagtatattggaaaaaacaactggtttaagtattttttgtttgaaaatgttttgttttcaaggagtactatgaataaattatgtgccatgttttgtgttttaacataatcagctttttttggtacattttttaagctaatttttttcactggctaacccattccatcaagacaggagaatgagaaacagtgaggaggttctttggttcgtttgcattgtattaatacatatatggaagttataatacttctctcattgacatttttaatagaggcttagatataggcttgaaaataatatcaaaactgtaagtttaaaaatgaatatacatgtttattaccagcaaagttaagataaacatacatggtcataagtgtattatttatggaaaaattattataatgtgtcctaaattttgtttttatttctaagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaaggggtaagtagtaatgcatttgaaaataacatttaattttatttaaagatataaaattatatgtaaaattaggacatttcacagataaaaattaagcatgacccattgctgtgcttaaatgggtgccatggtctattaaaaaatattgtttgaaatacttgacatgcccaaacgtagttagacatttcacttaatgtgtaattggcttcaaaaacaagcaactggatgggcttggtggctcatgcctataatcccagcatttggggaggccaagacaggaggctctcttgaggccaggagtttgaaattagccttgttaacttagtgagactccatctctacaaaaaaaaagaaaaaagaaaaaaattagtggcacacagtggtatacacctgttgtcccagaagctgaggcagaggatcacttgagctcaggagttcaaggctgcagtgagctgtgatcgcgtgactgcactctatgctgggcgacagagcaagaccttgtctcaaaaaaactgaacaactgtccaggtatggtggctcatgcctgtaatctcagcactttgggaggccgaggtgggcagaccacctgaggttgggagtttgagaccagcctgaccaacttggtgaaaccccatctctactaaaaatacaaaattagctgggcatggtggtggatgcctgtaatcccagctactcaggaggctgaggcaggagaatcacttgaacccaggaggcggaggttgcagtgagccaagatgacgccactgcactccagctggggcaacaatagcgaaactccgtctcaaaaaaaaaaaaaaaactgaacaactacacagctgtagttggtaaacagtcatttttatgactgagagttaggcatgctgaagataaagaactagaaaactttctagtagagagtgttgtttgctctcatctggttctgaaggttatatgtcaaacaataattggatgccaagaatattaaggcatagatagagtagatctcatctcagaaaatggttggtgtagctcaatttcaagcctttgtgatatatgatatctctggaacctgaggagctcacgacagcatagaaaatcaactgaagcataaaacatgctcacatctgaattggtctcttttgacttcattttggaatttgtgacaccaaagggaaaagcaacatgtcgtcacaggttttacaggcagtagctgcaataagggaacaaaatcactaaggttgcacagaatagaaaagtctattaatttatgcattcatttggtcttccgtttttcaaatatattaatacaacctgccacagaatccttttgcccttatttaaaagtaagggcagccaggcacagtggctcacgcttgtaatcccagcactttgggaggcaaaggcggcggatcacctgaggttgggagttcaagaccagcctgaccaatatggaggaaacccatctctactaaaaatacaaaattagccgggtgtggtggtgcatgtctaatcccagctactcgggaggctgaggcaggagaattgcttgaacccgggaagcagaggttgcggtgagccgagatggcgccattgcgctccagcctgggcaacgagtgaaactccgtctcaaaagaaaaaaaaaatagaaataaaaaaataaagtaagggcaatggcctttttactgtttggattataacaaattattgccttttgtttgcacagttgaggctttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaaggtaaggtgtgttttagatgaaatagagtgcacctaactgaggtttattatgattgtgtactgacaacgtgattggaaattaatttggtagattattaagtgtttatttctagaaataaaggtagattgttttggagaagaacacagactacactaacatttgttcaagttcagggacattcagagtttgctggaatttctgttggtgtgtcaggatacattcatggaggcctggaagggaggattagtaaaagggaaacaataaagaggctatgctgtgtagttctttttcacaaagtgtggtccatagaatacttgcacgtgaatcacctgagatgctagttaaaaacagttctgggccctgcctttcatgggggtatattggaatctctgaaagaatctgggaatttgcattttaaaatcctaaagtttgataaccacaggcacagagcaactgttggaaaaatttacaggaagattatcagggatagcaataacatgaaataatttatttctttctgtactttctcatagaaacatctaccatttatttgtgtatatttgtgtttttcctccacagactgaatgtggatgtcagttcacgtcaaaactggaaggaatgtttagggatatgagcatctcaaacacaacgatggatgaattcaggcaacatctacaggcaactggtgtaagattctgcgttaatttctacttagatattcatgtaaagtcttttgtaatgggtatattttcatccacttagcagatgacagttgtttctttaaatgtcattagtgacaacatgtgttttatctgtgagtacttaattttccttcacattgcctcttattctgtgtttatgttaaaactttttattcttttaaaatttagttgtttcttcccacttgaaggaatacactgacaatttaataaagagaattattctgttgttaataaagataatacaaatctattataaattgtggaaagagtactgggcttaacacaagtttactgagtttcagtactcttcttttcactttaccccaagattgtgtcatcttgggatagtcacctgaccttcctatacctcactactattattctcctctgtaagtttagcttaaatgggacttacatcctaagggtgcgtagcaggtgaagtgagactataaaaacacagaaattaatgtattataaatgtgtttggtataactccccaaaggtggtgagctggaacttctttagctttggagtctgatgggagttttatgagcatttaatgaaattcagaatttagtttcattttttactctgattttcaacttaaccttaagtttagagaattgtacagtttttaaatttttaaaatcaccgtgtaccactctatggttaaaatgtgtcacaaccatttaacagatttgtgagtcttttcctttggtatctaaatatgagatcatcacttctactggccttatagtctcgcaaaccagatacgtgaaaatacgtaattctgtagaataaccattcatttctatgaaaacattctgactctaatgtaaatagttgtatgatttgctttataaatatcagtgtttacagtggagaagagctgagaggaggaaagatgcaagtccatgacagaaatttcgggtggacaggaaatagtggtgtaattatcctggatttttatttttagattgtttaggaatttatagttaaatctaatatattgatatattttcttgtatttttttgtttgctctagtaagtttttaaatttttttcttccactaatcttacacattgaaagctatagggaagattgggctagatcccatgcatattgatatgggatggatggactgtccactttgtgaccctcccttcccctaaccaacttgcgaatgtataaacagttctccacctcccccagtacaccatctaagagtctcctctatgatcctctcttctgtgcatcatccaagtttattttcagtttccttaaagttaagtaatcatttagtggatacttgtgaagaaatcggagtgtagaatgcttcttgatattcataaactgattcctccccttaaaaatttacattactaaatcattgaggtaagataaaaatggaatgatggtttataacacatcctgaatatcaataatagaaataatatttaatctttaagagtttttgttgtgccttattgttgtttacttaaaaatttaatttgtttaaaggaagaaaataattgtgacagttgatactagcatagaagtagttattcattgtacagatatttgtagagcacctgctctgtagcactggatctatagtgttatagcactggatctgtatgcagaggttgttagaatgtgagctacatgctaaaacgtaaaagttttaattaactgtagttgaaataggtgctggaatattagaaatatgtattaagatagtaaaaatattttaaaactgagacgaaggatattatgctagaattttctctaaaatgatataattgaccctccttgaccttttatttaaaaaggcccaaacttttcagttctcagtgataacagtaagacttgatttatgtgccaaaaactattctttggtcagtgtttttaaattaacataataagcaataattaagctatttgccatgtagttaaaatttgggaaacactgggtgggtctaacctttaaggaaatctgtttttttgccgggtgcgatgtctcacgcctatagtcccagcactttgggaggctgagacgggcagatcatctgaggtcaggagttcgagaccagcctgaccaacatggagaaaccccgtctctactaaaaatacaaaatcagccaggcgtggtgggcatgcctgtaatcccagctactcgggaagctgaggcaggagaatcgtttgaacctgggaggcggaggttgcagtgagccgagatcgtgccattgcattccggcctgggcaacgagcgaaactctgtctcaaaaaaaaaaaaaaaaagaaaagaaaatctgcttttttttaaattagatattagacatggagctaactgctttggtaaatctaacacaatgtctaaacagaacagaaagcaaatcctagttaattttgaggggaatatctctttctgttttacataggtatctttaggtggtgttgatcttacagtccgggtgctcacgacaggatattggcccactcagtcagccacaccaaagtgcaacatcccaccagcaccaagacatgcttttgagatattcagaaggtaaatcaaaatcagactttgtatcactgtgtacaagtaagtgttcaaaattaaaaatgaatttgaacattagtatccgtaattgaggatgaatgtattccatttattacctcgtgatcaaaaggagcatttatcctggcatacagcaatttccccctctataggatcttgatgagtaaagtaaagcaggcataatttatctctagaaagattgtttatatgctggcatttgaaatgccttttatttagagcagcagtaaaaatggaaaaagagaaagtaaatgatgatggaaaactagacccagagaattccttggacttttctgaacacttcagctaactccaattgttggaaatacgtggataccttattcccactagtactcagagtctctgagatggcagttttgatgaggaagaggagcaagatgaaaaaaaaacaagagtgatatgcaagaaaaaaacagagaaagatccaagcaaatattttttttgggctgctgaaaataattggcttatccagtgtggagactgctttgtgaaaagaccactcgtgtgaacactagggatgaagatgagtgtatcacccccttcatcgagcagcctaaggtggacacttagacattgtctgtgagctgattgcacaaggggcagaagtttttgcagtgaccgtagatagctggacacccctgcagggtgcttataagtggaataataccagagtggcttctttatttcttcagcatggtgtagattagttatcagtgaccaaacaaaaggtctcttgacccacttgcatcttgctgctgggatcagagacagcagagctactctagaacatctactggtgaactgttaacctcaaaccagatctgaaaaaacaactgggaagaaactgtatttgatattgccaggaggacaagtatctgtcacgacctctttgaaattgtggaaggcactgtacaaattcttcaccttagtcttaatgattctagtaattgtcttaagtgtccaagtaccagtgccttctttgtgtgagatgtaaaatattcccatagtaaaaggttgacatcaaacatcttactacaaaaaattcattggtacttattaagatgttcttccaggtgaattgcctgaccttgatgtcaaaatgtatttgaaagttgtttgaatatatcttgaatgatttctgtggagtttgtgatttgtatcagaaataatttcgacttgcctacacttaaaaacttgacgtgggttgtacagaaactaaagatatttttggtgctgatccaggagatacgtatttttaaatagcccatatcctggatctttgttgagtattcagcatattgacatgtatctttgtaaggtgaagtaactaagaatttaacttaaaaagcctcgaacattctggtgctattcctgctgtcttctctacattaccatagccagttgctttcattttgaaccagaagcactagcatattattgacttgtagcttcataaattaaaaaaataaaaactagattttgtcttttagaacataggccattttccaggaaagcagctaggttttaatccattaatcttgtatactgtctccaccaccacaattcacataatcctgtagacagtcctgcttcaccctggtcaactgcatgatccttattgtaatagtgaatcagtataacactttagacatgcacacagataacacgctgttgcaagagttcatgatatgtctgctgtccaactagttttatttgcctgatcctactggtttaggcactgcctatagtctcgagttcacagaaatgttgggttttttccctccccaaagtcctcattttttataaactgtagaaaggcaaaatgacaagggaaaaggaattctaagagtgaagggatgattgttatattggggcaagaaccacagagtggctcaggctttggaaaaaatatggtgtggatagtgacaaaaaacataaatataaaaattcaagaaaaactaccagttttgaacaacaaaaacaaagggagagtttatcctttataattttaatatgtaagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaactgaacttgattcctaaagtttcctttaagttttaaagtccatacacacacacacacacacacaaatgtttaagggatgttatcctgtagtttgtaatttcaaatgtgtaagtttgtttgattttctaaaacctggtttgatttactgaaggttctacttagccaaacacagtggtcgacagctcacactccagcatcatatgggttctgcagatctcaatgccacattttatggaccagttaaaaaggtaaatattgatagtttgaacgtattaagtaacttaaagttagtctattagagctgatgtgtgatttatgttgacctgggtaaattacttacttctgtttctctgcctgtctcacatgttagaaaggttaaaaatcctagctttgatttattacttctgttctctcagttgctaactgcacctttgaaaatatgaagactataccagtatagtcttccctaaggactaaacattaggataattacatattttattcataaaattaggtttgagaaaatattgcataaaatagtaaaatgtaagttgatttcagtgcatacaaagccatgagccccttttcaaaattctgtcacctataatctttatttctaataaatcaagattgggaaaattaacatttgtgatttgttagatatataaatgttattaaagtaatttaaaaaattagtattagaccagtgatttgccttcatttttaaaaagcaatcgcatttttatatctagattgtgaggtttagagtaataatttattttcattacttgatatgaatcaggattttttgccttcagaaaatattaagtcttctagaaaaactgtagaaatatacctaaattgtcatctaggaggcaaataagctttagattttaatgagaattttactagtttggtatgatgaatcactgttaacatcagattaagtattgctgaaaatgcccataaaaatattctaattttgatatttaattgaaatgggaaatagtgctttataatttcgttaaataatattcgacacatatttaagtgtaagtgggaaggacaaggaaactaaagaactcagcttttaattactgcctgcttttgttttaaaagagggttttttttccctaaataatcatgttcttttgaagtttattaagcagatcagtagatttttaaaacatatgcatatgttaattattgaagaattagaaagttccactttgtatcccttaaatcgtaaagcaggaataggctttgagaatggcagttcccccctcctcccccagcccccatgctatgctatgctattttttgatctcttactgtgatcacatcacacagaaagaaacctaatcctgttacttttggtggtagtataacagtagtggtgttttgtaagtctattattattatcatcccatagtgtactgttaaaataattttagcattaaatacagggaattgattagttacttgttcagataacattaaaatgttcacaatggggggacaagggacagtcctaaatactgtttgtgtgtgtgtgcacacattttaagaaatagatttcctttatataaataagttatgtagttttgttgggggaggatggagattatgggacctatttctgaaacataccattaaagttaccagaaaattggtcaggcgtggtggctcacgcccataatctcagcattttgtgagcctatgcgggcaaatcactggagcccattagtttgagaccagcatgggcaacatggcaaaaccccgtttctacaaaaaatacaaaagttagctgggcatgatggtgcacacacatggtcctagttacttgggaggctaaggtaggaggattgcttgagcccaggaggttgaggctgcagtgagctgtgtttgcgccactgcactgtagcctggatgacaaagtgagaccctgtaacatacatatgtacgtacatacatacattaatgttaccaggaaatgattgtgtctttgtttatatttttttaaaaatgaaacaggaagatggatctgaagttggtgttggaggtgcacaagtaactggctctaatacacggaagcacatattgcaagtttccactttccagatgaccatattaatgctctttaataatagagaaaaatacacatttgaggtatggattgtggttatatacattttaactgtgttgtttctaactctcacttgttacttgagtctttcttatttgaataacctttagagagtctctttgggtacttttagagaaaactgtataaaatggatcatggaactgtatgaacatcatacatgtattgagttatgtcttatttttaaattaactttatagaagtacttttatataaaacataccttatataagtagacaatttgatgagttttaaatgagtgcatctttgtaactaccatcacaagaatattgcccgaaaatacagagcattacctccaaaattgcgttgtaccccttgccagtctattccctcctaccacctccagccccaggcagccagtgacctgctttatatcactataaattagttttgtttttttttagactttcatgtaaatggaatcatacatgttgtctgtatgctttaatcctttgtcagttcacctgcatttgggttgataccggatttaggctaagtagagctatatgtttaacattttaagaaactgccgaactgtatcccaaagcaactataccattttccttatttgccagcagtgcaagacggtccagtcgctctacatcatctgcagtctttagattttgagccgctttagttggtgtgtaatagtgtctcattttggatttaattttcttttttttttttgatgatgatgttgagcatcttttatgtgttaatatgccactgatatatcttgtttggtgaagtgtttgtatcttttttgagttgttttcttactacattgtaaaagttctttataaattctggatacaagtccttcgtcagatatatgtgctctgagtatttttttcagtctgttgcttgccttttcattttcttaatggtgtcttttgaagagcagagttttaaaatactgaaaaagtccagttaatcactttgctttttgtagtttgtgctttaagtcctaagaaattattgcctaccctgaatttgtaacgatttacttttattttttcaatagttcgtaattttagcttttacatgtatgtctacgatgaattttaggttaatttttttatatagtataaggtaaggattaagatacatttcccctcacgctgtcagttgtttgttccagcatcatttgttgaaggcactatttttttcccaccgaattaccttgtcgtcattatttaaaaatcaattgatcatatatgggtgggtctatttttatgctgtctgatctgtttcattgatctctatgtctgtctttatgccagttttatgctgtcttgatagtgcagtcatttttctctttgcacccatcttttttcattagagtaactaattttataatatgcttttttttccttttccttttctcccaattaaaatatgatttgattacattaaatccaattagtcttttcctgtacatttaaagggtgttttggggttaaaatgaaggtcatgtgattcacattaagtttaaatttaaggtaatgaatattttgaaagactcaaaattaattccatatttgtacttaattgaaaaccaattttcatatacaggtgagcacaagaaaaaaaatagtgtgtttgaaattaagagcaagttctaggcctatttaatattcatgtccatactcccatttatgtatcccatttatatgggagtatggaagttagtataattaagagagccatcatttttatgtgatatatttaaagggaatgcttgaaatctaggtattttagtagctcagtggctaaattgagaagtttttcttatggatttccatgtgggtcttacctagggagtaaccttgaattttttttacttttatttttattttattattaccttgattttcaagcatgagttatatttgattgagtcccaagaatactgattaagcaagcgttgagtaccttacccaaacctaggcttttcaaacagaggtggaattaaattatctctaacagctgtttttgtgtagtcatttttttaatctgcggctcttaatggataaaatattttaaacaaaattagctacttggtaaatgctagagttgattttcagagtcctggcttataaagacctggtaaaaaataatgggataataaaaaatacgaattcattttttaaagctgttactggaattgctggaaaatttagtggttcaagcttttccttttcccatctgacttggaatcattgatgctaataagcagttattagatggaaggttaaaattaagtagagaatatctgtaagttttccaactttagctaagtcacaaagcagaaactgattgtagtgtatatagaatgccatgcctatggctccaaagccttctggctgctgacacctcaaatctggggcattgtgagaaggcacaagaaatgtgtctttactcaacaccacgtgtttctctacagtctgttgctaatgttttattagctagcctttttaaagaaatcacctccacaaattagtggagatagttaaaagtatttaattataataatttaaaggaaggtgaacttttatttttgaatattctgtgtgagttcagtaagatggtgtattgtttaatgccacatgacgaatttcaaaagttagtgatttaaaacaaccactaacaatttattatctctcgtttctgtgggttagggattgagaagatactcagttgggtagttctggcttggggttcatgaggttgcatttagatgttgtctggggttctggtcatctgacggtttgactgaagctggagaatacacttccagggtggttcacatggctggcaaatttgttctggatgttgttaagtggccttagtttctctgcacatgggccttttcatgtggctctttgtcctcaaatcttggtggctggttttcccaagagcgagcaatccagaagacccaggcagaacctgcagtgcctttttgatctttccctggaagacatgtagtgtcacttctcattttcttggttgcccaagtcagccctgatagtgagaggaccacacaagattaacatataccagggttattacgtgctgtcatagaagctggctacaacaggtggcattaatttgtagtgtcatatttaatctgtagtagtcaggctgctgctgaggttttttcttttcatgttttttgaatgactaaaggtaagtttattgtgatttagaacagctaaaaataggaaatacatacagtggtagtctgtaccttggactttagtaattagcagtgggtttttgaaagaggtatggataagaactattaatacatatttttgttaatgttctttattttttataattttatgagaatgagtctgaaatttaaaaactacagacaatagcactattaatgtcagaatttaaatagaaaacttaacagtagtatttgatattcatcaataatttatagcaatcattagggacataacttcacaatatagaaaggaaaatgaaagtacaagggaaagtagacaactcgagaatcatggaaattccttacaaatttattgactaacctgagttgaaaagggggatataggaaatttgaataacacaattagcaagttaaaattgaaggctgtttagcgaactttgaactcagaaggcaaaatagacatactgctctcaggaaatatctgaggctagcataatttttttgctaaaactgagcaaggaaaatacaaaagagaaagaaagcttaaggttattcatcattctgccttgctccttagattctaatacactgaaagcataaatctcaatattagcaagtcatattcagtagtgtattgaaagaataatgcactgtgttcaaaaaggatttatccctacaatacaaagaaaggtcagcataggaaaactttttgaaaagatcgttattaagatattgtaataattgtaaaaacaagcagttgcctaattgccaggcaccattttaaggagaaaaccatttgatctctatagatgaacaaaaagtatttgataaaagccagtcctcattccttataaaagtgggggactcatcgccaccttagaatggattgcccttaatgccataaggttgtatctgatgacaaactaaatcattgtagtagttagtaggaaaatactagacacctttctattagactgaggaacaagatgaagttgcctatctttactactactattatgccttgctctgcaggtcctaatatactaagaagaagaaaggaatgaaattcataagtatcaggaagaaattgaaaaaattatcaaaatctgtagataatatgattgtcaatttggcaatacatgataatcagtgagaaaacatttctttagaagagttttgttggaaagaaaataccttttcagtaaaccagcattaatcagtaaatgacatgaagaaaaggatgttttattaagaatcatagccttcccaggaatcatcttaacaagaactgtgtagacagggtacttataccaagaagacagtaaaagctaaagaatatgaaagggtaaatgtacccaaatgggagaattacaagttataagtgtgctgtttttaaaagtcacctataaattcaaggaaatctgaaatgaaatgtccaaaatatatatatttttaaataaaactcgacaagctgattccataattcatctggaccagaaaatgcacaagattaggcaaaactacttttgaaaagggatgggtcttaggtaggaaagctcagtgaaaggggaaggaatttgtcctaataacaaaacataccatatcacgtttttttaatttataatttttatgggtacatagtacatgtatatatttatgggatacgtgagatatcttgatacaagcatatagtgtgtaataatcacatcagggtaaatggggtatccatcttagcattatttgtgttatgaaaattccggttgtattctctgttattaaaaagtatacaagttaacattatttaaaatgcatagacagacagctcatttgaacaaaagggagtccagaagcaaactaatatatttgtaggtgtctgggatgtgataaatgtcttttttttttttttctttaaagctctgggatgtatgtgcagaacgtgtaagtttgttacataggtatacttgtgccatggtggtctgctgcacccatcaccctgtagggtccagccccacagggtcggttgtttttctccccttgtgcggagacgagagattgtagaaataaagacacaagacaaagagataaaagacagctgggcccgggggaccactaccaccaagacgcggaaaccggtagggccccgaatgcctggctgcgctgttattggatacaaggcaaaaggggcagggtaaggagtgtgagtcatctccaatgattgataaggtcacgtgagtcacctgtccaccagccagggggcccttccctgtttggcagccgaggcagagagagagggggttagagagagaggacagcttatgccgttatttctgcatatcagagacttttagtactttcactaattttgctactgctatctaaaaggcagagccaggtgtacaggatggaacatgaaagcggactaggagcgtgaccactgaagcacagcatcacatggcatgagatggtatctcattgtggttttgatttgcatttccgtaatgaccagggatgatgagcttttattcatgtttgttagcaacacaaatgtcttcttttgagaagtgtctgttcatatcctttgtccactttttgatggggttctttttttcttgtaaatttgcttaagttccttgtagattctggatattagacctttgtcagatggatagatcgcaaaaattttttcacattctgtaggttgcctgttcactctgatgatagtttccttgctgtgcagaagctcgttagtttaattagatcccatttgtcaattctggcttttgttgcagttgcttttggtgttttagtcatgaagtctttgcccatgcctatgtcctgaatggtattgcctacgttttcttctagggtttttatggttttgggtcttatgagtagttttttctctttctgtgaagaaagtcaatggtagcttgatgggaatagcattgaatctgtaaattactttgggcagtatggccattttcacaatattgattcttcctatccatgagcatagaatatttttccatttgtttggtttgtagttctccttgaagagatccttcacgtcctttttaagttgtattcctaggtattttattctctttgtagtaattgtgaacgggagttcactcgtgatttggctgtttgtctattattggtgtataggaatgcttgtgatttctgcacattgattttgtgtcctgagactttgctcaagttgcttatcagcttaaagagtttttgggctgagacgatggggttttccaaatacacaattatgtaatctgcaaacagagacaatttgacttcctctcttcctgtttgaatactttatttctttctgttgcctgattgccctggccagaacttgcaatcctatgttgaatagcagtggtgagagagggcatccttgtcttgtgccagttttcaaagggaatgcttccagcttttgttcattcagtatgatattggctatgggtttgtcatagatagctcttattattttgagatatgttcaatacctagtttattcagtgttcttagcagcaaggggtgttgaattttaccaaaggtcttttctgcatctattgagataatcatgtggttttttcattggttttgtttatgtggtggattacgtttattgatttgcatatgttgaaccagccttgcatcccagggatgaagccaacttgattatggtggataagctttttgatgtgctgctggattcggtttgccagtattttattgagaattttcacatcgatgttcctcagggatactggcctgaaattttctttttttgttgtgtctctgccaggttttggtatcaggatgatgctggcctcataaaatgagttaaggtgaagtccctctttttatattgtttggaatagtttcagaaggaatggtaccagctcctctttgtacttctggtagaattcgactgtgaatccgtctgatcctgggcttttttgggttggtaggctattactgcctcagtttcagaacttgttattggtccattcagggattcaacttcttcctggcttagtcttgggagggtgtatgtgtccaggaatttatgcatttcttccagattttctagtttatttgcataaaagtgtttatagtattccctgatggtagtttgtatttctgtgggatcggtggtgatatccactttatcgttttttattgtgtctatttgattcttctctctcctttattagtctggttagcagtcttatctattttttaatcttttcaaaaaaccagttcctggattcattgatttttttttttgaagagttttctgtttctcttatctccttcagttctgttttctcttatctccttcagttctgatgttagttatttgtcttctgctagcttttgaatttgtttgctcttgcttgtctagttcttttaattgtgatgttagggtgtcaattttagatctttcctgctttctcctgtgggcaattagtgctataaatttccctctacacactgctttagccgtgtcccagagattctggtacgtcgtgtcttagttctcattggtttcaaataacgtatttatttctgccttcattgtgttatttacccactagtcattcaggaacaggttgttcagtttccatgtagttgtacagttttgaatgagtttcttaatcctgagttctaatttgattccactgtggtctgagagactgtttgttacgatttccattcttttgcatttgctgaggagtgttttacttcccattatgtggtcaatattagaataagtgtgatatggtgctgagaagaatatatattctgttgatgtgggatggagagttctatagatgtctgttagtcgagagctgagttcaggtccctgaatatccttgttaattttctgtctcattgatctgtctaatattgacagtggggtatcaaagtctccccctattattgtgtgggagtctgagtctctttgtagagactttatgaatttgctttatgaatctgggtgctcctgtgttgggtgcatatatatttaggatagttagctcttcttgttgcattgatccctttaccattatgtaatgcccttctttgtctttttttatcagagactaggattgcaacccctgcttttttttttttttttttttttggggggggcgggcttggtaaatattcctccatccctttattttgagcctgtgtgtgcctttgcatgtaagatgggtctcctgaatacagcacactgataggccttgactctttatccaatttgccagtctgtgtcttttaattggggcatttagcccctttacgtttaaggtaatattgttatgtgtgaattcgatcctgtcattatgatgttagctagttattttgcccattagttgttgcagtttcttcatagtgtcaatagtctttacattttggtatgtttttgcagtggctggtaccgatttttcttttccatatttagtgcttccttcagaagcccttgtaaggcagacctggtggtgacagaatccctcagcatttgcttgtctgtaaaggattgtatttctcctttgcttatgaagcttagtttggctggatatgatattctgggttgaacattcttctctttaagattgttgaatattggccccccccactctcttctggcttgtagggtttctgcagagggatctgctgttagtctgatgggcttccctttttgggtaacctgacctttctggctgcccttaacattttttccttcatttcaaccttggtgaatctgatgattatgtgtcttggggttgctcttctggaggaatatctttgtggtgttctctgtatttcctgaatttgaatgttggcctgtcttgctaggttggggaagttctcctggttaatatcctgaagtgtgttttccaagttggttccattctccccgtcactttcaggtacaccagtcaaacgtaggtttggtcttttcacatagtcccatatttcttagaggctttgtttgttccttttcattcttttttccctaatcttgtcttcacgctttatttcattaagttgatcttctgtctttgatatcctttcttctgcttgatcgatttggctgttgatacttgtgtgtgcttcacgaagttcttgtgctgtgtttttcagctccatcaggtcatttatggtcttctctaaactggttattctagttagcagttcctgtaaccttttatccaggttcttagcttcttagcttcttagggttagaacatgctcctttagctcagaggagtttgttgttccccaccttctgaagcctacttctgtcagtttgtcaaactcattctccatccagttttgtgcccttgctggcgaggagttctgatcctttggaggagaagaggcattctagtttttggaattttcatcttttttgcactgggttttcctcatcttcatggatttatctacctttgatctttgatgctgatgacctctggatggggtttttgcatgggcattcttttcgttgatgttgaatgttattgctttctgtttgttagttttccttctaacaatcaggcctctcttctgcaggtctgctgcagtttgctggaggtccactccagaccctgttcacctacgtatcaccagtggaggctgcagaacagcaaagattgctgcctgctccttcctctggaagctttgtcccagaggggcacctgccagatgccagccggagctctcctgtatgaggtgtctgttgacccctgctgggaggtgtctcctgtcagggaggcatgggggacacggacccacttgaggaggcagtctgtcccttcgcagagctggagtgctgcgctgtgggatccactgctctcttcagagccagcaggcaagaacatttaattctgctgaagctgggcccatagctgccttcttcccaggtgctctgtcccagggagatgggagttttatttacaagcccgtgactcaggctgctgcctttctttccgagatgccctgcccagtcaagaggaatctagagaggcagtttggccacagcagctttgccacccgcccagttcgaacttcctggaggccttgtttacactgtgaggggaaaaccgcctactcaagcctcaggaatggtggacgcccctccccccaccaagcttgagtgtcccaggttgacttcagactgctgtgctggcagtgagaatttcaacccagtggatcttagcttgcttgctgggatctgtcggggtgggacccactgagtaagaccacttggctccctggcttcagccccctttccaggggagtggacggttctctctcgctggggttccggctgccactgggatatgaaaaaaaactcctacagctaagttggtatctgcccaaacagccgaccagttttgtgctagaaacccagggtcctggtggtgtaggcacacaagggaatctcctggtctgcgggttgcaaaaactgtgggcaaagcgtagtatttgggccagatagcacagtccctcagggcttcccttggctaggggagggagttccctgaccccttgtgcttcccaggtgaggtgacgccccaccctgcttctgctcaccctctgtgggctgcacccactgtctaaccagtcccattgagatgaaccaggtacctcagttggaaatgcagaaatcacccaccttctgcattagtctcgctgggagctgcagatcggagctgttcctattcggccatcttgccagatctcaaatttgtcgtttctaaaaactgaatttaattgttttttatttgtgggaatgagaagagggtagtattaagacctcaattccatggatcacatcaaatataaaattccagataaatgtgaaaatctaaatataagtgcaaatctatataaataatggaagaaaatgttgaatattttggtaaccttaatgtgagaaatgtctttttaaaaatgtattaccaaaataataaaggaaaagattaacagatttaaccacataagtgataacacatctatatgatgagatacattaagttaaaaatagactaggagaaattacttataacataaaaattgaaaaccataatctataaagagcatcagtaaatcagtatgaaggcaaacaattgagtataaaaacatgaaggaatatagatagagaaagcatagaagattacagatatcctgtaaatataaaaatattttttcccatagtggtcatgagaagtacaaattaaaataatgagatttcatttttagccaaacatgagcaaaagaaaatctggcgttgaagagggtgtgagggagtggatattcatatactatttttgtggggggttaaattgttaagcaacttgaaagcagttcattagtatttatcaaatactaaaaaaaaaaaattttgagacagggtctcattcttgcccagactggagtgcagtggtattatcatgtctcactataacctcgacctcccaggttcaagccatcctcccaccttagcctcatgagtagctgggactacaggctattttttaaatgtttggtagagagcagatcttgctatgttgaccaggctgattttgaattcttgggctcaagtgattttcttactttggtctcccaaagtgctgggattacaggcgtgagcaaccgtgcttggcgcaaatataaaatatttataactttgaggaagcaagtgcatttctagaaatttgcttttgaaaaacaggctttcgtgctcaaagtcagaaatgcatgtaccaacagaacattggatccagtctaaatctccacttgtgtcatgatagaacagtactatggaattccttgtagctttaatctctttttgctagctgaaaaatctgaagaaattaatagaaaaattcatgttatggtctcatttaacactaatactggtgtataggtggatgtgttcgtgtacgttcatgtatatgcatatacttgtattcatgtgtatatatagatgaataggaaaacattgcttttaaaaagtaatttaaatatacaattgattaccagagtgcaggtaaaatagtaatagtaaagataggcatccttatcttgttcctaactctaatagaaagatgtctagtatactaactactgttatgcttaactctctcattatatatacaaccttatgactttaggggcatttcattctgttcttaggcagctaagaattccccactataaggttttaggactgacttttataaaatacttttggtaatagttacctcttgggatgatctgtaatcttaaaataccacctaaggtatttctggttcattgaatatgattaagcaataactaaagtatgtaaataaatcacttttagcatgtatgtaataataaacatcttcattctaataatagcacctattttctgggattagcatttatactatttgaaatgtctaaagtaggtagatataaccagagattatttgaagaaaatgaatatgtgtaatcactgaaaatcacatttctctgaatccttgcctacctgacagttttttaggagaacagaactgttgctcaaagacttgtctagagagaatgactgactctccagatcagttactcgtataatctgaatatcaccatcttcatgcccactcttcataagctgcttttgagaaagagacagatagctgtatacagtgcatcaaagcaataaatcctagtgtcaagacttttactcaatcacatatcactatagacatgtagagactaaatcatataactgtacagtttccttgctgtcccactgacagaatagtgaatttaaaattacacagcattctttcctgagctgctttttctcccctagtattacactttattcataccattcacatcattattcataatacgcagtaaagattattacctgaacttcaaaacagattgcttgttgatatttatgtttaatgtaattccaggtttttttttttcttcatttggtcatagaagcatacatatggtcagtctggatggtaaattttgattgtatggtagaaggcctgagctcaggcttaccttccttttttctatgaaagaaattactaagcaaaagagtagtctggataaacttggatggaagattgtaaaatatttataaaattagcaattatatgttggttaacactttatttttacctaaatgttgaagcaggttcctgataatctctgctggataacatttttggattagccattgtatctcctgaaacaaaaaagtacatgtctttttaatattttataacttgaatcaccctttcctctcgtttgttcaaataatgagattttaatgatgtgtcatagtactcaagagaattcttttttgtgcattatttatttaatggaattacctctttttaactactgcttggtcagtttacttgctaattaactaactttaatctttcaaaaagtctaattatgttaatctgatgaaatttcaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacaggtatctggaattatatttttcctctcaaaaaattatatatttttctctttagaaaaaaaatctcatctattggatttcttttaaaaatactccttttctggtgctgcatgatacttaggcttaagaaagaaagcagcttttattgataagtatttgtatcaaaatgcatttgaatccaagtacagtaagcattttaaaaagtaatttatagtgtgaacaaagtatttcttttcatgtttttcaataaatagaatacagtttatgaacatattggtacttaaaattgtttttaagttgttaactaatagtcagtggaagtctaattttaaagctgatttagaagtttttcagaattgggagacctatataaaagtttgatgtttggatgttgctatttatattttgataaatattttttgtttcaaaatcttaaaacccatatcctctttaatttaaaaacatagaaatgatactgatgtgaatgatttttaatagagccatataagtcgataatgaaaattctattcattaaacatttaacataatgtaagatgcttgttttctgtgtatttaaaggggaaaaaaggcactccacccttgctgattgatgtttaaaactaattgtttactacttggcttaaaaactagtattagataggcttcctagtactaatatattcattacagccaaatatgtgtgcaataaaacagtgtcctaagataaataagatgatcttttaaatgactgtcatttgttgattttaaaaaaatgttatttatattgtatattatgatagtctttttaaaagtaatgttaaatatacagttgattaccagagtacatggattctagagctttatatgcacacttaaatttttgtttttcattttgatctttttgtttcgtatgtatactttgtagaacagagtagtgtctctggcaaggctttgccccctttgtcttgtagttgtaaactgtatcatagtaatctgcattagccaagattggcccatgtcttgacataaatatatattaagaataaaacaaaactgtgctagccagtgtcatggaataaaatttatttttcttccaatgcaagacataactactttatacatttgggcagatgcaggttttggattttagggctcatttgtatcctagaattagaggaaaatatgtgggaatatttatctggattgccttaccctcaccctactgtaccctaaataagtaactgtctttgttatcccagattctatcatgtccagcaataataatatcagatattagtattatgtttaaaaaagtcttcatagatttttagattttcgtgttaagtgtgcacacttatgtgtgtatctggagtatgtgtatgtagtgttttaggtatgttcaaaacagaaatatatatatgatgaatttcactagagcttaaaagttcttttcagcaataaaattctacaaagcaatgtttttttcttgggaatggtttttaaatgatcttggctcttactcatagtttaagtcaaaattttctctttggtggtaaatattgtgaccacattggttttactgtcaaaggctcagtaacataatcaaatattcgaagactcagaccctacctatttatgctgcttttactgtagccagtagtaaaagttcatgcaaagaagttaaaggaattactaaaataacacagcctttgaaaagaattagattaattgtaatctgggggggcagtttccagagttgacagtcttcaccaccaccaccaccaccaccaccacctgcctttctcaaattccatcccccagcgtgcatataggtcatatataggcacttgcacaacaaccccttctgctgcactcaagtgaggagtgttgtgttaggctccagagtgagcccctcccctcccatttaaaaagaatactcattttgactcatcagcacgatctgcacatccatgtttttctgcaggtatttaagaagacacttatttaggtgaccacatccagatgagccaaagggattgtttaaacaactacttttttccctgcaactttgtattttttgttttcaaatccacaaagaaagtgaaaagcactataatgaatatcaatatggctgtgacctacgtttaccagtcattagaattttgtcttcctccctgccttcctctgtgtgtgtgtatgtgtttgctacagcatttgaagttaatttacaaatatctcagtagtttccccctaaaaaactttagcacacgtctcctatatcatatccaagaaaattaatttcatgtcatctgtttaccacccatattgcctcagttgtctcaaaaatttcttttatatctcactttttggatccatgattccatcaagatttccacattacatttaatttttatgtctttttagtttcatttaaaccagtacctctatctttttattttttcatgacatcaacttctgaggaaaagcatcataagcatcattcttagtagattattttcatcgaattttttttttttttactaagatattgattatcttacacttgggaaatgacaccgaaagcagtatttttatccaaaggattctaattagaaacagttgaatggatacgcacaccagaatgatcttctaaattgtacaatctgctgtctcgtggctatctatgcccatgcctcagtcagcaatgccccatgtgctgctttgcaattttacggtttctacctccagaaacttcacatctatctccttttggtgaacgaataaaacaccagttttctttttctgctatttcattcagagcagagttgcaggagaagacgacttctgtatttcccttaacagttgctttgaagactatagggaagaatagagtaagactcctaaagattggaatctggtatgaatttgtgatgaggttgtgacataaaaagcataataaaatatatgacaagaaatggttagataacagaactctagggagatttttggcaaggagattttaggaactgacatcctagtggtacttttaaattatttatttcactgactgaatcttggcagtacatactcttgtctcctcataaagccttagagattacagctacattttgagttagtaagacaacagatacctatctgagataattttggtgagttttaacttggagccatggtaataaaataatcaattgacctctgatagtcataagcaatgaaaattatttactggtaattttactactgaatattttcagctactgtttttcttccaggtaagaaattatattctgcataaaaacaaaatcaactttattatctcaaagttaaattcctcatttttgaaaaggataatttagtattcaagtaaacattaagacagtttctgaatgcgtacttgaattaataagtgtgtatattcagaggctgaaattggtttttatctgtggattacattgaattataataagcttgcttataaaccaaattttaaaattagatttatgataaatgtctttatttctattttagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtgaggactcttcactactgggctaatatagaaaaaacagtaacattattaacaaaattattgtattcaactaattttaaaaacaattttacaattaagaaatcctagtgatgtaacacttatgaaatgtatggcactcacttggtaactaaacatggtgatacatccaaatatgtgcacactctcggaaccaatgtgtttataactaaaatgatagtagaatattgtcacatgaagtattaagaaaagattttcactgctattaatacctttgtgtaaacaaactccctttacttctaaaaattaataatggttaccattcattaaatgctttcattttacaaattgggaaactaaggaggggaagaccccttaggaagccattaagataggtgggagaggattaggacctgggtaaagtattggtagagggtagaaaactgaatcaagataattgggaagtagaattgacagactttactgattgataatgggaagtgagagggagaagttgaagacgccgtttaggtttctggcttgaatgagtagatagaggtttgtttctttaaccaaaaagagaagggtaatgtaatgtgccgctgtggtccagatgtcacttaatattgttttgtacaagttgactttattgtgtattggcacatccaggggcaggtggaagacaatagacatgagggctagaagttgcattgggaattagctatatgagaatgcagttaaaactacaggtgtggattaaattgctcagtgttagcatggagagcaagaaagaactatgggatagacccctcccttattttaggaacagtgagtgtaacaacagaaactctttagagcactggttttcacagtgtggttcttggaacagctaccttagcatcacctgggaactcatgagaaacacagatccttaggttccaccagagcctgagaattgaatcagaaactctgaggatagggcccaagagtctggttttttaacacgagctgtaggtgattctgatgttttttcaaatttgagaacactgctttagaaggaaaagaaaacaaaatgacagtgtcctatgacaagggaagagaattacaaggagtgagtggtcagtaatataaaaaatcatggaaaaaccaagttgaataaacactttggcaattacgtgacaggttaactttctcagacattttcattggactcgtgaaagtggatatccagtggtagtgccttgagaaggaaatggaggtggaaaccaccaagagtggcttattctttgaggtactggctcaagggaaagggcagagagagtagtattagaggattcagtgtagagttgaagggtttgggctttttcccccccaaaatgggaggatactgagcatgtttatatcctatgaataaagaatggatccttaaattgaaaaaaatgagatgaagggataaataccacattctagaaaaggaaaggtgaggattgtatagagagtatgatgatggtagtgtactgacacagatgttactgaacatgcctcttcctgagaacctagggcagggtgcaggggtatgtgctaagcaagatttggtgtaagtatggataaatgtacatgtgtagggtgggtatttaaagaacttcaaattgaaatggcttcttttctctatgtgaaacccgatatgagcttggtgcaggactgggttgaggagtttaaggggattgtcagaaatttgaaataatacttgtcgaagaatggtgctcaggaacttgctgaacttttgaatactataaatttgtgttagtctacaccagagattggcagatgtttttgtaaatggccaattgtagcatgaaagcagctatagataatacataaatgcgtgtgactcgcggtggctcacgcctgtaatcccagcaccttgggaggccaaggtgggcggatcacctgcggtcaggagttcaagaccagcctgacaaacacagcgaaaccccgtcctactgaaaatacaaaaattagctggtggtgggtgcctgtaatcccaactactcgggaggctgaggcaggagaattgcttgaagctgggaggcgaaggttgcagtgagccgagatcgtgccattgtactccaccctgggcgacagagcgagactccatctcaaaaaaaaaaactaataaaaaataaataaatacatgtgactgtgtttcagtaaaattttacagaaacaggtagtggggtgtatttggcctgtgactgcagtttgctgactcctggtgtacacatacggtgttaacaactacatctttactcagcaaagacctctgtggtaggttgataatgatgtagtacatatagaatataggtttaatcaaatagtgtttatgggataggaccaaaagaatcaggagtagaaggtcctgttgagagtgcagctttcaagagaagtgatcttgaatgcagtttaggctcggttaaacaggggagggagcaagtcgataggagctgttaataggctggaagaaaagaagggcaaagggtgggagatctcaggtgatgggttgagagcaagtttgtcgatacaggagtggtaatcctggaagggcgataaattgtagttgcagaatgaagtgctgaattttcagattccaaagaattatcaatccattgtggctttgggaaatgaactgatcaacaagagtaaaagcaaagctggctcatggatgcattagagcaaagaacatggactttgaggtcagaaaggtttagattcatctctgttggctctgttatttactacttgttgatgtcagttttcttctccggctttattttcctcgtttgtaaaatgagacaacttattttgcagggttaagaacattaaataggccgggcacggtggctcacgcctgtaatcccagcactttgggaggccgaggcaggcagatcacaaggtcaggagatcgagaccatcctggctaacatgatgaaaccccgtctctactaaaagtacaaaaaattagccgggtgtggtggtgggcgcctgtagtcccagctactcaggaggctgaggcaggagaatggtgggaacctgggaggcggagcttgcagtgagcggagattgcgccgctgcactccagcctgggcaacagagcaagactcgatctcaaaaaagaaaaaataaattaaataaactcatacatgcaaaatgacagatgaatagtgcatagacagactatgactgctgctttagttattattttattattatatatagcacagtacttagaatcctgatagtacttggaaaaaaccaacagaagcacttactatgattgggcagcattattctttattctaaggcgttacatctgttaacacatttagtgtacacaccagtgggccaaggtcccagagctagtagtggtagagctgagtttatccaggtactctgagtccggagtttgtgttctttaatacataggctacccaagttctgtgagttttgagtataactcagaattcagtagataacagcatcaaaacggttaaactataggtggcatatgctcacactactgtaattccaactaattcaattattcaactgctatccactttagcattcacattctgatttgaggaagtgtgttgtaaccataatattacattttcaaacagaacctttttaaagtttctgtgcttttatctttggtaatccagttagtaaagttcagtctctgagtgttaaaatgacatatcagttctgttcaaagatacgaatttttatgtgtttatataaaaatactatctactttcttttttaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcag

SEQ ID NO: 35850 - DNA, 27181 bp, Homo sapiens
aagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggtgagggcgccgcgggggcgagtgcgggagcgcggggctgggacgggccgccgctttcctgcccgccccggtcccgtccgcccctggcccggcgcggcccaccgggggcctgcggggctgtgggtccggctccggcgtccacctaggcggccggcccatcggttcagggcccggggcgttgggctgccctcgcctgccccttccacctccgcctcacgcccccggccggctgcccagatcccgggcgtggggggctcgggtgcggacgggcggggaaacgtagccccctgagccaagcaggaggttggtcggggtcgcctgcgctccactggggagttcctgccactctagcatttcccgagtggactagcgagagcgacgtccgaaaaggaccattttcagaccagtttctgaaaatgcaactaaaattaaccagaatgtcgtgcgtattaatgaacttgttaataaatgcagaatttttgtcaggtgaacggggcacctcagaaatcactaactcaagccgggcgtggtggctcacgcctgtggccacagctactcgggaggctgaagcgggaggattgcttgagcccaggagttagagaccagcctgggcaacatagtgaggccccgtctccacacacaaaaaattttttttaattagcagggtgtgacggcgggtgcctgtaatcccagctattcgggaggctgaggcgggaggatcgcttgagcccaggaggtggaggctggttgcagtgagtcgagatcgcgccactgcactccagcctgggcgacagcaaaaaaaaaaaaaaaaaaatcgctgattcttgaatgtgccaagcgtttgtttgcggagaggtaggcgtgatggccaactgtgatttttaaaatagaggttgactttggtggaaacagatggtgactggtctttgtgttgagtggctcttggaagtaaagtgttgattttcagaaacgagagccgatcttaagtttgggaacagtgtttgctggaaatgataagtgggatgtgtgttttcatgcacgatagcactttgcagaaagttatttttgtttttaatatatataaagtttttttccaaagaataataaaacatgcgggtgatcagttcgttcttgtacatcgtgagtgtgtgatcttcactttgtaaattctgtatccattgttttcttaacccctgaaattatttcgatctctccatctttgaagtctagagttgtccacattcatcctttacaaggtggactaaataattttcatgtatttttaggttaaaaattctcacttgaagtgcatgaagaagtaacgatgttattttaaaacgtaatctataaaattttcttaaccgtaatgtttagaagtcatgatgtggcagaagtgcactggagaaggaaagattttgttagtctgattttagggtactcttaagatcatgaaatttacttagaaaaggagcactaatagatggtgttaagttacaatatttttaacgggtgtaatgttggtcggggcctttgtgtattaagtaactatttgttaacacaggaggatttatttttgtaaatagaagtgccaagcaagtggtatttttctctttctgaaacaaactgcttacttgtggcttcagttgacattcatttttattgtgataacctgtaatttcatgagtcttaaaatttatgccttaaacatctctctccagctctaatgcgaagtgaaatgtacaggtttgaaatgatctgagtcagttaacctgactatgagcatcagaatacagacttgaagttatgggtaaagtgttagttgaatcagtttttcccattgacttcctttttttgttttatttttgttttgagacagaggctcagtctgtcgcccagactggagcgcagtggtgccgtctctgttcactgcaacctccacctccggggttcgagggatcctcctgcctcagcctcccgagtaactgggattacaggtgcatgcagccatgcactgctaatttttgtatttctagtagagatggggttttgccatgctggccaggctggtctagaactcctggcctgaagtgatccctcagccttccaaagtgctgggattacaggcgcgagcctcgtgcacagcccctattgactttctaataattttaagatgaacttctagagaagaatattgtaccactgctgtactttgaaataatcacaccggagtgtcaacgatcacttgaggaagctttctgtatttgtcaaaagagattatttttacttcggctcctaaataaatcagactaacagttcctaggacttcacaggtatatttaagattatctcttgtatcttactagccttttttgggggcgggggggggacgcagtcttggtgtgtcagtcaggctggagtgcagtggggcaatcaccgctcactgcaacctcaacttctggggcataagggaccctcccacttcagcctctcaagtagctgggaccacaggcatgtgtcaccacaccgggataatttttttattttttttatggggtctcaccgtgttgcccaggctggtctcgaactctcgggctcaagtgatcctcccgccttggcctcccaaagtgcagggattgcgggagtgagccaccactcctagcccatttttttttctttgaatatttgtccttacccacaaagcatgaatttgttagtgaaattcattcatctttgttctctacccccattgatggagttgccaatgggttggaaaagtgtgataatactcatttctctctactctttttgagccgtgcttagttttgcagccctcttctggcagctatgacctagctttgtggtttgtgtatgtatgagtatatatacatatatatgttttctgaccttagtttctagttccgttttatatccctaccccatcctccttgttgatacataacaagtgtagcattcatcctgtctgagttccagtcctgcttcacagcttgctagctgtcagtctttctgcacctctgattccttatgacagagataatatgtaccaatcctcccgggttggttgtgagtgctaagatatatattcattggccgggcacagtggctcacgcctgtaatcccagcattttgggaggccgatgcaggtagatcacttgaggccaggagttcaagaccagcctggccaacatggcaaaactctgcctctactaaaaaaaaaaaaaaaaattagctgggcgtagtgttgcactcccagctacttgggaggctgagacacaagaatccctaggaggcagaggttacagtgagcagtgatcataccgctgcactccagcctgggtgacagaatgcagttttctcaaaaaaaaaaaaaaaaaaaaaaggccatgtaaagtcctaatgagaagtaagcacgcagtgaatgttaactaaaggaaggctgaaagttttaatcataagtgtcacccattttcttttgtaagaaatgcaaaatgaatagatgtgccaatatgccttttctttggtaaatatacttcaaaggagttttttttatatagtggctatagaaccctgaaaagtagtggtgcctgttatgtgaaccacacagtactggaattaatagcagttgtgtgaagtatctttactcctgacttggtctacttaatacttgccctacctttctagggcaagagtagcaggcatgtagaaagaaaatatgagaaaaataaagagtcaaacctaattatataaactatctttaatccttgtgattcaatttttgggttttttaaaaatacctttttttattctattggaaatactattctataggaagttacatcgtatgatggtggtttttccttaaatttctattctaattcagattgcctaaaaactgaaggagtcggctggtcatggtggctcacccctgtaatcctagcactttgggaggtcgaggtgggcggattgtctgagctcaggagttcgagaccagcacgggcaacatggtaaaaccctatctctactaaaatacaaaaaattagccgggcatggcggtgtgtgcctgtagtcccagctactcgggaggctgaggcaggagaattgcttgaacccaggaggcagaagttgcagtgagccgagatcgccactgcattccagcctgggcgacagagtgagactctgtctccaaaaaaagaaagctgaaggagtccactgaaatcaagaccagagtagtactagtaaaggcctattttgaggtagttgcaaaaataaaatctatcctagtgccagtgggtgaatgactacaaaaaataaagagtatgaatggtatggtgtgtctggcttccaaggttaatttctgcctagtgaaaaattgtttgcataaaatagcaaggcatgtcttctgagaagactagctcttaacactagcttaaattagcaatccagcttttgaagctaattgtgaatttgactcctcttgtgtgtgcagagaaattgcttctgtgattcattcctgcatcagcagtatgcagttattttagaagattgtgtgccaagagagccaggctggcactgctcaggacactctgtgactagaactatatttaactgttgtctcagaaagagtaaaaattttaagctctttgacctgttaaattttataactgaagaaccttggtgatgattctttaggtggggagggaaattcagccaatgtgtgtgctggcagatctttattctgatgattataaagtacgtattgagaaaaatgtcgaggcttgtgtagaagtataaatatgtaaattttatattgaactgatggaaatgtttctaagtcctggcgttagccttgaaataagcagaaataactttaggatatgacttcattcctaatgtgaaatagtatgcttgttcctgaatacccaaaaccatcttaatgaagattagattctggtaaaaatgagtgatttttgtgaattgagaaaatttttttagattactttctgtgattgattacagcttaaaaaataaaaatagtggtcttgacaggcaaaatgcctaactggtacttccatttttaatttccctcgaacaaaaattagtgccagctttggtggtccattgataaaatctaaaatgcagtgataaaatagctcctttcttagtataatgaagaatggcatgattacagtgaaatagagggtcaagacccaattctagtgactgaacaaatcattgttttccttgctaagccagcctcttagtggacaggtaaagaaattaaaccaaactagactagcatgaactattgctaatggcgggaaagtggactttgttacatttctctactttatatatgacgtgtcaaatatatatgactaggtaaatatatttaatacttaatactgccctttaacaataatatacccttgccataagatatttacctaagtagataaagtgaagatatttgcaatgtaaaatttcttttcattgcctgcttttattgccgtgtgtgccttttattcttatttgaagatcttgcagaaattttttcttcacagtcttttctcttcagtacgaatgttataaaagacttggtgaatgaagcccttccttggtaaaaggaaatgaaaatgccagaaattgaagatggaattaatgcttaattaattttcctagattgttttctgaatgtagttttttctaagaagaatgatattaaagttacagaagtaatctgtataagaaatctgagtctgtgttaaatagaaattttttattgttttgaactgatttccttcaagtaaatgtaatgaaatgtaaacctaatccagattgtttaaagaaacttgtatgaagacatcttttcttccttaatgaccaaatgtgatctaatagttcctgtacgttacttttcaactctaaatttcattaataatcatattaacggccgggcatggtggttcgcgcctgtaatcccagcactttgggaggccaaggcaggcggatcatgaggtcaggagatccagaccatcctggctaacatggtgaaaccccgtctccactaaaaatacaaaaaaaaaaaaatcagccaggcgtggtggcaggcgcctgtaggcccagctactcgggaggctgaggcaagaggatggcgtgaacccaggaggcagagcttgcagtgagccgagatcgcgccactgcattccagcctgggtgacagagggagactccatctcaaaaaaaaaaaaaaaaaaatcatattaaccctgggaaggagttctgtgtattacagattccgtttcctttccagagaatgggagagctcaagcactcaagcttagaactggtttgctgttgtgtcctttgtaatttagaaatatttatcatcattccttgtaaactgttttttgactgagatacttttgtgatcaaatgaattaaaagacaatcctgaggtgcaacctgagattcctgacttgcgttataatagcatcatgttacaccaaaaatgtggaagactccattggagatctattaagtgaatattttatacaaagacaatcgtttttatgttgagactgggatacagtggtgaatttaagtgttctcacctattcaatcttagaaaaaagcttatttgaattaactttttagcatagttggattttttttaatatgcaggatacggtgtgtaggctgtagtttaattttgctcaaaatctctttttttttgtttttttgtgatggagtctctctctctgtcatccaggctggagtgcagtggtgccatctcggttcactgcaagctccgcctaccgggttcatgccattcacctgccccagcctcccgagtagctgggactacaggtgcctgccaccactcccggctaattttttgtgtttttaatagagatggagtttcaccatgtgagccaggatggtctcggatctcctgaccttgtgacctgcctgcctcagcctcccaaagtgctgggattgcaggcgtgagccactgcgcccagctcaaaatcccatcttatagagagggaaataattttcatcttcgtttaaaagagttccgcatgatatttatgtcctggatgatgagagctcagaattggttcagtgtattctcgacttggcttgagtagcaaaagaggcgcttgttcctgtgggcagtgaagaagaaaggagaggattggttgacagaatgctgccactgtgtagttatcccgtacattcaacagattttagttgaaccactatgtaccagactgttcaaagtgctagagattcagctgtgaagaggggacacgattaatgaacaccaggcattgattcttgctggcaagaaaaagcagaagatggggacagtgatgggcttgaattcaagagactcttttttttttaatagggtggtcatagaaaaccttccaaattctttataatgtggtttacttttgtaattaaaaaggattttgcgagagttagaaggcacagtccctaacactgttctcacctctgacaccatcttcaaaagtttagtcatgatgtaccttcagaacagcagacaaaaaataaagttcagtgaactataaattacagggaacactgcccaggactgcctcagttttggcaccaatatactagttcagtgggttccgaaaaccactcttaggttcagtgattcacaggaatgactcacagaactcactttaagctgttacactgatgattatggtttattacagggaatgaatacaatttaaagtaagccaagggaaaagactcataagggcagagtacaagaggggctgacatctgtagtgtccagtcctccagagaccaaactgatagtgggatcatccaaagtccgcatcgtgagtcacattgttaatggtccgcaggtcagagcccccaggcagagatctctttaccaagcaggaaattccaggggcaaaggccagacctctcctcgggtgaggttaattcttcactatacagatttttattccatagcaaattctgagggacgagaaccttaataataataaatggcaataccaaaatacatgaagaaaacaaggctagatttatcagaattgtggagtgtgtgcaatgtgagggatttttccagttgagttggcatattctttttttgttttaagtttgtattttgtcaactgggcacagtggcttatgcctgtaatctcagcactttaggaggccgaggcgggcggatcacgaggtcaggggtttgagaccagtctggccaacgtggtgaaaccccatctctactaaaaatacagaaattagctgggtgtggtggcacgcgcctgtaatcccagctacttgggaggctaaggcaggagaatcacttgaatccaggaggcggaggttgcagtgagctgagatggagatcgcgccactgcactccagcctggacgacagagcaggactccgtctcaaaaaaaaaaaaaaattgtattttgtcttttcttggttgtataaattctccaaaagttagccatttaaaaatgtttaaggtcttattttctactttgtgatatgtgtgtataatttttactgtgcaagttttagcatttttgtatagtctgattgtccatcttttccataaactttaagcgcacatgagaatcacttgggaaagaaataggaaattcatgttccttgactccattccagagactgattgacatgtcttgggcaggtccaggaagctgctttttttttttttaaaggcaggatcttactgtcgcctaggctggagtacagtaacatgatcatagttcactgcagccttgtactcctggactcaagccatcttcacgcctcagtctcctgagtagctgagactacaggaatacacaaccacacctggctttttttactcatttttttgtagagacagggtctcctcatgttgtccaaggtgatcttgaactcctggactcaagtgatccttctgcctcggcctccaaaagtgctgggattacaggtgtgagccactgcccccggcctcctttgtgctttcagtgtcatgaaatacctgtatttgtcaagaagattaagaccatgtcttaaaaaaaaacaaaagctagtgagatacaagagataatcttaaatatacctataaagtcctaggaactgttcgtctgatttatttaggagccgaagtaaaagtgatctttcctgacaaatacagaaagagatttttgctagcatcacttcttccaaaacaattttcctcatttatgcaataagtttggattttcacttctttatgtcactaagtttctgcgtgttgctaagttcctggctgcatatttggagtctctccaacagcagcattgtcagcattcccacagtcggttcttccgtgtacttttgatttgaatttcatttccagggttatgtcttgtgtgtttggcttctctcttttagcataatatatccaagattcctccatattgtagcatgtatctggacttcgttcctttttatggctgaataaaattccattgtgtggatattttataattactgccatctggaatttgttttgaagtttaagaagccaggttttttccgtttgaaaaagtaatacagaatttgttttttaaaatttcgagcattggccagtcacggtggctcagacctgcaatctcagcactttaggaggctgagtgggaggactgcttgagcccaggagtttgaggctgcagtgagctacgttcacaccactgcactccagcctgggcaacagagcgagaccctgtctcaaagaaaatttgtgcaagcacctcagaaaggtagcaaggaaagcaaatgcactctacccaccattcctgtcccctgccctcctacctcccagacaaccattatgtttctgtatataatctcctcagccatgttcttcatatgcaaaaaatatgtggtgtgcagaatgtttgtggtgtattgggagctgttttgtggaataaacttggcttctggtaaaattattgtttaatttgtgatctcaggaaaagaaactgaagggtataaaggccttaagattacacaattagattaaaactgaagagaacccatgttttctggaagacttcattgcatataatctcattctaattaattacaagcaaggagaagaaagtatgggctacattgtccataactcttgggaatcctaccaggctataagcagaaaaggcatttgtagaagaatacatggtagcctagaatcaaaagaaaagctggagaaccaagcatgagcattttgcagaaattaagggaggttagaggtgcagtcagaatcataccttagaaatgatttagaacactagagagaacacttctgttggaatagaacttgccattgtccctgctctttagagttgcttcaaattaagagtctgggctgggcgcatctagttggcataaagtaatctggggctagagtaactttgtgattcctacagtgtgtgtacaaactattgtgtgttttgaaaatcgctacaggttgagtatccctcaactagtgttaaagtctgttgacaaaaatgcagagtagcaggaaatacagtgaaactcaaaatccatgttttaaatactcttcagattatcaaatcactgaagaggcagagaactgtctgtccctaaaattgtgctctctcccccaccagtctaagctgtcatctgcttttactttaagcttcatcctgtttgactttttttttttttttctgtgactgagttttgctctgtcgcccaggctggagtgcagtggcacgatcttggctcactgcaagctccgcctcccaggttcatgtcatattctcctgcctcagcctcctgagtagctggggctacaggcgcccgccaccatgccgggctaattttttgtatttttagtagagatggggtttcactgtgttagccaggatggtctcaatctcctgacctcgtgatccacctgcctcagcctcccaaagtgctgggattacaggcatgagccaccgtgcccggccctgtttgactttcactgtgctgtgttgttgccttttttttcttttgtctcactctcacccggggttaactgcaaagtggtgcgaccatggctcactgcagccttgaactccccagctcaagctgtcttcccaccccaccccaccctcctaagtagctgggactataggcacacaccaccatgcccagctattttttaaattttttatagagaccagaggtctcactatgttgcccagcctggtctcaaactcctggattcaagctatcctcccccctcggcctcccaaagtgctggaattacaggcatgagccaccgcgccaggctgccctgtgttttagctatgctagccatccggttgtttcttcctctcggtttgcattctgtattagtcccagttctcatctcttagctttcgtggttttctgtttctaatttctcatggacctggaaactcggtaaatagcttgttggaattttgtagataacagtaggcccagaataaggcctgagagtctcttctggtgggttagatacatttttatgatgtctgttttgttacttcagaggcttttaaatttttcttcctgattctgggatcttttgctattaggcagagaggccagatcgatgagccattagtgaacttcgatttagtcagaacatttcatttgccagtgtttaagcataaattctgtacttcagggccacctaatggtattttctaacttaattctataaatataaaataattggaataaagaaattcaaggttggcctatgaattggtgtaagaatgtttgttcacacaagaatttgcataatttgtgacttttttctttcattgacctttttaaacttgtgaataataagattattctttttaaaacacagaccttctgccttgaagatttgcctattctggacatttcatgtaaatggaattgtacattatgtgatcatttgtgactgacttcttgcacttaccataatgtcttcaaagttgtagcatgtatcagtacttcatttcttcatagctgagtgactattccattgtatgaatatgttatgtccattcatcggttgatcaatatctggtggtttctactttttggctgttattaataatgctgccatgaacatgtataaactggatttcatttctcttgagtatatacctaggagtggaactgctggattacatggtaattttaggtttaactttggaggaactgccagacagttttccacagcagctgcaccattttgcatttccaccagcagtgtatgagggttccagtttatccacatgtttgcaacacttattaactgtcttttttattatagcctttctaatgaaagtgttatctcgtggtttggttttcacatacgcttttataaggcacttttcaagtgtttttttccccaaattttcttttaatagataagaaatgatagttttaactttgtaattgttgatttcacttttctaacaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtatgattattgaaattcaatttttttttcaagatttaaaccaggcaaaaggcaagaatgacagtattgcatatcatctgttttatggtctgttcagtttatagccccttaaaataataattggttttacatctttttaaaggagaggtgaaaaggataacttctgtgtattcccgataaatgtatcattctctcgagtagtccatagctgaagtcttggaatcatatttgactttatcacttatccgttatattgagtcagtagacaagtctttttaaatccttgctttgaaaagtctgttgttcctgtctctttctattttcacacagtttatcacttcacaattcgattgttacaatagcttagtaactaatatttctgcctccaagatctgatcccccccaaatccacctggcatacgctggccgatgaaatctcttatttaacccttttatattgttacttcctgttgattgcctgttgcctatagaatcaaattcaaactccttgcctggccttctatagtctagtctgaatttttgcctgccagcggttggtagcataaactctggctcaaatcaaagtttcttcttattcagtgctctggactctgtttatttccatagtcgatttcccccacgaggttatcctgtccctgatttcttacctttctgccaagactcagctcaggtctcacttcctccatgtaaccttcaaccattttagccttattccttctgctctaaattactatgaggaaacttattctcccagcccttatttatgctgcaaaagtggcttattgccttctattacttattattttacatatgtccttagtgaggttagtccctcaacagcagaagccatatattacatggtcatgggtcacttaactgcaggcatacattctgagaaatgtgccattaggtgattttgtcatctttggaacttacacaaacctaggtggtatagcctactgcacacaaaggctgtaatggtatagtctcttgctccagccaacatcgtacatgtaatctgttaacaaaaatgctgcccagcacatgactgtacttgtgtagatctggcatctggctttatagcaccaaacttacgttagacacataacggatgcttagtaaaatatgtatgaattgaagtacatacttgcagcttttagcttaatttgcagaatccagtgctttttcgtatttcttatcagatgcattcctaactaaatagtcgcttatgttttttaatagaaaggaaactattaatacatttgaaatcttgcccagttttgtcaagggcctgtttttgtgttattattggcaaatccaatcttcctgtgggaaataaaaattgaaaagggaagaagttaatctgtagagtttgtctcagcttcaaacctgtgattttcactactcattcagcagtaagaagtcatagtgttctagaaagatttaggaaagtagtaataatttgatgatgaagataatagaagcaaagtatcagatacaagtttattatagtaatataagtattagttaaaggttctgatgagggttgtcgaaacctgatgaaaaaggatgattataataaacacgtcaaatgttaaccagtaagacctggttatgaataagcaagttttttattttgaaactgaaattaacatttaatatactggtggccaaaagcgccgtgtttaaaaatgggtcagagactggtgtacttcacatgacactagtaaaaatgtgattttactatgggttttactccttttcttccaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctacaaaaaaaaaaatttaaaaattagctaggcatagtggcgcgtgcttgtggtctagctactcaggaagctagaggtgagaggatctcttcagcccaggaagttaaggctgcagtgagccgtgatccagcctgggcttcagcctgggcaacagcaaaaccccatctcaaagaacaaaaaaagaaaatagaagcaaatgctatttctgcatttgctgtaacaagtagtgcagacatgtcatgaaacattcaaaagtataagaagaaattatgcaaatttcctatttcaatttctagagataatcactgtaagcatgaactgatttaaatttaaatataaaacaaaagccgggcaagttggctcctacctgtaatcccagcactttaggaggccaaggtgggtggatcacctgaggtagggagttcgagaccagcctggccaacatggtgaaaccccatctctactaaaaatacaaaaattagccggggatggcattgcatgcctgtagtcccagtcccagctacttgagaggctgaggcaggagaatcacttgaacctgagagagacagaggttgcagtgagccaagatcgtatcacggcactccagcttgggtgacaaagtgagactccatctcaaaaaataaaataaataaatataaaacatataataaaactccataattcttaaattatgaaagcccagagttgtcaagaatgtaataaattctctcttagactgctcgtgggaatataatttggttataactttccctgtgtaatcctgacagtcttttttctcagccatgattttggacactgccgtgattaatttgaaaggacgatactttgcctggacttgttaaaagaaaatgtgaatttaaaagatgttaaattttaattaaggttgtttttaattgttttgaagcaacatagtcttcattaataataaaattgctggacagaatgatttttaaaagacagcctatcagttttaatgaagtatctagtttttaaaatgggtgcgttagtagagcttttatatatttttcccttcctccttccttcctttctttctgaaaagttactagaaaagaaataatagtgaacaaaactgatctagaagaaaagatggaaggcacataaaacactaggaatgaaataaggcataattataactatgcaggagctcgtgtatcacaagaacaggtgcagctttagtgcactaagtttgaaaagctgaatgaagcttactatagtaaaataccagttattaaaattggcttgcagaaattcgtccaatataagtaaacaaccaatagcaaccaggtgtaaatagttttataggctaattctaccaaacctttaaggaacatataatttctgtgttctagaacttgggaaaagatggagagttcaaaactcacaccgtatgcctagtataacctcaatgccaaaccagacgtggcacgcacagaaaaataaaatcagaccaaagtcatttggaaaaaaaattcctatatttatgattcaaaactcagttattttataaaataataatattaagtggataaagaaacgccagttgtactatcagctaaacattagaaaccttctcatcaggccaggtgaggtggctcatgcctgtaatcccagcactttgggaggccaaggcgggcggatcacctgaggttgggagttcaagaccagcctggccaacatggagaaaccctgtctctactaaaaatacaaaattagccaggcatggtggcacatgtctgtaaacccagctactcaggaggctcaggcaggagaattgcttgaacccggaaggcggaggttgcggtgagccgagatcacgccattgcactgggcaacaagagcgaaactccgtctcaaaaaaaaaaaaaaaaaaaatcaaaatcagaaagaaaatgcttgttaaaacttacgttattctctctgattcagaatacctagagcatggacttgaaactaggtagtttacaaaaaacaaaacagaaaacatttgtattattccattttattttagaagtcctggccaatgcactaagcaataaaaagaattaaaacgtataaacattgagaagaaaaaacaaaaatagttttgcaaatgacttgattatgtacttagaaaatatgaaggaactgaaaatttattgtagccagtaacaggaatcagagtgtttgctgtaagagaaacaaaaaattgtatatatcagcaataaccaacagaagctgtaatgacagctgggtacagtggcatgcacctgtaatcctagcttcccaggaggctgaggcaggaggattgcttgggcccaggagttcatggctgcattgcgcagtgatcaaggctgtgaatagctactgctctccatcctcagcagcacagcaagactccatctctacagaaagaaaagaaaggagggaagtggggagggagaaaaaaaagaaagaaagaaatttaatggtaggtaccaaggatggggataccattgaccagagaaaaggaagggagggagggaggggaaaaaaaaaaaaagaaatttaatggtgggtccccaaggatggggataccattgaccagagaaggggtaaagaagaaaaaatgatggacaaaatatgtttaaatgttggcactatttggactgacacttttaaccattatttactctttgttaactgtttggagttagtaaaacaaatacattctcttttgttaattcatacatagatattctgcctccatggtggcctctctccatccatagacacactggatcatataagagccctggatcgtttacaggaagttccacatgaggtaaacttaatttaaaaaagaagaagaaaggaaaagaaaatataaccacattttgaggatgataaagtatgactgataataatttgtaacatgtacttatttttcttggccagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaaatttgtgttcatatagtactgttatttaatatgaacactttattcaaattttgctaattgtctcactaatgtctttaatagcaaaatttaattttttgtgcatactgtatgtgcatagtcgaatccaaagattaggttgtattcattctactttgatgtggaaatcctccgattttcattgttttccacattcttgacattttggaagagtaggagcattttatcttacagaaatatccctcagttggggtttgcctgatgttttccttgcagttagggattcaatgtatgcatttttggcagtcatgacatagaaagatggtgtgtcctcctccgtgcattgtatcaagtggtcctaaaatctgcttgtctcaatgctggtggtggcaactttaattgcttagttaagatgatgtctgccagatttctccactataatattaactgttatacaactactaagggaacataaacaacataatccctgcagaccagtagggagtggcttcaagatgtttagagaaaacttcgccagcccagtagaaacaagggagcatgataaaaaaaacacaaatttacatagtaaaaataaatttaattatatcagtgattataagaaagagactaaaattttagcctgaaagagactcttagattggataaataatcaaaatttagctgttatttgggatgtacctaaaacataaatgattggctggacaaagtggctcatgcctataatcccagcactttgggaggccgaggtgggaggatctcttgagtcttggagtttcagaccagcctgggcaacatagtgagacctcatctctatataaaaaaaaaaaaaaagtcaaaaagttagctgggcatggtggcatatgtctattgtcccagctactcaggaggctgaggtgagagggtcacttgaggccaggaggttgaggctgcagtgagctatgatcgtaccgctgcactccagcctgggcaaaagggtgagaccttgtctcaaaaaaacgaggaaaaagaaaaagacaccacaaactagaggtaagagttggaaaatggtatattggtatatcaagtaattaatcaaaatatcaaaaatatagctaatgagctggcgtggtggctcgtgcctctattcccagcactttgggaggctgaggcaagcggattgctggagctcaggagttcgagaccagcctgggcaacatggtgagatcctgtctctactaaaatacaaaaaattaacctggtgtggtggcacgcacctgtagtcccaactactcggggctgaggcaggagaattgcttgaacccaggagttggaggttgcagtgagtctagatcgcaccactgcactccagcctgggcaacacaggatgtgtgtgtgtgtgtatatacacacatacatacactaatgtatgtatatatatgtatacatatatacacacatgtatgtgtgtatacatatatgcacacgtatatatacacatatacacacgtatacatatatgcgcacacatacatgtatacatacatatatacgtgtatgtatatacacatgtatatacacatgtatacatatatgcacacacatatatacatatatacacgtatatatacatatgtatatacacatacattaattagcatgtatgtatacacactatatataatactatagctaataatatgaatgagataggctctaataaaaggtattattagaaataaagagattattgatgaaaactggcccagttctctaggaagaaagtattctaaatttgtatttacctagtaatagcttcaaaatatataaagaaaaaattggcataattcatgagggaaaattgagaaattaattatgattgtgggagaaattcagtacacatccttgccaagatttcaagcatagatacggcaaaacaacaattagcgagctgcatttaacagactcctaggcccacgaattgcacagtattctttacaggtacacaaactattaaagatggagaccttatatagtaatatagacgactacatttccacagagagtacctgtagtttttgagtttagttttttttaaatgtgtctgtgtcaaaatcataatattataatgaaataatgaatttgtttttatcctgcagggatacaattggtgtcatgatcggaatgtggttaccattttcagtgcacccaattactgttatcgttgtgggaaccaggctgctatcatggaattagatgacactttaaaatattccttgtgagtaactgtaaattttaattgtatatactttcagaaggaaaattttaaatgttaaaaatagaagatttctgtttctgaaattggatgaggagtatagcaaagcccctctccagcaaaaataaccattagctggagaacattatttttaaaaaataatttttcaaagcttttggaaattgtcctaagggcatacagcaggtggagaaacagttaattcaagaaaacctactaaatctcagtaataatagccgtagtctgtggcatttgagctatgacttgccccctccaactcctcccagatccctctcacagaaacgactacaggcgctctacgctgggttggtatagtcaggaggctaagggattccccctcttcatcagctcccagggctggggctgtgggttcactcccagagatcagatgccagcatatctcacctctcctagtctggagttacaaaagctctactcctggtagacacagtcaagcaggctgaggcccccttccctgccccagctcctggggcagaagctctgctccaggcatgcatggcagatgagaatgctgggtttcccaatgctgttaccccagcacctgcttataaaccaggtggtatcactgagcctgcactggcacagaagttctgctcaggaggaaaggcaggtcacagaagttcctcagctctgcctcagaggacttatcttacttaggtgatggagaattccaaatctgagtgctttgtggaaagcagtagatgtcatggtggagaccaattaagagggctgtaatagctcccatgatactaggagcaacatacaaaagagcagagcaacatgttgttcaacaaatagcaccagggaaaaagccaagaagagcccttctgggatcacagtcagccctgggggacaagaaggctgtgcacatgcactagccatacccactcaggagcagtcaagagtaggatgtggggtattcatataatattttcaagccacacatagattgtactgagttgaataatgtccccccaaaaaaattcatgtccacccagaacctcaaaatgtgatgttatttggaaataggatctttacagatataattattaaagatgagattgtactggattagggtgggcctaaatccaattcgaatgggattttagtaagaggaaaagaaacacacacaggggagaatgctgtgtgaagccagagattcaagtgatgcatctaccagctaaggattgccagagccatcagaagctagggagaggctaggaaggatttttcctagagccttcagagagagcgtggtcctcccagcatcttgctttcagacttgtagcctccagaactgtgagaggataaatccccgttgtataagctatacagttcggtaatttgttacggcagccccaggaaatggataagtagattgatcaacaaatggtgtaaccatcactagtatgtgaggcttaaacacaacctctcatcattgactgaacgacattcagttactctgatccaggagcacctcctaggtagtcaggctttaaaataaaatcacactcatccctgacagtctggcagaatatgtgcatgcccaaggttataccctctctggactgagtgcagtatgaagatccaactattagtccctggctgaatgggaagccaaaatataaactccttcagctttgatagcaatctgcaagtcacataacatttccggtggccattagggtgagctttaagatctaactggccaagggggcttaagtacaatctttgatcagtaagtggcttatgcctacccagagacagcccctcagtagccaggctgtgaaagattaaaagaagtaaaaacggtcaggcacggtggctcatgcctgtaatcccagcactttgggaagccgaggtgggcggatcacctgaggtcgggagttcaagaccagcctgaccaacatggagaaacccagtctctattaaaaatacaaaattagttgggtgtggtggcgcatgcctgtaatcccagctactcaggaggctgaggcaggagaatcgcttgaacctgggaggcggcggcgatcacgccattgcagtccagcctgggcaacaaaagtgaaactcaaaaaaaaaaaaaaaaagtaaaaacatccgagcagggccacaggggctgcacactatgggggaagtagactttacagttagttcagctaagtcactaaacaaaaataataaaccaccaaaaagacaagatcagtccccaaggacatgaattccagagctactgcaatatgttatctataatgtccaatttttcaaccacagattataagacatggaaagaacaaggaagtgtgacctctacacaggaaaaaactaagcaacagaaactgtttctcttggatagaacaactaggcaggagatgaaggcaggagaagacttgagcaacactgtaaactgactgtatacctcatgtctgtaaaacaacacccaacaacagcagaatactttcctctcaagtaaacatgaaacatagtcatatgctagactgtaaaacatgcctcaggcaatttaagaagattagattcttaaaaggatattctccaaacacaaggaaatgaaattagaaatcattaacatggctggatgctgtggctcacacaagtaatcccaacactttgggaagccaaagtaggaggatcacttgaggccagcctgggcaacatagggagaccccgtctctacaaaaaaatttaaaaattagccaggtatggtgccaagcacctgtagtctcagctgtatgggaggctgagatggaggatcacttgagcccagttgatcaaggctgcaatgagctatgatcacagcactacactacagcctaggcaacagagcaaagaccctgtctcagaaagaaaaaaacaaaaaaaaaaacaagaagatttgaaatcagtaacctatctttatacttgaggacctagaaaaagcagagtaaactaaacctgatgtaagcttatgaaacgaggtttagagtagaaataaacaaacagtagaaaatcattacagaaaaatcaacaaaacccaaagttgatgctttgaaaagccttaactagactggccaagaaaaaaaggagtaaagactcacattaccaaatcactagagaccttactgaaataaaaaggattataagggaatacaataaataactatatgccagcaaattcagtaactttgataaaacgtactaattcctaaaaagaaactactgaaactgactcaagaaatatgaaatctgaatgacctttcaaatgtgaaaatattgagccagcatggtggctcacacctataaatcccagctttgggaggccaagctgagaggattgcttgagactaggagtttgagaccagcctggacaacatagcaggaccttgtccctatttaatttaaaagaatataaataaatgagtgaaaaagttaaaactccccacaaataaaaggccaagcccaattggcttcattgatgaagtccaccaaatgtttaaagaaaggaattggccaggtgcggtggctctaaccagtaatcctagcactttgggaagccaaggcaggcagattgagcccaggattcaagatcagcctgggtaacatggtaaaaccctgtatctacaaagaatacaaaaattaacctggtgtggtggctcagcctatagtctcagctactcaggaagctgaagtgggaggatcacctgagcccagggaggttgaggctacagtgagccatgatcacaccactgcactccagcttgggcaacagagtgagaccctgtctcaaaaataaaaacgagttaatgccaatccttcacaaacacttccaaaaaacagaagaggaggactactgcattcattctgtcacacctgcactattatccttgataccaaaagtagacaaaggcaaaaacagaccagcatttgttacgaatacagatataaaattttccaacatacgtaccagcaacctggatctagcaatatgtaaaaagattatacaccatgagcaagtgggatttatcccaggaatgctaggttggttcaaaacatgaaaatcaatataataaaccatattaatattaagggattaaaaaacacatgatcatctcaatagaggcacaaaaataattggaaaaatccactagccagaaacactcaagaaaatagtgatattaggcctggcgcggtggctcacgcctgtaatcccagcactttgggaggccgaagcgggtggatcatgaggtcaggagatgagaccatcctggctaacacggtgaaaccccgtctctactaaaaaaaaataagaaaattagccgggcatggtaatgggttcctgtagtcccagctactcaggaggctgaggcaggagaatggtatgaacccaggaggcggagcttgcaataagccgagatcgtgccagtgcactccagcctgggcgacagagcaagactctgcctcaaaaaaaaaaaaaaaaaaagtgatattattattattattaaataatattaaacaattattgtttaattatttaaacttgatattatttaatctttaattatttaagcttttaaataataataacatttagaaattgttatgccaggcaccaaaccagacattctgtcttcttaaattttcaccatagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaac

SEQ ID NO: 35851 - DNA, 23550 bp, Homo sapiens
gtcgtggaagcaggactgcgccgcgtcttcctcaaggtggggttcggggggccaccgaatcgctgtcacgccggcaggtagcagggggtggggacgcgggctccttgggcttctgtttcctggtgtccagggcaaagggctgagccgggcagtagggcctagtcggggcctggctcgccgggagcaggagggcttccggcaaagccgcgtgcgctcgacgggcaggcgctgaggattggggccggcagcgcgcctgaccccgcccctcgtaggctccgccccgtgctcgcaggcgggggtttccatggtgatggtcaacaagcctcaactgcctctgctacaactgccaagttccccgcgtcccaccctcctctaggtgctccaagggaccaccggggtgcctgatatgagagcgggagtgtagagactcggaggccgaggtgaggggcggccgaagtctccgaggtcgaaggccgcacacccgggacctagcggggaccgggtccccctgggggtggggacggggggtgggatttgagattagggagactatccgaagtccagggccccgtacccggactacctggggactgggcctattggggtggggatcgttgggctggggctgggatttgggatcagggaagagcgatctgagtttaagcgccgcaaacctgggaccgagcgaggactgcacataatgaggggccgtggcgctgagatttgggtgacgggattcgaggtcgaggggcccgtacgtgggaccggcaagaactggacccactgggatcgggagacgcagcgtcggaggtcgagagccgcacgcccagacagtggtcccacgcggtgagcaccgcgggctgagattttggagtcaggaaagcgcggggaaggcacggacggccgggtgcgttagtccggccccctggcggggagctggcgactgccggagggctctgaaagtgagaacaggcctggcgcagtgggaggcccagccgggaggatctcttgagcccaggagttcccgacaagcctgggcaacatagactgtctctactgaaaagtaaagaaaaaaaaattagccacgtgtggtggcgcgcgcctgttgtcccagctactcgggaggctgaggcgggagggtcgcttgctctgaggtcgaggctgcagtgacagtgattgtgccactgcattccagccgggcgacggaaatgagaccttgtctcaaaagaagtaataatagtaataatacctgagtaaaatgaaagccgcgcgctcacgtggctgcaggcgcctgagagttgcacaagacttccttgtggggagttggctccgccctcctcccacgcccggttcccgtagccttagctctcggccccgggccctttttcctcctcggctgcgccgcgtgtcctcggagcgcggtccctgtattggtctcctgctcctagaggtatcgtgtttgtatttggggtgaaaatctgactcgtgcgcgctcttcagcttagtcgtccttttttttttccttttgtttgtttgtattaagtattttcgtcgattccgccctgctcgtaggaaacttgtggacggggcccggctcctgctgcgccggctgcccggctcccccaaccgcagagtcgtggaccagggttttgaggagcaaggcacccgactcgccctccccccaaggccgccccgggcgcgggaacccctccccctaggcgcctgggacccccgctcggctccgcgtgtgtcccggcggagggtggaaggagagccgagctcggccattgcccgcgggcggcccggggacgagctgacgcgcctctttagttctcgaaactgctcgcgggcgctgggggctcgggccggccatctgcgtggcgggacgcgaggcgcgcgctggcggctgcgcgcgaagggcaacgggcggcggcggcggcttcccggaaccgcgcggggcgggccctgcgccggggtcagggccacagcctcaggcggcagggagttctgaaagcgtagttttcagtcgttccgtcccaaaagtcatcttaattcttccaaaaatacacgcatataattctttctacttagttatatttttaaaagttaaatacgtggttgtctctgaattcctagtaagatgaaaatttcttgggttctccaggtaggtgaaagataccttaagtgctattcctgcaaagtgactcgttgctctcacagaatttataaactataaaataagacattactactttaatgaatattaagagagagattgctttattcctaagcaagaagatcttttcccttgtaggtattacattccggtgtgcattctgtagattagagtcattatcggccgggcgaggtggctcacgcctgtaatcccagcatttagggaggccgaggtgtgggaggatcgcttgggccccagagacctaccccgtctctataaaaaaatatgtattattttttgagacagggtctcactttgttgcccaggctggagtgcaatggtgtgatctcggctcgctgccgagatcctcctgtgctcaacggatcctcccacctcagccgccgagtatctgggaccacgggcactctccagcacgcccggcaaatttttgtattttttgtagagatggggtctccttatgttgcccagattgattttcaaacttttgtgctcaagcgattctcacgcctctgcctcccaaagtgctgggattacaggcgtgagccatcgtgcccggccacttttttgtaaactgccaagttttctgttaagggtagcgttataaagctttattcaggtaaaaaatggaatttatttaagggaaaagactgagtaaatagaaagttacttctcccacgtggccagaaccttggaaagcctggaggcaaatgagagcccggtgggggtagatgcctgcaggggctgcagaaatgtgacaggccctttccttggaggtgacttctctaattccctctcccccactgagctctggttctctgctcttcgggagaaccacattagttgactcttactaggtcctagaagttttactccattttctaattacatgctcaggactactccagaagggcttgctattagccccatgtttcagatgagaaaatggaggttgggagaagtcatgtgtccagggacacaattgggacttgggacccagtcccaactgggtcccaagttggaccgggacacccctcccctgccagggcccttgccctgtcttagttgccctgagctacggttcttgtggagggcaacagggtgggcagagggagaactgagctcagccaagaccgccctggcttattttacagcaaatcccagaccaataaggtctttattaataaataaatccgcagtatttctaagaacttttaaaacctaaccatgatactgctgtcatgcctaaaaatacattccaaaatatcaagtatccagggtttaagtgtttctgtattaaatttttttttttttccgagacggaatcttgctcttgtcacccaggctggagtgcagtggcacaatctcagctcactgcaaactccatctcccgggttaatgccattctcctgcctcagcctcccgagttgctgggactacaggcggccgccaccatgcccggctaattttttgtatttttagtagaggcggggtttcatcatgttagcagggatggtctcgatctcctgacctcgtgatccgccggcctcggcctcccaaagtgctgggattacaggcgtgagccaccgcgcccggcatgtattaaatattttaaacagctggttggtttgagtcaggatccaaagtcacaccttatattttgtagataactttttaaattcagagcagcactgtccaatagaaatataatgtatgctataaatgtaatcttatattctttagtggtaaaaggaaacatgattcattgtattaataatttaacctaatatatatccactactattttgcatgtaattttaaaacactttttcatttctccatgatcttgactaaaataattaaaaacaaaatcctgtgaacttgtcaaaatccagtgtgagttttacacttacacatttcaagcgtggtgaatggatgctgtgtaagtgatcatctagaggttcccctttcttaaaaggctccatcccccgttatatttgtcgggctgtcttgcagcattccttccccacacttcgcatttttctgattgtttttccgtggtggtctttgagtgtctgttctttatatttcctgtaaagtgatagttacctctagaggtagtttttggttttggttttatttttgtttttgagacggagttttggttttgttgcccaggctggagtgcaatggtgtgatcttgtctcactgcctcctgggttcaagcaattctcttgcctcagcctcctgagtaactgggattacaggggtatttttagtagagacggagtatcaacttgttggtcaggctggtctcaacctcctgacctcaggtgatccacccgcctcagcctcccaaagtgctgggattactggtgtgagccaccgcacccagtctggaggtagttttgattcagatgagagtttttggaaagaaaacttacttgaggtgctgtgctccaaccggaggcacatattggttggtatcttctcttttgtcatgttacagcagctattaatgatcattatgtagatccattattttcttaaatggttttcaaattagtgatattttaataatcgattccttttcatttattagcaggaatactttttcatgtgatcgctctaagatgtacttttgtttttgttttcctttttttttttttttatagacggattctcactctgtcacccaggctggagtgcagtggcaggatccaggctcactgcagcctccgcctcctgggttcaggcgattctcaggctcgtgagcagctgggattacaggtgtgcagcaccaccacgcccatctaatagtagagatggtggagtggcagggggtggggggtttcaccatgttggccaggctggtctcaaactcctgacctcaagtgatccacctgccttggcctcccaaagtgctgggattacaggcgtgagtcacccaccacgcccagccctccacatttttttttttcgagaaagggtttcactttgatgcccacactggagtgccctggtgtggacagagctcactgcagcctcaacctcctgggctcaggcaatcctgcctcatccccccaagtagctgggattacaggtgtgtgccacatgcccagctatttttttttgtattttttgtagagaaggggttttgccatgtcgcccagggtggtctcctgagctcaagtgatctgcccacctcggcctcccaaagtgctgggattacaggtgtgagccactatatatggcctcagttcttccttgacataaattcagcttagcatttctcataaaacattaaaaaagtacctctatactttgtctccattgatacatcagtatgagaaattgcagtgattgagtttgaaatgatcaactacacttgcattcctgaaatccaacttggtcataatatcgctttatatattgctggattaggttgactgatacttggtttggacttttgcatctgagttcttgagtgaaattagcctgtgatacttgattaattgtaaaactcttttggaaatgaaaaaatcaattccaagttcattgtagatgtaagtgtaaaaatttagagaagaacatcaacgctttgtaagttcagataactatatgggctggggctaggaaaaagatctcttgaaaatgacacaggctgggcggggtggttcacacctttaatcccagcagggccaaggcaggcggattgcttgaggccaggagtccaagaccagcctggccaatgtggcgaaaccccatctctactaaaaatacaaaaatttgccaggtgtggtggtgtgcatctgtaatcccaggctgaggcaggagaattgcttgaactcaggaggtggaggttgcagtgaaccgagagtggaatgatggtttgagctcaggagttcaagataagcctgggcaagatggcaagaccctatcttttcaaaaacagaatttttaattagccaggtatgatagcgaacacttgtaaagacatagaggatgcagtgagttgtgattgcagtactgcataccaccctgagcaagaaagcaagaccccgtttaaaaaaaaaaagccatcataattaagaaaaggcatgacagattaagactcctattagatttatcctaacggtatgcctcctgttagacaaaatgcttcacctaatacaaatacagatactcttacttactgttatatcccgataaatccatcataagttatttgattagaatagtgccatctaatagaattatgatgtttatgacaaatacatatcttttctaatttaagttggtgttagataccatatacgatcctcttaaagtacatagaattcagaagttagttttcttgtgatgtttttgtctggtttggtaacacgttgtattagtatgctagggctgccatgcaaagtaatacagactagtaacaaattttctcacggttatggaggctagaagtcttaagatgagggtgttgatagggttggtttcttttcaggcaggagaaataatgtgaatagtaggaattccagaaggagaaaaagacacagatggaggcagcaagagaagcgataaaggattagaagtgaattttcctggcttaagatccctgtagttcccattaggatattttgaaaagacacagcacaggcgtgtgttggtaaaactcctaaagtatagaggaaactgctttggaaaaagtatgtcctccaaatctcttatcttctcccccattgtttctgttttgatgtttattctacttcgttttcctttctttgaattcattactaacttttaaatttaaaactcagttttagttccagaaagtttttttttttaagttttgtaatggagtggtatctgaagttgctctttttttcctgttaaaatcattatggtttttgtctagcacttcttgttccctgaaacctgaggtgtggtatgttatttctgggtgccggagcccctcttctgtaaattgtcatgttcctttcctccttccatctctctgttctgcacaattcccccaaggcagaatgcagtggtcccctgggcagcacagctcagggccagcagtctcagctcagggcctgctgcttggaacctgactaaggtgtcatgtttccatggaggcttcaggaagaattcccatcccaaggaatgtaccttcctcagggggctgaggataccccacaggcctcctttctctccagctccagggtttgactatgcacctatttaggggctgcttgctcaagggagagaggtacaggaggtggtctgggaaaaacaaaattgatcttcctatcaattgtatttttgtttagcggaatctatacacacccatttctttggatattatttccagttactccagctaatccaaataatgatatttgccctcagttaagaacagattttatttttaggaacagaagtctagtagcagttttgctttttattaacgttttaaggaacatttaccttagatatcatgattcttgggcatttgcaaaatgcagtcaatatcaaacagcaatggttgcttgttttatgatcggtcagaatttgtcccttatattaatttcagtacaaacagtatagataaaatttatctaacattacattatactactcttgatgctttttagtaacacagcttttgagaaatgaacgctgagggaagcagtgtgttatccccccagacttagctacagcaagtaagtgaaaggacctgatagatggtaatggaaaacagctttcctgttgcatgcagatcaggacagatcccctttggtggatataaatgtagtaataatggagtaaacatttaaaatgttaatatatgctccatctgcagcttctcagtcttttttttttttgagacggagtctcgctctatcgcccaggctggagtgcagtggtgcgatctgggctccctgcaagttccgcctcccgggttcacaccattctcctgcctcagcctcctgagtagctgggactacaggtgcctgccaccacgtttggctaatttttgtatttttagtagagacgaggtttcaccgtattagccctcctgacctcgtgatccacccgcctcggcctcccaaagtgctgggattacaggcatgagccactgtgcctggccacttctcagtccttaatagcttttaggatagctctgtgtattgaatttggcacgttgtgtgaattgggttagaattctcacacttcagatacatgtgcccctgaaaagttaagtacaaatgtgtgcgttggtgcatttttttaaatggaattagtgtcttgtatcataattcttgagttcatgacagcaggaagtacttaagagtgactgaataggaattttataaaattgctgggttggaagatacttttgaggccattaaacccaattttcaatatttccaacagaaaaggaaaacatccataacaaatatggtctatgatctgctcacatactatataccatgatggggaatttttgcccccaagatgcatcttgtgcttctcatgtggtgaacagacacgagcagcagaagctgtgtcctaaaatttcttcaatctaaaggattcaccacgaaataagaatatgaatacaaagcatccagcaccaaaatgtatcccagtaaagggctttggtaaaaaatataaataatttgaacaagtgtccagaggggagataatgtacagaaggaaaaaagaataatgggcttttaacttcttttttttccctcagtttttatctttttcctatatagagatgggagtctcactatactgcgcaggctggtctcgaactctcttgggctcaagtgatcctcccacctcggcctcccaaagtgctggagttacaggcttgagccactgctcctggccagcttctactttaaacctcagctatttatcaaggaaaaaagaatttcccttctttctacatgaaattcatcactcagtgttcccactcacccatgctcctgtctgtttaaatgtcacttcctcagaaccccaatctgagctaatgcctattttctgtttttcgttcattctaaaatttgtcatcatatatttgtacatttcttgatttcctactccactgttactggacccaccaaggcaggaactgtgtctctttaccactacagttcctgtatcttttaggtgcgtagtatttcttggtgagtcagtcagtctccagactcagtcatttttctctacattacacattctttcacattcttctcccaccagtcttcctagacttgtttcattccttcccatcttgtctccatgtatctcttcccaccattcattttccagatagcatctagactgttgtgttaaaaagcaaaactcctttcacaccacattccattaaatgccttcccactggcctttgaacaccaaaccaggcctttaaggctatgtcatctcctaccattgatctcagacctagctgcagttgcacaatacaacccctggctcaagtcttctgcacacattgttccctcacaggcaggaaccctatggtgactgatcaataattaaaacttgccttgggccaggcacagtggcttatacctataatcctagcactttgggaggccaaggtggatcagttgagcccaggagttacagaccagtctgggcatcatagagagaccttgcctctactaaaaaattaaaaaaaaaattagcccggcttggtggcatgcacctgtggtcccagctacgttggggaggctaaaggtgggaggatcatttgagcccaggaggttgaggctaatgtgcctgtcacacagattcaacagttactaatcatggacagttattctccatctccccacctactactttgtggacaacttcaaacaaatccaagccatcacaaatatttcaagatggatttctaaaacttaattgctttattttataacataaccataattctgtgggttcttttatctggctggaactattctgaggtaggactggctcatttgtccttgtagtttcccacagtctacatcactatatgcagtatgttactgttccctgtaattcgtgttatttagtaagtgcattctaaagacttgctttctctcagttttacaaacagttgtattagccgggtgtggttgcatgccagtggtcccagctactcaggaggctgaggttggaggcttgcttgagcctgggaggttgaggctgcattgccatgatcgtgccactgcattccagcctgggcagctgagccagaccctgtctcaaaataataataattctgttaaaaacgtaaaacaggccgggcgcggtggctcacacctgtaatcccagcactttgagaggctgaagtgggtggatcacaaggtcaggagttgagaccagcctgaccaacatggtgaaaccctgtctctactaaaaatacaaaaattagccagggtgtggtagcgcacgcctataatcccagctactcaggaggttgaggccaggagaatcgcttgaacctgggaggggaggttgcagtgagccgagatcgtgccattgcactccagcccgggcaacagagcaagactgtctctcaaaaaaaaaaaaaaacaacaacaacaaactccaaacaggccgggcatggggctcgcacctataatcccagtactttgggaggccgaggcagggggatcacgaggtcaagatatcgagaccagcctagccaacacggtgaaaccacatctctactaaaaacaaaaactagctgggtatagtggcatgggcctatagtcccagctactcgggaggctgaggcaggagaatcgccttaacccaggaggcagaggttgcagtgagccaagatcatgccactgcactccagcctgggtgacagagtgaaaactgtgtctcaaaaaaaaccaaccaaacaaacaaaacagtcaaacatacacaaaagtagaaacaagtgtaatgaaactctatgtatacatcaggagctttaataaaaattactagttcatagcacatcttgtttcatgtatatttccactttccacgtaatctgaaacattcaagaaatcaggtatcatctgcaaatatttgtggctctaaaaagggtcttttaaagaaataaaattacagtataatgacaacaaaatttacaattctgcaatataaaatgtcactgatcatattatcgaaattgctttatagttgttctccagttcatttgaattaagattcagaggtccacaaaattgcgttagttaaaagtttaggaattgcgttaaaaaaattttttttcaaagattttttttcaaaatctttacgtgtgtccatggtcaaatgtacaaaccaaggtacgtccgctagttccattttagaggcggcctcccagagaggggctgtgtctaacttgctggcttctcttccactctgcactgcccgcccttccccgtggctggcactctggactttccccaggtcgcgctcgcgcctggctcccttcgggagaactcggagaaatgtcttcccgccgccctgactctctccttcccccacttcctgcctgggcccagcgcgcgggccacggggccgcacctgcaggcacgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggtgagccgccgcgcgggcgccccggccccgccactccagtcccggccgccccccccaggtccctttccgccgccccggtcgctcggagacggacgcagacctacgagcgcctcttcccttccctcccttcagccgcgctcggcccgcgggtccccgagctcccgcctaggcagcgctagcttggcgggccggggagcagcccccaccccaccttgccgtcgccctcgctctcgccctcagggccccggaagcccgccaggggccccctcccctcccctcccctcccctccccctcccgcgaggcgcccttccctccgggaaccctcccgtccctgcccccactctccccgctgcgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggtaagtctagagcatgaaagtccgcgggcccggccgggtggactttggtttgagagtggaactaagtgagtaatgggggcggcgcggccagacgcgctcccagcctcctggcgagagtgctgcccggtttcccgggggcacgggagtgtgtctaggaggggaggccaggatccttcctcgagtcctgtcctgaacaaaagaaaacgaggtgggtggtgcttgaacggccctgtttactctgcagatagccgaactggtaggactccggcgcgccctatttatcttgattggctctgcctgaaggcaagcgttaatcccgtccaacctgtatcactgcgaagagctcgttcgggagcgctttttggaaatgcagattcttagcccccacccagatctgttttagggttggtgttttaattatctaggtggcccccgtgcaagctcgatctgaaaacctccgggtccagtcacctgggggagctgagcagccctccccgcccccagcgctttcttggcgctgcggacggggagaccagactcttcctctgcgtgcgttggcggtgcgcagtggccgtggtctacaggcttacagcggctggtccattggggtaaatgggtgtacgtgggtctggttgccagcttgtgcatgtccccagagacgcctcagggtgttggtctgtggatcacgcagggataaacaagggcataagtggatcagatcattaagatgactgggttccaccctttagatccttgaacaagtcggattgttgaagccttttgaaaacctgattccagagtacttgaaactgtttcacccctgaataggtttcctaataaatgtaatgctttccatttgtacacccccccaatagtgtcttaagtaataatcactggaagtttgcaagacaaggcagatttgattatcttcatgttaagacaacaggttcagcataattagctggttttactaattccacatttccaaaactcaagcagcttagttctcagaattccatagccctcagcccgtgtcctagtcctttggggcagcgtttttactgggatgttggtgatctagtgattatgatgtatgttctagtgaagcatatttcaaagaagttacccaataaaactgaaagtgtcttttggatgtgtctccacactgcttacagaggggttcctataaatcagactgaacaatttctagcaagcacccttgctccttgcccatgctatcccagtgaaagaggggtcttaaggtcaagtcccctgtggttgtcacttctcccccacccatctccctcccaagtgccctgcccccgatatttaaatttcctcccagcacttagggtcctcagtgtacaaacttagaattgggcagaggcgggcggatcacctgaggtcaggagtttgggaccagcctggccaacatattgaaatcccatttctactaaaaatacaaaaattcgctgggtggggtggtgcacgcctgtaataccaggtactgaggcaggagaatctcatcaagagtaaatctcatcaagatcaataaggcgtttcccttttgttgtgctctgtattgccctgtgaaaagataatacttccaaaatgctgttaggtggatggggtgtgagatttaatttaaacccacgggctatataaagggcttcccagctgtttctgtccttacctggagttctgatcccagagccagtgcctaggatctgagaccacacagccaatatcgctctgttttttttttaggacatttcattaccatccagaagtgtctcccactgaaggcatccgtggttgtttttaaggtaagctattttaagaagagccccttttcagctgcagtatttatatttgttatactcaaatttgtttagcagcctggagtgaaaaaagttttgtccctaacattaaccttgagcaggacaccacagggctcttttcagcttgagttttagttaatgaaaagccttaggacttctgagaaatggaacagaaaaccaattctggagtaaaaataagcagtaagtgttttaagtgtacacatgtgttttggaaaggaatggtctcttcgccttgccttcagagaggaagtaattttgcttctgaaacatttcctgatgcaaaacacttatgacatgtaaaagattaggcattttaagtaattcttctatgaaatgtttttattttttatgctgcttgtatgtctttttcagcctagccaggccactgccttcttgaggaaggtgttgacccccctacacatgggcaacagttaatcctggctaatcttggaccagctgggtcaagtctgtgctgaggatggggtcatggtggccaacaaaacaggcacaagtttctccccagtaggctcctattgtgggtttaagacccctttaacaacacaagagtgctgtggttagtgtagagcatgagacttaatttggataatgagaagacctttgagaaaggtggtgtatttgagcttagaccttaaggattagtgggatttaggtagacagaaggttgaacagagtatatttggggagagaattaaccatgagtgtcaactatgtgcgtcacatccctgaaggggcagagagcttgccacattccaggagaaaaaaggaagtgatgtgagcttaggtagaagagtgttgcaggcaaaagttgcaaggcctgagggaccccattgggcctgtggtccttgttctgaggtcagtgggaaaccactgaggacttggatgcaggacagtaatgagttttaaaagtacacgtgagccgtagatgggattgcagtaaggcctagccactgtgcttggaaaacttttttttttttttgagatggagttttgctcctgttgcctaggctggagtgcagtgacgcgacattggctcaccgcaacctctgcctcccaggttcaagcgattctcctgcctcagccttcctgagtagctgggattataggcatgcgccaccacgcctggctaattttgtatttttagtagaaacggagtttctccatgttggtcaggctggtcttgaactcctgacttcaggtgacctgcccgcctcagcctcccaaagtgctaggattacaggcatgagccactgcgcccggcctatgcttggacttatttaaaagatatatcggtaatctggaattggctgtttgtacatacaggaattagaataggagaaataacaatatgaggtacagaaagaaaatgacaatttgataactcccattacaaagaaaagaattactgagttcataggctgccattcaacgtgttaggaacagggtagagctgtgaggcacctttattgctgaggaaatggaagagttgaataggatttagggatgaggatactgtggagaatgggatcacccaagggagttgagttgattggatttgagggcttgggagaaggtcaaggattactccagtttccttctagagcctctgggtgcaggtaggggcagtcatgttgctattggagtgtgacagaagagagaatgtgaggtttagttgtggcacagaggagaacctgtggagtggagttgtgtctacccgtctaggcttcagggagccgaagactgggggtttgtgtatctcctgaccctggagatgattatggagaccctgggagcaggtgagtccactgagaagaggacttgggcccaagcctgattccctacagttaatggttaaggaaggactcagagactgtctaaggaattaactggaaaaccaacagtaattgccaacaggagtgaaagggagaggatttccaggaaagaatggttaagtaagatgaagataaaaacatttgctctttttcttgccatggagatctgtatagtaggatcatgcagtttttttgtttgtttttgtttttgagacgagtctctgtcgcctaggctggagtgcagtggcacgatctcagctcactgcaacctctgccttccaggtccaagcgattctcctgtcccagcgtctggagtagctgggattactggcgcccgccacgacgcctggctaatttttgtatttttagtagagacggggtttcaccatgttagccaggatggtctcgatctcctgacctcatgatccacctgcctcagcctcccaaagtgctgggattacaggtgtgaggcactgtgcccggccaatttttctgtatttttagtagagacagggtttcactatgttggctaggctggtctggaactcctgacctcaaatgatctgcctgccttggccacccaaagtgctgggattacaggcgtgagccactgcgctcaacctaggtgtccaccactatgctcggctaatttttgtatttttggtagaggcgggatttcaccatgttggtcaggctggtcttgaactcctggctccggttatccaccctccttgacctcctaaagtgctgggattacaggcggtgagccaccacacgtggccttgatcatgcagttttaatggaggggagtggaagtgacagtagaggccttttgacaagattttgctgaacaaatcaacaagtagctagaggcaaagttggcacaggggaggtatgacatgattgggtagaactgagcatgtttaattaccaagtagacagggctcagtggagaaaggggaaaaggaaaaaaagaagaaagcatggctccggggtatgtgaggttggacccagagcagagctgttgttcacgatgtccgctgtaaggggcccactacgtgcttacaaactcctggactctgacttgacttcacaaagtccacttccaagagtaatgtcaaccagctggagaggaggtgagagtctgtaaggctgccccagacatctgaagggctttggacaagcagggtgctggggtaggacagtgggcgatattgagggcccgcttactctatggctgttcactctgattttcttttttttttcttgtgtggtgggtttttttttggagttagtctcgctccgtcacccgggctggagtacaatggtgcgatctccactcactgaaaactccgcttcctgggttcaggtgattctcttgcctcagcctccgtagtggctgggactacaggcgcccaccaccacgtccaggtaattttttttttttttttgagacagagtcttgcactgtcgcccaggctggagtgcagtggtgcgatcttggcttactgcaacctctgcctcccaggttcaagcgatgctcctgcctcagcctcccaagtagctgggactacaggtgcccaccatcacgcccggctagttttttgtatttttagtcgagacagaggttttgtctattggaactcatgatctcaagtggtcccacccacctcggcctcccaaagtgctaggattataggtgggagccactgtgcctggcctcaccctgatttctacagtatttcacaacttgggggcagcattagccaccagagaacatttgggaatgtctggagacattcggttgtcagaactggaggtggagggtgctactggcatctagtgggcagagaccagggatgcagctaaacatcctacagtgcctgggcctgcctccacaacacaaagaactgtctggtccaaaatgtcagtagtcctgaggctgagaaattgtagcttagaggcaccgtttcgcctggctgtgtgcagctgagccactcagtacatccatggagtagtcagatatttgtttggaatcttccagagctctggttttactgggcgcgtacagttaagaagttcattgaatgaattccatgtattgtgaggaaggaatgtaaaatgatacttgctctaagctggattatgaagaatgaggagagaaagaggctgtgtggataaggaagccaaggtctctacaaaggagggggatagcagttgtggtggagggagtaggatgtgattaggtggggtttcctgcagggaatggtgaaatcattggaggtaggagtccaggagaaaatggttagtggattatggcttcatctcccctacccggaacgatggctggacctaaggctaggaacagaactcgagggaggccttcagatacttttcatgagtgaggagcaagaccagggtatggtcaaagacaaaaggacaggcggtgcctagcctgacccagtgttgggaatggaattgcataagaagcccccacctgtaattgagctgtcccagacccattatcccaagagacacaatacaaacttgccctgactctccaaggaggagcttctgaactgttagcacagaattccctccgtggacaggagaggaagaatctgctgtgaccttgctctgccagatcagcatgttgcagtggccatatgcaggggatttagataaggccctggggaggcggagaccattactttctaaggtggaggctaaaccccagggtttgttgcagacccaaagcacagtttgagaattggggataggattatttatgcccaatcatttgccgttcaggattattttataaaagttgatggagtttatgtacatagtcaataatttgaggtgggcaatgagcaatccaggttaggctccccttgactctcttcccagaggcttccatgttccactctcattagcaagggtgacatcttttagttaggctgtatactttgaaagcccttgcattccaaatcacagttcgtgagtaaatgccgagtgtttggtcttggtgatgtgttcaggatatcacatactgttctgtttcatttgtgccattatgcttgttattgggagaggagacacatcttgttatctttataatctggtgtagacacaggtaaatttgaaagatttacacaattatccttttagacgttgtcaatttgaaatgatgaagcactgtatgataatatgtcattatctgcaatggctacatcaaactttaaaattactaattttccctgaagctagtgcagttgagcatttatttagtatgaatttgcttttccttttcttaaattacacttacctttactttttgtctgttttttaaattgtggggttttcttatggagcttttttccccacatgatgagcccatatttcttgaaaaggccaccagctatatctattatgcttgatgtaaaatgacactttgaaacattcgatttccagctgtgcatggtggctcacgccagtaattccagcactttgggcagctgaggtgggcggatcacctgaggtcaggagttcaagaccaacctcgccaacatggtgaaatcccgtatctcctaaaagtataaaaaattagccgtgcgtggcggctggtgcatgtaatcccagctactcaggaggctgagacaggagaatttcgtgaacccaggaggcggaggttgcagtgagccgagacagcaccactgcactccagcctgggcgacagtgagactcttgtctcaaaaaaaaaaaaaaaaaaaaaaattccatatactcctatgctctttttgagcgtcacccttgacagtgttcatataaaaatacgtctttggccccatgatactgcagtgtttttcttgcttgtgactatgttatagaccctgctgtctaggtcagctgctcctctttctcagaagactgccttccagtgtgtggttggccttactctgagtttggacttcaggtgccatgtaccaccctggtgggaagggcatttctcagccctcttgcgattgccctttcttcccgatgccctcttccagatcttcagcacaaggcagcaattctgctatattttatgtgaacctgtgaatcatctgatctggtttctccatttatttgcagtgcacataactaagtctgctggtgaatttgtctgcttgtctgtatatgtcatcagtttggcctcatacttgactggtatttagtttgaattgacaatttaggagcaaaatcataactccatagacagtggaagccattgctgtcttgtatcctggcaacattactgctgatgagaacactagaaaatcttaccctatgttgtggtttaaaaacagcctgctatgttcccatcccttatttttactcatgaaagtaaaagtatcctaccatagacaagcagatttactaaatttactattttaccaaatgtaaggcgtatagtttaggaggaacaactcaggagctcttataggtgaactgccacatattatcatgacaaatatgtggaataaatataacaaggaaatgcccttgctctaaactgactgaaacttacatttctctgtgttcaaggcaccacattcacatgcatcgtcctgtcttgtaaactcctgatttgtttttcaaactgcctgtgactgataatgtaattttttgagagacctggagttaactcttagctctcaattgtatttggtatatttcttaatgtcttgctacctctctcgtctgtaaaatggggaaaatttctgttgcatactaaataaatttttcttttttttttttccagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 35852 - DNA, 50172 bp, Homo sapiens
agcctgagaggggagagcgagaaagagcgcgagcgagcgaggcctgggccttgcctgaggtagggctctctcttcaccccggccggtgcctgcggaggagagggcctcctccctttccacccactgcgggcctcctctgatccggatccggcctggtttgggggtggcgtgggggagggagggcgatggggtggagctcccccaaactcccccatgtggccctcagtttggtgtgcgaaggattaatttgttccggctgggaggtagggaggagattggccccgtgggctctcgatgtggcgctgaggggggtgagcctcccatcctccacccgtgggcttgcgtcccctctccgtttccaggctctttgtcagctcctcttattaccctcccttctttctcaccaacccagttcttggaatatgtttttgctgctgtctttagcttcctgtttatactgtagtttgggtaccccaaacaattgtgttatttgggaagctggacatggaggcccccatagggtgtatttacgcttaagggacgtcactagagcactggggtatttgttcactcttctcataatggtacaggaatgcccagtttcttcaaacccttaaccttgtggacagcccttaaattgctttgcaaactgatgtcacaaactggagactgctccttttccaccattcttgaaatgtagccacctctggtgtaggatgttgtggaaagaaaaacaccacagtaacaggcgtttttgttattattgttaacgtttttgcctttgactctccctgattattaaatggagaaatcctttttttttgtcttctctcccatcctaccttcctccgccgcatatcctgttttggggatacctgatgtgacttgctgggaggtgatggacattactagtaaccagcgtttctagagaattaaaacattttggctgtgtatcagttgataaaactgctttgagatctgtctccattgtacttaaagattagactatcccaatgattacagagaattaaaacattttggctgtgtatcagttgataaaactgctttgagatctgacaccattgtccttaaagattagactatctcaatgattgtttcctttgtgaatgggaaatattgctggcacataaactagtgatgaaaggcctaaaaatgtcctgttttgtttttcatctttaaagctcctccttgctatgtcctaactgggaagtactcttactaactagatatcaaggtggtggggaaggggatgcaggggccatttcaacaaagcatctacagaaattagttgttctgttagaggtagcaaattttacccaactcagtctagcttcagtttctgaattgtttcttaaattagattgtaagctccctgagggcagctactaagtcatactgcttttgtattttcctgaagtattggacacatagtagattctcaataaatatttgttatttagttttttcagtgaaatttctctggctatttttttaagtagctagttttcaaaaaagagtcaagggcactcctgtgttgaaacctctgtttactctcgcacgatttccttggtctccaatacttctcaccctacttcctttaaatctttttattttctaagaaagagcaagtaagtaacaagattcttcatctccagtgtgatagctgggaatgggtctgcttgctactaattctgtgccctcaagtgatccattccagatcacttacttttgacctgttgctcagtgttgtcactactaggtggtaaaaattttcttagtcacatttcgaagcacttgtaagagggaaatgttactagcaagagtgattaggagaatttttttctttcttggttaattatatctttcaagatgactttttaatatgtttacatctgactggtacagtatatgcaatagtgtatagctagtcatgcagtttatacctgcaatataacttatcctcacaaatagatatcacatgtggagtagaaaacagtcaatatttgtaagttacagtagtgggttggaaatgactatgccatattagaaacttcatcttagagccaattttaaaacaaaatagttttcctctcgtctttatatatatacgtatatatgtgtatatgtagtcttgttgatttggattcggggtacttggttaaacattttttttttttgtaaagttgaaacgactataatgctaacctgggaaaatgggctactgtgtagcaaataatcctttctagcttgaaatacttatgggcttttgtgtgccaatatgtgtagggggaagaggtaatgggttaaaaattacctgagaagctaccttaaaaaaatctttcttgatacaaagacctatgcaacctattgacgcaacttggtgaagaatttatgcacagaaaaagtcagctttctctgtgacatccaagaaagtcagatgaaattcacttccctaatagttaatccttgcatatttctttagaagtccttcctcccactcaaatccagtaatatctctgggcagtctagaattacgttgtataaggtttcattaacaagaaaaattaaatatagagcagaaaagtataaacttaccctctttggaagggaataaatgcagagtaacctattattttgaacactctatcatatgattaatgttttcttttttactaaatgcagcagctgagattgtattataaaacaaagtatgaactaaaggaacttgaattcagtagaatccttccttgttagaagtcttgtaacaaaaactatattctggtttggggaaggccctgtgtgttctgtgtctctttaaagactcaactaagtcatcttgccagcattaaggtctcaagtttaaaatgatttcttagaagcactttcttccaaataaaactttgtgctagatgcttttggtttgagacaaatttgagattccctgtatattaaggtgagtggtggagggtaattgccattttggtttcttgaaaatgtggactaggagaccaagagaagcacctgtaaaagcagtgtgttggaattattttccagagaacagagattctggacaaagtcattggggctaatacgtaccctgttgaaggctgtggtttaaaaaaacaaaaaacccccacaaacacaaaacaaacccatagcatactgagagagatgaaacttgagggacaaagaagagtctagacttgaacttgtcctttcccaagcaatggaggtcacatgcagcttacataaaaaaggttgtaaggcaggtaaggctgttttcttaggtgattgaatacagtatttaaaattatttctctggagtgtagactaatctccttcctggaaggtttttgtttccagactttactgattatctttccttctgtcaaaggtacttcagatacttgcatctatgtaaaaggcttttgattattagttaaatgtaaagtctgcttatgggggactagtaaccaaactgctgtaacttcttaaaaaaatccatcacttacacatgctttatacatttcttgttacataaaaatggattaacagccatagctccttaaggaatttatcaagctaattatgttgtaagaataaatgaatcttattgatttgttcctttgaagaagtgaaagtgtttggtggtgaaggtgctgatgagagagttaaaaacatattttgcccacatttaatacctaattttcttttaaatctttcagtattctaccttgtaaatactgttatttgtatatactgtaaatgatgacatcggtgggcactaaccgagcccggggaaactgggaacaacctcaaaaccaaaaccagacacagcacaagcagcggccacaggtaaataatccaaggcatacggattcatggatagcgttgcctgctgatactggtttccatgcagtacagcatcattctgtgctttgaactgttggtttaggttccttatttttgttttctagtccttggctctttttttacttaggtcctgataactgttcatgacatgctgtaaggcaagatgcttacttttttgttgtttaatactgtattatgaggcttagcactttattatgggtcctgtgctttttatcttttttttttttgttttgttttaagataggagctccctttgcctaggtcaaagtgcagtggcacagtcaccattcatttgtagcctcaacctctggggcttaagtgatcctcccgcctcagcctcctgagtagctgggactaccagtgcacactaccatgccaggctaattttaaaattcttgtagagatggtagtcttgctgcattgcccaggctggtcttgaactcatgggattataggtgtgagtcactgcccggctctataactcttaagatagcatttcccttctcttacctgggccattttagcaatacctttctatttcttagaccttccaccttgatatctctctcttttgtttttgagacggagtctcgctctgttgcccaggcttgagtgcaatggcgccacttcggctcactgcaacctctgccttccaggttcaagcaattctcctgcctcagctttctgagtagctgggattacaggagtgtgctaccatgcccagctaatttttgtatttttagtagagacagggtttcaccgtgttggtcaggctggtctcgaactcctgccctcaggtgatccacctgcctcggcctcccagagtactgggattataggcatgagccgctgtgccctgccccaccttgatacctctctagcaagccttttccattccagattttatcctttgctcctcttttccccaacttgtcttttattttcctctctggttccattgagaccttacctgattattcctttcccatgaggagctggcaacttcactatgtttcttcaaaattaaatgaaacaccttagagcattgctcaattttaagttttaaagagtaaattaacctcttggatattaactttgatgtagatatattctgtttctcataccaggttgatgttagttggtatgtaatgtgaatgaattacttatatttgattatggtcagataaatcgaatatgtaagattaggacatcccccttacgcatttttctttcatctgtgttttcaagtggatttctagtagaattataatacttagttggggcagtaaaattcctagtatctgaacatacactggatatatagaagatgtgttgagtctattgtcagacttgtattctaagctctaggaataagaggatggcgttggttattacagaaataagaatagagtttacacatggctttgtgacttaatatgaattaaggggcagatgtttcagagcggttctgtgattctaagacggaagtccctttaactgtgaagattggtgaatgagttccttactctttctgtaacagtttcactcaattttttgtcattttactgatttaagcatctttttttttgaggtggagtcttgctctatcacttaggctggagtgcagtgccactatctcagttcactgcaacctcctcctcccagattcaagcaattctcctgcctcagcctcccgagtagctggacctacaggtgtgcaccaccacacccggctaatttttgtatttttagtagagacggggttttgccatgttggccaggctggtctcaaactactcacatcaggtgatctgtctgccttgggctcccaaagtgtggaattacaggcgtgagccaccacccgcacctatccctgatcccccattaagcgtcctaaatggtgctttattacttgctcatttgttacaaggaaaagaaaattggggcagtggaggctgacgaaataggttcctgttctctaaactgttgcctcatgattatgctttcttgatctcatctcaattcctaggccactgcagaacaaattagacttgcacagatgatttcggaccataatgatgctgactttgaggagaaggtgaaacaagtgagtgtatcactaatttactgtacactatgagaaaagataccagtattaaggcataatcaaatactgtagatggatgccaggatactttctactataggtattgaaagaattttgacctgaaatataataggtcaggccaataaataagtgctttcattctctaattttttgtagccctttgttttgttttttgtttttttttcagatgaagtctcactctgtcacccaggctggagtgcagtggcatgatcttggctcattgcagcttctgcctcccgagttcaagcgattctcgtgcttcagcctcccgagtagttgggattacaggcgctcaccaccatgcctggctaattttttgtatttttagtaaagatggggtttcaccatgttggccaggctggtctcgaactcctgacctcaagtgatctgcctgcctcagcctcccaaagtgctgggattacaggtgtgagccactgcacccagcctattgtagccctttggatagatactttgtttggaaattttatcttaattttaacctcttgcctgttgctgatgccattttgtagaaactgagcagttgtgggtataggaaatgtggaaattcatgctgaagcctgtgtgtttcagagtttgattctgtatttgatgcttaattgctttgtaaatacttttgacctcatccctgaaccacagatgttaatatttggcttttggaaatagaataccaaaattctacatgttttcctttttggcgggggttgggggggtggttctggaaaacctgctaggcaaattctacatcatttttctttctttcttttttgtttttttttttattttgagacggagtcttgctctgtggtccaggctagagtgcagtggcgcaatctcagctcactgcaacctccgcctcctgggttcaagcaattcttctgccccagcctcccaagtagctaggattacaggcgcccgccaccacacccagctaatttttgtatttttagtagagacaggtttaatcattttggtcaggttggtctcaaactcctgacctcaggtgatccgcccacctcagccttgcaaagtgctgggattataggcgtgagccactgtgcccagccctcatcttttgctttttaaacttgtttttttcaaactcaactgatagcgtttcccttcacctagtttcctttcattgggagtgtgagcataagcctgttcatgatggttgctgttttttctctttcagttgattgatattacaggcaagaaccaggatgaatgtgtgattgctttgcatgactgcaatggagatgtcaacagagctatcaatgttcttctggaaggaaacccagacacggtagagtgcttatagagtgttctaggacatgggtcctcaattgggaggctagtaatgttctaaaagtagcaaatggcaacataccttaaagcagagcacctttttcttgaagtaaagttgggaactttcttggagattgttcaccacaggttataaatacttaaaatttatgtgtactacatcctttttatgaggataatgctcataggagaaaacagtgaaatcagtctctgctaattggcctggaataaattatttattccaggctagtgactgttttcaggctgtggggttaggctgaattagaggtgcgatttgatagccttggatattgctgttgaacaaagtcacacactatacttgattctgtttttttttctttttattttattttattttatttattttacatatttgattctgaattcaggacattcccctcaatatcagcttcgcattgcacactactgtttcattgcctgaacttccttctgttgaggtagcagagaaacaagctttgtagcctgctgaccatccctggagatgataggggatatcttggaggatctcttgccctggaatttagacaagtcgctttcacttctccttcccacttcatgagaattctgtttttatgcttgtcttatgtttgtaccaaattgtaatcctctgactgccttattgatcttcagaatgttcctgcagtgcttactagagaaattttgtttttttaatgagcagtgtattattattattattattattttgagccagggtcttactctgtggccctggctggagtacactgacatgctgcaacctcctcgtcctgggcttaggtgatcctcctacttcagcctcctgagtagctgggaccacaggcatgggccaccatgtccagctgattttcccatttttagtagagccagggtttctccatgttgctcaggctgatttcaaactcctggactcaagctagctgcccgcctcgtcctcccaaagtgctgggattatgggcatgagccaccgcacctggcccagtgtattattttgaaatcattttcatttattgggtcttatactggggctctttggttggaatagatatcaaaattcatccttacagataacaacttgttttttttcttgagtcagagtcttgctcttgttgcccaggctggagtgcagtggcgtgaacctgctctctgcagcctccacctcccaggttcaagtgatcctgtgcctcagcctccagagtagctgggattacaggcattcaccaccatacccagctaattttttttttttgagacggtgtctctctctgtctcccaggccggagtacatctcggctcactgcaaactctgcctcctgggttcaagcaattctcatgcctcagcttcccgagtagctgggactacaggcatgcaccaccatgcctggctaattttttgtattttagtggagacagtgtttcactatgttgcccagggtggtcttgaactcctgagctcaggcaatcctcctgcctcggccttccaaaatgttaggattacaggcgtgagccatgaaacctggcctcagatacaacagctttctgatactacagagtcactccagctaaatgcaggaggtttgtcaatttctttgagacaatgggaaataataatggaaaacttttaaaaacaattgaatttaaattggtgggttttttcttcaaaagtgttatcctggattaaattttacactgttgaccttatttgaatatttactatctggccaatcaagatatgcttttgatttgttttgggtttactctagaataattgtctccagattttatggggggaatcaggtggggctatttatgtttttttaaaagtctgaatgttttttcgcaaatcacattttatcttaccttccagcatcttctgtctagtgctataaggctgatgttatacagtatcaaaaaggaaaataagctggagaatataggtttatgttacgaataaactagctactagtgaaaccaatgggaagcaaagtcagctcccagggatattggatgtatttgggtgggtgagatcatttcagaaaactgaagtcgcctttgggaagataatagtaattctttctcctgacccatcttgtgccagcaacagatgtgcatacagaggagggagaaaggttacagtttcctgaaacttgccaggttttgagatagcagcataaattctaaaagctgttttgagtctagcttccagagtgttcctggtgtatatttagctacagggttgttctaacttactgtgagcataaaatgacccactaactgtaatgtataataggcttgggttggaagagtaggcagcaacaaactaccaagtcttgggtaggtaatctttttaaaacaaatgaattaagagatggggtcttgccctgtcacccaggctggagtgcagtagcatgatcactgcagccatggacacctgggttcaagcaatcctcccacctcagcctctttagtagctgggacaacaggtgtgcgccaccacacttggcttttttttttttttcttttttcttttttttgagatggagtcttgctctgttgcccaggctggagtgcaatggtgagatctcggctcactgcagcctctgcctcctgggctcaagcgtttttcccacctcagcctcccaagcagctagggccacaggtgtgtgccaccacacctggctgattttggtatgtttagtagagacagggttttgccatgttgcctaggatggtctctaactcctggcctcaagtgatccaccctccttggcctcggaaagtgctgggattataggtgtgagccaccatccccggccctgttttctatttctatgaatttgcctgttttagagatctcatgtaagtgaaatcatgtaatatttgaccttgtatgtctaacttacttcacttagtgtaatgtttcaaggttcgtccatattgtggcatgggtcagaatttcattcctttttaaggctaatattccgttgtacatatatgtggcattttgtttactcatcagtggacacttggaattatctggaagttgtagacataatacttgatacccttaagttcttcaacatgcttcccttaaaggaggatactcttacattaccataatactattatcaatcctgataaggttaataattttgtattatctaatactcagcccatattctgaaagtgattagacattaggtagctgttactgagcactagggccatgattgagtttgatggtaagataataaagatctgaggctgtgcacagtggctcacacctgtaatcccagcactttgggaggccatggcgggcggatcacgaggtcaagtgatcaagaccatcctggccaacatggtgaaaccccatctctactaaaaatgcaaaaattagctgggcctggtggtgccctgtagtcccagttgcttgggaggctgaggcaggagaatcacttcaacctgggaggcggaggttgcagtgagccgagatcgcaccactgcactccagcatggtgacaaagtgagactaagtttccaaaaaaaaaaaaaggaaagaaatctgatagtgttggtgtttgtcctggaagttccatttgtacaggttttttacaaaaatatgtgtaaatcaaggtatgcatttttttaaaaacttttaagtttacaatgctcattttcctgaggaagagtgttttgcaagggtgttaagcttattttccttaccacagactttccctcttgcagttaggaatgtatcatagatatgtatttttcactggggaaagttaaattggctgataccaatttaggaaatatagggagaacactgcaagtaaaacctggatggaaggctttgtataatcagtatctcttggggtcagggctgcgactgtcgtttggtcttcttttatttttatttttatatactttttgagacagggtcttactctgtcacctagactgagtacagtcacataaccacgactcaccgcagcctcaatctcctgggctcaagtgatcattctgcctcagccttcaagtggtttgggtgacaggagtgtaccaccatacttggctaatttttaaatttttagtagagaccagagtctcatttggttgcctgggctggtctcagattcctggcctgaaatgatcctcctgccttgatctctcgacctcccaaagtgctgaggttataggtgtgagccaccacacccagccttacctttttttcttttttttttttttgagatggagactcctctgtcgcccaggctggagtgcaatggcaggatctcagcttactgcaacctccgactcctgggttcaagcgattctcctgccccagtctcccgagtagcggggattacaggtgcctgccaccacgcccagctaattttttgtatttttggtagagacagggtttcactatgttggccaggctgttctcaaactcttgacctcaggcaatccactctcctcggcctcccaaagtgctggaattacaggcgtgagtcaccgcgcctggcccttttttttctttttttttctttgagatggaaccttgctctgtggcccaggctagagtgcagtggtgtggtgcgatcttgcgtcattgcaacctccacctcccaggttcaagcagttctcctgcttcagcctcctgagtagctgggattacaggtgcgcaccaccacacctggctgatttttgtatttttagtagagacggggtttcaccgtgttggccaggctggtctcaaactcctgcccttgtgatctgcccgccttggcctcccaaagtgctgggattacaggtgtgagccaccgcacctggccacccagcctgatcttttaaatgaaattgctgtgtgtgtgtgtgtgtgtgtgtgtgtctgtaggtaggtagctctagttgttttcctcctaaatttatgggtgagattagagaacgtgcccaagagtagaatgctgctcattcattctgaattcataggtaacttttagaaacattttcttttttgctttatttggtatgaatgatgctataaaaagttgtgggtcactgactccgaaggaaattagttttttcttttttttttttagcccaggaaataacacttgaaagatagggaccaataacttggtcctttgactaatatgctaagtgactgaattagatagaggtctttgtaatcctcttggaagtgatccctgcaatgtttcctataagtaccttccctacaaaaaagactttatggctgggcttggtggctcacgtctgtaatcccagcactttgggtgcagtggctcacatctgtaatcccagcactttaagaggccgaggtgggtggaccacctgtggtcaggagtttgagagaccagcctggccaacgtggtgaaaccctgtctttactaaaaatacaaaaattagccgggcatggtgtcgcgtgcctgtaatcccagctacttgagagactgaggcacgagaatcgcttgaacctgggaggtggaggttgcagtgagccaagatcacaccactgcactccagcctgggcaacagagcgagactctgtctcaaaaataaataaataaataaatataaataaataaaaaataaaggactttactttttgtagtgatatgtataaaatatttaaacagaagtaaaagcaaactaatggaagtgttttagacatggatgctgagtggagaatggttaagtcaatcagtcatcccagctttcatctctagtgtcctgatagcactccatattgattagatatgaatgctctacccttctatagcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtgggtcagtaatgtctagactctagggatgtgccagggccctgctagtcaggacctaggaaccattatattatccttttgcttttcttgccgtcgtctgttctgagaccttgacatctcttgcatgtggccttttctaccaactgccaccagtctggcatgagattaccctgtagtcatttataaagttaaatttgacttgcagctctccattaaggcacattaccattccctgagaaacatgttcccatccttccagctcattttctcttcgttgtttttttaattcccaataccatattacataccatttatatatttgtatatatcctgttgactgtgctctggccatctgtggtttggtttttttgttgttgttgttgttttaatttttatttttatttcagttcgaggtcaggaaaatggattggatggcaccaagagtggagggccttctggaagaggaacagaaagaggcagaaggggccgtggccgaggcagaggtgatcagtttgttgggggatggatattgggggcaggttactctttattcattaatggtctgctttattttttttttttattggaggtagtctcactctcacccaggccggagtgcagtggcacagtcatagctcactgcagcctcagactcctgggctcaagtgatcctcctgcctcagcctccctagtagctaagactacaggtggccgccagtatgcctggctaattttttttgagatggagtctcgcactgtcacccaggctggagtgcagtggcgcgatcttggctcactgcaacctctgcctcccgggttcaagcgattcttctgcctcagtctcccaagtagctgggattacaagcgtgcgtcactacgcccagctaatttttgtatttttagtagagatgggctttcactacattggccaggctggcctcgaactcctgacctaaagtgatgcgcccgcctcgctaatttttaaatgcttttgtagagatggagtctcaatatgttgcccagggtggtctcaaactcctggcttcaagagatcttcctgcttggcctctccaagtgctgaggttataggtgtgagagacagcacttggctccagggtctactttgtttaaaaacaaattaacatgaagtctagttagttaattcctgaggtgtcatgcatatactagagattgcagaaggggagagtgagaaagaaggtagatgtcatttcctctagtctttattgctagtattgtatttgcttgaggacatggtagtctgagagcaaaagaaaaatctctcaacagtaatgattgtcctactctattactgatgtgtaacatgggacagagagaaagaacatctgatagtatcaaccactttttattccagagctgcctcagctggcagggtagttttttgtatttttgaggcaaggtttcactgtcacccaggctggagtgcagtagtgcggtcttagctcactgtagcctctgcctcctggattcaagtgatcctcctgcctcagcccctcaaggagctgggactataggtgtgtgccaccacactcagcaaatttttgtactttttatagagatagggttttgctctattgcctaggctggtctcgaacttctggatgcaaccaatccgcccgccctcagcctttcaaagtgctgggattaccaccgggagccactgtgcctgcctggcaaggaagttttatatcaacttctaaaatacatctctcttctctttttctcattctttctttaggtggctctggtaggcgaggaggaaggttttctgctcaaggaatggggtaagtttcattgatctagtgtcttaattttttttcccttaaaaattactgtaggcagccttaaccaaaatgatcagaatgatttctagactggtcagaaagatatggggacttagggctcatttcttagggataaacctttaccacctggatcattacctatattttatatatctttatttgaatcaatatacctgttcttttctcagaatatcttagatatatgttgagattataccatgaaattttgggtagagtgataagtgagaaaaagtagatgacacacaggattatagaatggggccatgacagatttgtactaggaaggatgcagtcaagattttgattctttgagttaatatttgccaaagctgcttagaggtcagagactcttaagttttattttttccagaacctttaacccagctgattatgcagagccagccaatactgatgataactatggcaatagcagcggcaatacgtggaacaacactggccactttgaaccagatgatgggacgagtgagtgaccatttatcattcatttcttgtctctgggaatctaaggaaatagttttttctgattatacttacattaaaacgtggaagaatagtgtttggttatggagatagggtgagaaagggctggcagttgtattactgtgtgtactgtttatgtaacgtgcatatgggcacattacacatgttatttcgcttaatgctgcttgatattgtatgaaataatcattatttatcatcactttccagatgacaaaactaaggccgaaagagaggttataaatttgctagtatttgaactcagcattgtttgaccctgaaagtccatgccctttcaactatgctatgtcactgctattaggtccaagtgtattttctagtgtttatgttagggtagtgttgccttttgaaaagatagccagaattaatcaagccactgcttgtaaagatgaacaaggcctagaatcaaagtccacactatccatttatttgttttctgttactgagataagaatatcctttttttccctttatttttgggacatgtcagtatctgaacaagaagatttcgaaatctctctagcctttctggtgccctgttgaacagccttcttggtgtgatggagtattcagggtttgaataagattacttttttgttaactgactttggtgcctgcgtctgggctggatataaatgtttaaggatatgttaagctgtggtatacacctaagatgtgtttgggggtggatacgtgtgccactttcaataagagcagttcattttagtaagaaaactctggagtgctttcttgaacagctgcctcattctggctgagctaacacatgagagcctaaggctttttttcctcttacaaagggggatgagtagggcctgaaatgtttgactccttacctgtttaaatttgccttgtcacctttcacagatacgtgatctctgggcctttaggagagcctttggcacaaatagttttccacctttttcctacaatatattattcctgaggctctgaatgtcgtctgctttttgttcgccaagttgctatcttataaattcatttttaacacatttcatgggtggaggctgaagttgagttacaagataggtatctttgaatttctgcatcatttagttacgaaatgtcctgttatagtttaacttactatacttcggaggcattagaactgttcttcattcatctcttgatggctttgtagaggcagtggtagcagtctcaataacaaataagttactgtttttgagctgtagcttattcctgggtatttggctttttatctttggcaggtaagatggcagaagttgaaaagtttgtttttagttgtgaatagaaattcaggcatggggtcccagtccttagccttcgctgtcttcagtaaggatctggttggaaaaacagcgaaaggtagtgtgtgtgttaatttctactgagtagaaaagggagcagatgtgcaaggctggaattggaaatctgatttgtagctgaatgtgacgccactatcgtcttgttagtgcaaaagtgttggttatagcttcatgaattcccattgtcattaattttttttttcttttctttttttcttttttgagacagagtcttgctctgtcactcaggctggagtgcagtggtgcgatcttggctcactacagcctctgcctcctgagttcaagctattctcatgtctcagcctcctgagtagctgggactacaggtgcacgccaccacgcctggctaatttttgtatttttagtagagatggggtttcactatgttggccaggctggtctcaaactcctgacctcaagtgatccacctgccttggcctcccaaagtgctgggattacaggtgtgagccaccacgcctggtcgttgttaatttcatgatatgaacataccttcatgcatggtttctttttgtgttttcctgatagcaaacttgagtttcccctttaaattaaaaaaaaaatccaaacctacctttaaaatatccacaggtacaatggggattatgtattggggcagactttctcatttacaagcaaaatttcactggttgttttttcttttcttttcttttttttttgtttcaggacttgatttcattggggttgaggggtcaaattatcccccaaaattatcccccagactgctcctggtatgatacatccaggtgcctaactgccccagatatttttgtagatttttatgagctgaaatatctgtggatatgtcatttttatgtctttctgctttttctctttctgcctttttctctcatttttctgtgtccacttacctttctgttcatttaatgaatatttgacagttacactgattgctttctgctaatggaatggaaaccctagtctgttgtttagagcatttccatctattctgttccttaatgcttcctcagctctctctcttcctcagccatgaccgtatatcctgaataggaacataccagttaggtgtctacgttcctcctttccatcccagttgaagtcatcagtgtgcagaaaaaaattcttgcatcaagagcctagattaaataacctgttagatcatgtctaactctaggattgtgtataagtgctaatgcaacttggattccatcgagccaggataagatggatgtcaatgagaagaaagtgtggtatcaatgaaggagaaaagaatgtggtttgtaacttgtctgtactgagattggactttggttttgagaatattgtcattattaagtggtttaggatttccctggtgcaattttaatattttcctgggaaagtctttacaatgaatatattttcctctaagaaagaagatttttgcattattaaatgtttagaagaattttagatgggctttgtattagaatacttctaatgtggtgttagaatacttctcttcagtggcacagcatctgaatgtcagacttttcatttcattcttataagcttttttccagtaggagggaaggattgaagagttatttaatatatattattctagcaagaaaataagggtgctcttgtcccttcttcagacaggttcttgtttttactgtgcctttggctgaagggaagaatcctggttcttgttagaaattctcacccttattttttaagaaaggacatttttttttttctgaaaatatatgtatacatgaagcacaaaaaaggaatgtggaaggtggtttgattgcttttggatttctccagtagaaactgtatcccagcttccgtattaccaacaaacacaaggacagtgtatactcccgttgtctgtgccatgaccatagcaggtcaggtttcaagttctatatgagtaaggttaggacagtaactatcattcatacctgatttttcagtcttgttcattgtcttttgaagaggacagctctataggggcttttcttatacagttaaaccaataagatctataaacttgacttctgctgagtatgcatttttaatctaattctcatagcagatagttttcaatgccctcagttcgggtttcaaacccacccttcttcactgctctttcactaaccattatgtggtaaccatttgtgtttctctatcagtgctactatccttcttcagactgcctacagtattttttgtcttatactagataaataggtgtagtttgcatgttatggtttaaattggctgctgccatttcactgaattgaccactaaatcaacctgaggaccttaaagatactgctttgagcattgggtggttgtctgtctgtccccccccccacccccattcctgctttgtaacaaaaactgaaagtagctatgaaatcataatcttattaaaaccctggtactctgagatatccttttctaaagagtgtttccttacctttgaagcccaagaatttctttttttttgttttgttttttgtttttgtttgttttgagacagtttcactcttgttgcccaggctggagtgcaatgccgcgatctcagctcactgcaacctccacctcccaggttcaagccattcttctgcctcagcctcccgcgtagctgggattacaggcatgtgccaccacgcccagctaattttgtatttttagtagagacagggtttctccatgttggtcaggctggtctcgaactcccgacctcaagtgatccacccacctcggcctctcaaagtattaggattataggtgtgagccaccacacctggccttctgattactaaattttagtcatacttttggctgccaaaaaaattaatacattgatgttttctatacatgctttgtactggcatttaatagtgaagttacttcactatttttctttattctcaggtgcatggaggactgcaacagaggagtgggggactgaagattggaatgaagatgtaggtattcccaggtcattcctcactaatgccttctatccctaagtgttgtttagggatagaaaatgggtatgtttctacccctcaaaattcacccttaagattctgacccaaaacttttacatccaaaatagtgttctgagccagaacatttcacatatgttatatgaaggagactgggcatgaacaggactctgtggaaccacactatggaaagggcaagtgcacttgtgtaagtccaatatctgattgtcggatttatcccaggaagagattggtggttgggtagggcaccagaagtggagttaggcaggtagtgcattgagtaacagctgctggtggtacatgactacttggtgcatttaagtatttgctataaggtcctgtaatggattggcagtggatccaaagcgagtgttgtggtaccaaatcctcaaacttgtaatctggttgactctggaacccttgtatttatttgaagcccaactgtataattgtgattgagatgaatatctgtagaattggctatctgccagcttgacttaacttggaaacctcatagatgggtggcacgtaaacaagctctgtgaattcatttgagtactacctgagtaagaattttgctgattcctggtcacagtcaagcttctgctgtgaattatggttttcagtgatcatggataaactcttgttttaacatttttaatctatgtacttttctatactttcatgtagttaggcaagacagcttttgtgataagaggaaatgacatgtgaagactgttttggttgccaattctgggttttttaaatttcagaggcatcagcatcacagggtgattattttctattgtataatcaatgaactagactgctttgtgaaaatgggcaaattatgttcctttctgagatttggcttgtccgcttaagcaactttcagagaatgataaatggtgttgggcattgaggggagagtggattttctgtgctttagcgattttaatcaagaaataaaactgaaacccaaatcaacttttgaatagtaggaaaagttaatccctgcatttgcttacctaagtttgatgccttaatagtggaaggactagatgtcacaaagtcaaatattaaggcaaaaataacatctagttaaaacgatctcccataaaaaccttaattcagcagcacttgggcccttactgctcaaaagctaaaaatgaacttcttttatttatttcttcatcttggttatgatctttctttgggaggggtggggctgtgaagggagtagtagaagacaaatgtggtttgggaagaggtgggagttgggaactgtaatgggaaaatatagagggattttctttcttttatttttttttttttatgtctagcatgcctgtaagttcagtatgcatatgatcatgtgactccactatattttattgggttccttgcttctactctttctttggctaaaactattgagcatatattgaagggcttgaaagtcaatccattcaggattcctcagggtagatagttttctctttatagggctttcactttttcttgatgttgaattccccttacctatgccaagtttctgactgtagcatccctgacaccaagagtgactaatccctctgttttccagctttctgagaccaagatcttcactgcctctaatgtgtcttcagtgcctctgcctgcggagaatgtgacaatcactgctggtcagaggcaagtgtgcagtaaaatttagtaccatttcttaaacacatctgctgagattactgtaaagagaagtggcactggcctttgtaaactcccatggtgtcaataataataaccaaattacattacatcattacattcctcttaagttgatggagagacttctttttttttttgtttttgagacagagtctcactgtatcggccaggctggagtgcagtggcacgatttcggctcactgcaacctctgcctcctgggctcaagcaattctcctgcctcagtctcccgagtagctgggattacaggcgtgtgccaccacgcctggctaatttttgtatttttagtagagacggtgtttcaccatgttggccaggctggtctcgaactcctgacctcgggtaatccgcccacctctgcctcccgaagtgctgggattacaggcatgaaccaccgcgccagttgatggagagacttctaagagttagtactagttaatctgctgaatggaagttgatatgttacaattttaaagttgattctccctgcaaatagcactttaattacaaagatcagcctttcatatcaccagcattgagtatataacttgttttgaagtaagtcagggaaagaagagccaaaagtggaaatgttttcatttatttctgaatcttttagaactgttcagcagtttattctcctgttctctgagcccactgagtataacagttgtttttttcctttggatcagcaggatccagctaataaacgttttagaatttaaatctctagggatcagtggtaggagatacactcttcagggaatatttttaattcgctggaaacctcttggattttttctagacctgagcctgatagctcaaaaattcagttctgacgttaactacccagagttaatgcagaccccacaagttgaaagctcagttctacaagagtgccccaacttcagaggttctgccagccagctacaaatttggaggttcccatgaccgcctttcaagtttgataactcactagaatgactgaactcaggagttttacttgccgttactgtttttttgtttttgtttttgagacgagacggagtcttgttctgtcacccaggctggagtgcagtggcgtgatcttggctcactgcaaccttctcctgggttcaagccattcttctgcctcagcctccctagtatctgggattacaggcatgcaccactatacccagctaattttttatttttagtagaggcagcgtttcaccatgttggccagcctgacctcaggtgatccacccacctcagcctcccaaagtgctgggattacaggtgtgagccaccacacctggcccattactggtttattataaaggtacaactcagcaacagctaaacggaagaaatgagtagggcaaggtatgaatgggtatgtgggtggggcacacacaacctccttgtcctctgcaggtatcctgaagctctccaaatcttattgttatgagttttattacctaggcatgattgattaaatcattggccattggtgattggacttaatagccacctcgcctacacccctggaatttggtgggattgggaggggcttctgaaagttccaacactcttacctggtctctttttttgagacagagtctcactctgttgcccaggctggagggcagtggcacaatcttggctcactgcaacctccgcctcccaggttcaagcgattctcctgcctcagcctcccgagtagctggtatagtaggcacccgccaccacgccaggctaagttttgtatttttagtagggttttaccatgttggccaggctggtctcaaactcctgacttcaagtatccgcctgctttggcctcccaaagtgccgagttacaggtgtgagccactgcatccagccttatctggtctttctagtgaccaaccctcatcctgaaactatctggggccccaccctgggctacctcattagcattcaggtatggttgaaagaagtgtgttatgagtaacaaaggacactatcacttaggaaattctaaatgttttaggagctccatgccaggaacaaggcaaagctcaagtatatattataccacaggtaacttttgaaattttacgaaaattgtgggaaaaaatatctctcagactgcccctgttctaaagccatttgaagattccagtgttctggtatatgattttctgttttaggaattggtaatgacaggtattcagtattaaaatcatggataagtacttgtaagttttggctgagttattgagctgccatgttaaaactagcatttgaggccgggtgcggtgcggtggctaacgcctgtaatcccagcactttgggaggccaaggcgggcggatcatgaggtcaggagattgagaccatcctggctaacacgtgaaaccccttctctattaaaaatacaaaaaaaaaaaattagccgggcgtggtggcaggcacctgtagtcccagctacaggctgaggcaggagaatggcgtgaacccaggaggcagagctagcagtgagccaagattgcaccactgcactccagcctgggtgacagagcgagactttctcgaaacaaacaaacaaacaaaaactagcatttgatatttcattaaattaataacttcacttaaaaaattaaccattattattggcaacatcagtggaattcagctatatactgtagtgactcttatgcatcagttattttgggacatttaagcatttcaaggcttttgtgtttgaacccttttagaagaagccccagcaagtggcttcattttgatctaatctgatttgagtgttggggaatgttagcgtgttcagtcattcttcatgaagatcccttcccttccccattagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagtaggaaacgtggtttatcctaatcaaaccttcctgctaatcctagcacacatacacagttccttccaaagacagtcaggtttttggcaggtgaagcatcctctttgtcttcttaagcagacttggttgtagaaatgtttgagttgggtaatagggggtagctctaagagaggacttagttctggacagactgaatattcttataagaataagttaacattatttattgactactcattgtgctgaatgaacaccatttgccattactcttgagagaaaatcaatgacataaacttgtcaatacattttaatccttttgcagccctcattaaactatgatgggagattgtagcagttccccatttcttgatggatcagaattgtcttgtatatttacttaaaccaggtatttgtagacaaggcctccagaaacctatggtcttcccatttctgccacttactagctgtgtctccatttctatgtaaatagggataaaagtgctagtccttcccatcttcccaaaggtggctatacaagtgtggtttcagtagtgatattataaataacttagaacttatgacatattacttgttgactcagagcatttaaaacatccaaggtcattaacgacatcaaaggaatcatttaaactaaacaaagatgctacaagtaccagttttctcatagtcattgagtcctgagaagtactgctttttctttttttctctttttctctcctattttttgatggagggatactaaagttgtaagcagaccatgtgtgtgcatataattttatttttccagttagagtaattagtttaactagaaaactgccaagctagctactaattcagaactcggtcagtttttaattgttgtcttaaaatgttttttgtgtgtgttaagttagtaatttggtggtcgatgtcctgccacataggaaaggtaacaggtgagaagaggtgggaggagaagggaaatggagagaagtgttgggattaaatagaaaaagaagaaagaaaataggacaaaggttgtaagaaggtgtaatgaagatcaagaagtaactaccaacccttaaagataaatgactggaaaatgtgattatgtgatctatgtctcttaattgccctcttaatgtctggaattgtgaaaatttacaacgaaatcagacttttgatatcaaaaagatgttttcagctggggacagtgacacgttcctgtagtctcagctactctggaggctgaagtgggaggattgcttgagactaggagttcaagactatagtgagctttgagctcaccactgtactccagcctgggtgacagaatgaaaccctttctctaaaaaaaaattttttttaaataaaaatgtgaaaactaagtataaatactattctgtttttttgttgcctgtactaatcaatatgttagataatgtaatttcctttctattgagaataaatgttagaggattaatttcacttaaaatttaatagagctaaataacatgggagtttctttatatttttatgtataatacagtgaacactaggtaattttaattgtttttattttttatttattttttatttttttttgagacagagtttcactcttgttgcctaggctggagtgcaatggcgcgatcttggctcaccgcaacctccacctcctgggttcaagcaattctcctgcctcagcctcctgagtagctggggttacaggcgcccgccaccacgcttggctaattttgtatttttagcagagacagggtttcaccatgttggtcaggctggtttaggactcctgacctaaggtgagctgcccgcctcagcctcccaaagtgctgggattacaggcgtgagccaccgcattcggcccagtgattaccctatagaacttgtatgtacatggagaaaacaatcaaatcatactgacttgctacttgattgtctagtgcagaagttgggatgccctttaacttttcctttttgcctctgtgctagttattagcagcatcgagatgaggctccagttaattgttgtttcttttgagtttttttaatgagaagggcaaggaccttaatggcaaaagtaaaatcttatattacatttatgttaattgtattggttgatttaaaaattctcggctgggtgtgatggctcacgcctctaatcccagcactttgggaggccgaggcgggtggatcacgaggtcaggagatcgagaccatcctggctaacacagtgaaacgctgtctctactaaaaatacaaaaaattagccgggtgtggtggcgggtgcctgtagtcccagctactcgggaggctgaggcaggagaatggtgtgaacctgggaggcggagcttgcagtgagccgagatagcaccactgcactccagcctgggtgacagagcgagactctgtctcaaaaacaaaaacaaaaacaaaaattctccagtcagccaaattttatccctgagaagcagggagaaggaagtaatgatgatatgaagttttaatggctctgtttttttagtgattactatgtgccatacatgtattaagtgctttaatttatttaatcctcctacagctttacttttattcctatttccagatgaggaaagagagattaaaaaatagtttttccaagcttacatagccaggatttcaatctaagacagtctgactctaggtcctatactctagtggactatgctgtatactcagtgtgacagtattctttacttgcctgatctatactggctctcggtctggataagtgtctttatgagtagctgaacaaggttactggctgtaggtttctctcatctctttgttgatctacaggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatggtgagaagatggaaagtgacttgaatctttaaagcattggagcattactgtcaagaggctagcagggggagggggtggagaatgtgtcctgaagtgaagaaaaggggcagctagttggttaccttcccacatgtatttcccctaatcaaataagctgaattcaagaagttggggaataataaaatttgaggctatgtatttctcatcacatttagaggctgggcatggtagcttacacctgtaatcctagcactttgggaggttgaagtgggaggacagcctgagccttaggagttcaagaacagcctgagcaacatatcaagactccatttctaaaaaaattgttttcaattagctgagtgcggtggtgtgcacctgtggtcccagcccctagtgagggtgagctagtgtgaagctagctttccgcaaaaaaaaaaaaaaaaagaaaaatttttaaccatatacatagttgcagtcttctgttgattggggttttaattattattattattctccttagatttatcttcagtgtttgaaaataacatattgcctccaggttcttaggcttagccatcttaagaccttatacagtaagtcttcacttaatgtcattgataggttcttgcgactttatgcgaaacataagacaaggtctagttctgtcatccagaccggagtacagtggcactatcttggctcactcatcttcctgggctcaagcagtcctcccacctgagcctcctgagtagctgggaccacaggcttgtaccaccatgcctggctaatttttaattttttgtagagatgggttttcaccgtgttgcccaggtgtgtctcttgggctcaggcgatctgctggtcttggcctcccaaagtgatgggattgcaggcgtgagccattgcacctggccatttttttttcctcatcaacattataatgaaatcatgttgaaggaaacaacgttatgccaagatatgccatgccttgtttttgcttaaagccagtttccaagcacctatggatgttaaatgagaacttgcggtactttaaacttggacaatttgtgcattcctgtcttacacagacagggtaatgttgatttagttaggctttatttaaggatggttgtaggccaggtgcggcagctcatgcctgtaatcctagcacttcgagaagccgaggcggacggatcacttgaggtcaggagttcgagaccagcctggccaacatgacaaaaccccgtgtctactaaaaacacaaaaattagccaggcatggtggcgcgcgcctgtagtcccagctactctgaggcaagagaattgctttaacccaggagtcggatgttgaagtgggctgagattgcaccattgcattccagcctgggtgacagagcaagactcccatctcaaaaaaaaaaaaaaaaaaaagatgtaatccagtgattgtcacctatagaaatgagattaagccccaaaagagggcctgcttatatgagtttctgatttttacagtcctcattcatggtgctagtgcaggacaatagcatttccttgagattcattagcatctctggcttcatatactgggtttcctcttgcagatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaaggtacttaaacttttaggtagataccattttatggcaaggggtgtggggcttgagaattgagattaaaagggtaagtttggaaatttaaagggaagggttttttttagtctttagtaaggttgtattaaagccattactttctcttctccttcaactttatagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccaggtagaggaaacattaaccataagacctctcttattaacctttactacttttttaatctgtgggagatttctagaactctggagaggccaagcccctctgcatggctgagggggaaagtagtcagtcatagcatttttagtgctttaaaatattgttattagggttatctgtaactaaacaggtagaaatatgccccttaggggctgggtgtgatggctgacacttataatcccagcactttgggtggccaaggcaggaggattgcttgaggccaggagttcaagaccagcctgggcaacataatgagtccctgtctctacaaaaaaaatttttttttaaacacagagtttcactctgttgcttaggctggaatgcagtggtgcgatctcggcttactgcaacctctgccacccgggttcaagcgattctcctgcctcagcctcccgagtagctgggattacaggtgcccaccaccataaccagcaaatttttgtattttttagtagagatggtgttttaccatgttggccaggctggtctagaactcatgacctcaagcgatctacccacctcggcctcccaaagtgctgggattacaggggtgagcaaccgtgcccagcccagattttttttttttttttttttttagatggagttttgctctgttgccaggctggagtgcagtggtgtgatctcggctcactgtaacctctgcctcccaggttctagcaattctcctgcctcagcttcctgagtagctgagattactggaatgtgccaccacatccggctaatttttgtatttttagtagagacagggtttcaccatgttggccaggctggtcttgaactcctgacctcgggtgatctgccctcctcggcctcccaaaggactgggattacagtcatgaggcaccacgcctggctcagagttttgctcttgttgcccaggctgaagtgcaatggtgcaatctccgctcactgcaacctctgcctcccaggtttaagcaattctcctgcctcagcctccctagtagctggaattacaggcatgcaccaccatgcccagctaattttgtatttttagtagacatggggtttcaccatgttgttcaggccagtcttgaactcctgaatggagatgatctgcccaccttggcctccaaaagtgctgggattacaggcgtgagccaccacacccggcccaaatcttatatggttcttgagggagcctagaattcagaattctctaaaatgagtgtgaacaaaagatggcttttcctgtgcttagggtccatgttataatgtatagaaggggccaagagtaatgtatcctgtataccgacatttagccacttttttattttgagacagagtcttgctcttgtcacacaggctggagtgcaatggcacgatctcagctcactgcaacctctgcctcccaggttcaagtgattctcctgcctcagcctcctgagtagctgggattacaggcgcccaccaccatgcctggctattttttgtatttttagtagagacaaggtttcgccatgttggccaggctggtctcgatctcctgaccttgtaatctgcccaccttggcttcccaaagtgctgggattacaggcatgagccacggcttccgggtccactttttcttataacagcaaaatgtaggggggagccaagggacttttctcttccttgaagacttgaagatgtttttaagatttttttttttttttttttgagatggagtctcgctctgtcacccaggctggagtgcagtggcttgatctcggctcactgcaagctgcgcctcccgggttcatgccagtctcctgcctactcccaagtagctgggactacaggtgcccgccaccatgcccggctaatttttttgtatttttagtagagaccatgttagccaggatggtcttgatctcctgacctcgtgatccgcccgcctcgaccttccaaagtgctgggattacaggcgtgagccactgcgcccggcctagatgtttttttaagattaattcttaattcagatctctggcgctatagaaggtagggattcctagtgttatcaggaggaaattttggtagattcttctatttgttgctgaaaaatttcttcttgattcaaatcaagttattccactagtagatctccacgatttccttagtatgagtagatatgctctattttgtttctctgagatttttctcttcgttactcacagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaaggtagtggcttcatgaacccttgggaattggttaggagaatagtgggcaaaaattccttaaatattagtgttttacttttcagcaagtggtgctaagaaactttggaagtagtgattgagaatttgaaaaaggcacacatctgtggctagtgaattaaaagttcttatcagcaaacccggagactgaagagccaggaaaccattctctttgtactaaaaattcattgcctctagtagaatcagtctcaagtgcctgtcctgtcttctgggaagatgtgattgccagatttctgggtgcgtgtcagtagacctcaccttgctaagtcctggcatggtgagggagacagcatgtgccagaggtgatgtggagtgagtgtcagatgcagccagcggaataggtggtgtggctgaactgttgtacttacccttccccaaaaatcactggatgtggactttgggcctttcctctatctgttttaggtttggggtgtcttcaacaatttgtagggtttccttcttttgcttttggtcacacagtgttggtatatctcagttttgttgtttaatttttgttcctattttggttttttggatagtctacattgtattaatattaatccttttggttaatttacagagtttctcctaaagatttgttgaccaaaataaagctgcatcagtgctaactttcctcattcacatgagtttgtctgtttcttgctcttctgttttttttttttttaccagaatggcttcagttctgtgcaggccacgcagttacagaccacacaatctgttgaaggtgagtgttcttcaggcttttcccctcctaagtttctggttttctatcttaaaatggtgataatccattagttcccttcactggacaattgagacccatgctgtgtaattctcagcattaaagaaaaaagattctacctaatatagtccattgttaaataactcatccttttgtctttggaactgccttggactgtggtcacctctctatagacattcccttttttctgatgagaggaattcctttcttctaaatttctaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcaggtgatttggggtgaggatggaggttggggttggtgaatagcaataacagagctctctggtccttattactcccttgacctggcagagaccacattagccctgcttttgtcgtaagtgggtgacctaagaactgtgggaagtgaagacagaggaggcttgttttaattttcccctttcaacatccacttttgctttaactgctctctacccctggctggccattgtgcttaacatatgatctcagacctccttggtgtcccatattatgtcttatttccttgttatgttcttgactgaagctccaggtcacgtaactatagcactatggctgatggcagcctctttttttctgacagcacgttatctacgcagcagaataccctttcatcatcaacatcttctgggcgcacttcgacatccactcttttggtaagtgtgatgctgagagggatgtgtggttttcttacacttagaactgtccaactgtaagattgtcccaagagagaattattgaaaatttcttcatgaggtggcaaaataattgatttgaggttgcaggaaaaggagtaaagggatgttaggaagccaagagaggcagaagaatccctaaacattgagctctgggtcattcctaaaagccctgaaagtgactttctgatttttttcccctactgaatatatagttgggctttgtatgctttaataaattctggaagaacatacctttccaactggtagagctgttctctttccttggtcttgggtatgcccaagttctgaaaagaatcagtgcaaggctggacatttttgtgaaagtagatgccaggtgagagcttttggtccaagagtcaattttattgttttgatttgtaacaactattaatagaattaagctgagcctgtaaagggaaggacccattttggacaaaagtatcagatttgccggaagcctggggaggtatgagggctaaggctcctttaggagtctctattcaaatacacagtttcagatttaaagtcagaattgtggacaggtgcagtggctcacctctgtaatcccaacactttgggaggccaaggcaggaggattgcttgagcccaggagtttgagaccaacctgagcaatatagtgagacctcatctccataaaaattttttgaagattggccaagcatggtggtacattcgtagagtcctagctactcgggaggctgaagtggaaggactgtttgagcccaggaggccagggttgcagtgagccaagattgcaccactgcaccccagcctgggcaacaggatgggaccctgtctcaaaaaaaatgtaaaatcagaatttttgctttttcctagtccacaaactggtctcaactagtaaagaaaagttggggagagaaagctgtgatatattttttacatctcaactctctctgttcctttatcagccagtgttagtctctggggaatctgtctccatttgctttactgtctttctgaacaggatgatgatgtgcagtgagtctgttaccattcttgccagatgagtcttgaggaatatgtagctggagattatttctaactactttagcagggtgtactttggtaccttgcctacttggcctctttaattaggaagttgacatcataatatattcagcaggagggattgtcttatttttcctgacctatgatgctgatctcttttcttcttctctcttccactgctcccccttttgaagcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggtagccttgcataagcagatggcattcctctgggatggaggaggtaagtaattgtgtgatgggataaaaatgtaatttctcttttaggaaaagctcctcccaacctccctcctggggtcccgccgttgttgcctaatccgtatattatggctccagggctgttacatgcctacccggtaagtgggactaaaggatcttcttcaaaaggtgaggatgttgtggctactctttttatagctctggcttcagatggacccctgtgaataccaaaacttgcacatactcaagccctgcagttggctctgtggaatccatgtatatgagttttgcattctgtaaatgtggccgtatttttgatctgtgtgtctggttggaaaaaattcatatataaacagcgtgcagttcaaacctgtgttaagggtcaactgtaattaaaatataaaataaatgagggattgccacatgtaatcaaactggtttttaatctttgcagttttggaaaaaatactaaactgaggccaacccatctattgtgtatctgctttggtttatggtgcacacatgtatgcatgtgtgtgtgtgcgtacaatgtgtatgtatatgtgtgatgagaatatctgccctgtttgaaacacagcttctgggcctcagaagccaaaggccagaatgttcatctggaatcctttttggtttcttagataattatgactattattttattttttgaggcagatcttgctcttttacccaggttggagtacagtggaacgatcatagctagctcactgcagccttgaactcctgggctcaagcaatcctctcacctcagactccccaagtagctaggactacaggtgtgcatccccatgcctggctaagttttaaaaatttttttagagacagggtcttcctatgttgcctaggctggtctcaaaatcccaggttcagacagtcctcctgcctcagcctctcaaataactggggttatatataggcctgagccactactcctggccccaagaattattttctctgatttgattaaatccctaactctgagtgtgtttgctggtctggcctggttagaggaaagtttcctgactcaatctgggactttgagaataagtggctgacattagtagctttttgccctagtgtatcttctgtgaccttcaagtatttggtacctattaagatgaaggatatatggaaacgttttagaagatacctgttcctgccctcatagacaaagtctagataaatttcataccgatgacacatccaaataacacagttacacatttttaatttgtggtcactaccttaaaaccctgacattggagaaaagtgaagtattctttccagaggagattatttttaagccagattttgaagagtataagagacagagacttgtagaatagagagtaaaactggttgttcgtgtatgttttgtgtctactctattggtatcaagaagccagcctactagaatcagtagtatttagctcaaggaaagcttcaagacctttcatgaatcatttaatctctgtgtactttactgctttttccttaaataaaattgaaggaaataatccgtgtcctgttctaacccagaatgaggatgaatgttctgttgaattagcttgtctcttggctccttgttttgctaacatcatgaccagttcctgttattgctatatgtctgtatctttcagccacaagtatatggttatgatgacttgcagatgcttcagacaagatttccattggtgagtatgtgggatagagctttggaaaagaaagtagtcttaaaattagtgttgggagaattatctccgtcacagacatagctctttcccatcccagccctccatacactctgatttaaggcatattagaatatagggatttgggggagggtttccaacagaagataacttttttttttgagacagagtctttctctgtcgctcaagctggagtgcagtggtgtgatcttggctcattgcaacctccgccgcctgggttaaagcaattgtctgcctcagccttccgagtagctgggattaaaggtgcccaccaccacccccagctaattttttttgtatttttagtagaggcggggtttcaccatcttggccaagctggtcttgaactcctgaccttatgatccacccgcctctgcctccctaagtgctgagcttataggcatgagccgccgcacccagccttttttttttctttttttaaatcagagttgtggcatcttagtaaatacattttaacctattctatagcccagtaaagtactctggagcactcagggtgctttctgtttgtcccagacactttaaattatcgaatgatctgttttctcagtagaataagcttggtataaactgatagggatgacacctagagggttgaaaatattggtcctcgtggactttgatgtattctcaagtgggcatacccgtagaccttgtctgactgtgctcatggccaggcaggggggacagtgtatgcaagagtaatgtggagtttgtgctaactctagccagcttaattagtgactggataaattgcacaactctcacattcttctgttttttcctccgtggaaatagtactcatgctggggaatgagtgacattgaatctctgctcttttttcccctcttttctaggattactacagcatcccatttcccacacccactactccgctgactgggagggatggtagcctggccagcaacccttattctggtaggattgggatgggactaaataaataaaaagggagatagtgttgggattgatggcagacacctgattggtagcaagaagggatgtgataaatcaggattggtagattcaaaatcctgctaaagttgggcatgtcatggcttttcctattcatcccactttgtgttgtctccctgtgatttctagatgatatcttagccaggcatggtagcacacacttgtagtctcagctacttgggaggccaaggtgggagaattgcttgagcccaggagttcaagaccagcctgggcaacatagcaagaccccatctccaaaaaaagtgatatcttgacttagtttcaagccatttgctagctttttccaggaaatacagtggttgaggtggtcttctctgctcatctctgcccctttatgctactactcacagtggcaatctcactgccttgccactccttcttttacctgacctatcattgtcctcattgacttaccgttttccctgatccatcgttgtccttcaagtccagcatggggtattccccatggaggagaagaggggagggaagaagagggaagatgaaagagaacacaagtgggcagagaaattgtgcaggtgccttattccaagagcctcctgccatagcattgcacagttattcaacattagtccttgacttgcagcaactgtgctaagtgtatgctgagcaacaataattggagccactaagaaatgtaattcaaggaattgaactttaatagtctttgaacaggatctcctggaatcatgtgaaatcagaagaggtaattctgtattggtattggggtgaaagaggcaggtacatttagcttctcctgtcacaggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtgagtacctggctttggtcactccttgtggtgaaggatcctagccctggacactatcctagctgcttttaagggtcaatgactttaataatggatgaggaggaacagtttccacctctggcctgtttttggcctgatgcagggtggtgggggaatggggctggaattggtggaattaggatagggattgcctagtcttagaatttgccaaagggagaatatgataccatacagctttgcttcactcagattcattcattccctgctgccattgtccctttttcttcctccaaactaccatttcttgacttcattagtagattctagaacagttagtaaggagctaatttcactaagcaaactgtagtcaacttgcatcaggataggtagccatctgaatggccagtacctggagcaggacaagtgggacagatggtattctgctgccaagtcactgcaaatctggcctttttgctctttaggtggctcctacctcttccaagcagcatggtgtgaatgtcagtgtgaatgcatcggccacccctttccaacagccgagtggatatgggtctcatggatacaacactggtaagctgaccttgtctctggctcggtgttatctgtggggtgttattggataaatttcagggaggaagacttggtgcttgagaaaatgggattggtgagggtgtgccgctgccccaggtatgattgttaatgcttggctgacttgggtatctgtgggagcagcaccaacagaggagcttgatactaggacatgtgtccactatttgtgacgggaatgcccaagagtatgtgttggtttttagaatatgttggttggccaaaagtgtgggtggaagtagggcaaggagccccaagattttgctgaaatgtcagtggaggcaagtgttaatagtatgtatggcactgatagtacaaaaggggggtgtattcactgagtagaaggattaaatgggttcatagctagcagcctacgataggtttggcttaaatcactttgtagcactacttttcttatgtgtccttttttattccctagctagaagacctaaactgtggagaaaaaggagtaggcgtgaccatacttaatagagtgggaattggactgggagagttgggcctttaggttccttcatttgtatggctggtctctttgcaagtctttttgcatatgtgatggcagggagggaattgtaggaatcctctggatgggtacttacctaaaagatactcagcctctcccttgcttccatacctgacatctgtgctctacttttggaggacagggagtgagaaggaatctttgaataatataattgtaccttttcagcgacttgtagatgaataggggaggagtaggtttctctgattgcttagggttggggatgggggttgtccttcaaagctgtcagctcagttacagtttcatggtgatttggatagagcagcatgtgtttttcacccttatgtgggctctgggtgggtcagttgcccacagttttcaataattgggaagagcacagaaggcagtaagggctaggaactgatagccaagtggagctttgaactgtgctgcatgagttagagtgggtcatgagttaaattaaacaaatcctgagaagccccattgagatttaatacatagactccttgtggccacccctgtcattgagcaaggttcaccctaaatcttggtggggaggattataagccttttgacttggagtggtggcccctttctgaggacattaggttgaagtcttagttggaccaggttcacgaattttaagaggtaggtgatggataatataagagaattggcatacctgattctagaaatcccaccttcttgcctcccttcagaattcagaaacgtattatatcagcccttgagaacccccagttcccaaccccacaaagggcttttgtcattccattcatttatttttatgtatttgattccttttaggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaactctggcgttctttccgtgcatgtctttgtggacactaggaaccaatgctgtgctgtggatgaagggtggagggtggcctttttaatcaaaccccagcatagccaaagaactattaatttttcagtatggtggttttatgaaggtggggggaggggaaacagcctcagtttcccacctgttgattagttggtaaaggaaactatttgtagaaatacctgattctccatgcttatgttgcttcatttttccatttagatctttcctttgcctcttacataagcagtgggggaaaggacaaaaaagtttggagtgtcatgtcatggtgaaaggcaaaagagagagttttcagagctgttagagaagtatctttcaaggcttaattcccacatctatctggttcctaaaggccaagtggctaagatctgataaagtcattagtgataagctagttgatgactcaggctctgtggcgactgtgctatcctggaacattgttcttagtcccttgatggcttttcagagatcgtggattaccagttttgcatttgtgggtataagctaaggatgtgcaggagcggtttggtcagatatctccttgactatggaaattctaattccctcccagtccagctagcatacaacattagccctttgtttataaagttaacgtggacagtgagatcaccaccctgggtgaattagaaaccaaagtattcagctttccttgtatttgttcccagccctttggagtaattttgctctgtggagtgtgaccacctttcccaggggctgccatggtgggagagatagattcatgtgtctctgccctgctgcccacgtgattctggtattgtcactgtttggggataagtagggggtgttgatgttggaaggaaagcaagagaactctgtagtctgaagatcttcctaataactggtgaggggtagtgaaatcagtacccattattttctaggtctctaatactgtaattgagattattatggctactacagagtattatggttcctgcattctcagtcccttcaacctcatatcaaagataaggcctctggactagaagctgtttttagcctaaactctggaaagaatgagatcaggtaggggcacactggagctgaattcctccctaccactcggcttgagaatccagttagtcatttcttccatccaatataggcagcctagcctcactgcagaaggtgaccaactatgctattttttatttttttattttttttttgcctttgcagtaaagataaattctctcttttggtttgacttaaaaatgttctacttatatcctgtttattccacctttactctccacccttccacatgaacttactagcttaagccttttccataactgaacttcctattcttaaaagttatgcctgttactcagtgatttgccagatgggcacctcgggtttgaaaagggaatggaaaaaataccccattagccctttaagatactcctgtatcgttcccttcttttacttcagtgtctttagacagttgatgcttcggagatgaggaagtattttctcttgcttggttttctgtagttccgttatttttcctagttagtgtttgcccctcccaggaactatctggacttaggatgttgggaaggttttccagattaagataccacttcaaaagtgactgttcaaggtgggcttaactttggaaggctgcctttgtctgaggcattgggaggatttaggttctagagtttgaattgtgggtgaatggaggattccttatttgtgatttggccactctagtacactgcttctaaaactcttttccatcagtgttcctgatagcagaggagaaggaaatgtgtacctctgatgggaaggatccaagggcatagacaggcaaagtttttctgaagctttgttttatttttataaaaactaatatatctttttaaaatcatgctttatattcctagttaaattacttacttttcttcacatctttgtttcaaaatggaaagtataaaagatgttaggttatttatttcatggcttttcctatcttcttgacccgatgccttataccccaggtgatggaatatagtatgagtatttatttgtttgaggagtacaaattagaatgacatgttgtactactctggtttctttaaagttgtagtggttagtagggagtttttttcaacaggaaatatgagagttggggtatgagagcttttatcttacggagaagctgaagttgtatactgaaaatgacgtggtttttgtgttccacctaggctataggagatggcctactcctgtctacctatccctccccaccccgctacacttaggcttaaattgtgtacatggaaattgatcttgatactagacctttacatcttaagtttgaagatttagcctagatgctccaagactaaagaagctggactaattgagctgaggctctgagaatgagagtgcccttggggattaaagtggactgctcctctagtacttatgcagtggaggcatggattttgagcccagaaatgtcacttcaggaagagagagggccagactgccccagtctccaggaataaaactgagtggcatttgggtggattgatttgaaatggacattaaaattaaaagtttattatattcctgctagactttggcacagaagtgttttgaaaacagtgtatgctagtgaggtttggtcatatccccttgcccaccaaaaaacaacttacctcactctctctcacgtatactcaacacgtacctgggaagggccaaagaacccttagggagcttttgtttcatgaactcttacctctcaggactaacttgaagctggaaaaccgaccaaaattcccttgcattggtatagctagaaaggctacagatatcacctcatctcaggaataagggccaggtagctagctgagctaatcctcctgtctgtttcctcctcccccaggtgtttcagtcacctccagtaacacgggcgtgccagatatctcgggttctgtgtactccaaaacccaggtaggtgcctggctctggataaaagtggaaaagagatagacatagaggaggtggagttgcaatggtagaaataacagtggacaagaagaaccctaggagaggtggcaggaaacccatcctactttttctaaatgaaaggtcttctctagacttcacttcctctaagaagttaaaatttagccctctgagaaaaaaaacgagaaacgtaataggaaggtaaagcgtggcaaattgtttatcgtgtcatgtaatttactgtgcaactctcctggccccttttcctacctactcccaacctttttcataacttttcaagagaataagtatgagagtgacaggaaactagttcattccattctttgagtaaatctataacagtgggagtgggaaaggagacgacctagtaactaatgaagcatttgagtgatccacaggtttgttatgttgcttttatcccccatcaccataaatacttaaagtttgctataaagcactgggggtctgggggggcacttcatgcacaagaccttcagcacttcaaatatctcagtatgtgtttatttcttttgaaatatccaacgagttttttttttttttttttttttgagatggagtcttgccttgtcacccaggctagagtgcagtggtgtgatctcggctcactgcaaactctgcctcctgggtttaagcggttctcctgcctcagcctcctgagtagctgggattacaggtgcccaccaccgcgcctgctaatttttgtattttttagtagagacggggtttcaccatcttggctaggctggtctcgaactcctgacatcatgatctgcccaccttggcctcccaaagtgctagattacaggcgtgagccactgcacccagcggagttactatttttgtaaggaatattggaaggggtagggacactattggtttgcctttttttttttttttggagacagtctcaagaagtcacccaggctggagtgcagtggtggaatctcagccttctgagtagctggggctataggtgtacaccaccaggcctgcctaatttttgtatttttgttttttgtttgttttgtattttgtatttttgttttttggtagatacagggttttgccatgttgcccaggctcgtctcgaactcctgggctcaagcaatccacccgccttagcctcccaaaagtgctgggattacagatgtgagccatcatgcccagcctggagttctaagttcggatttcatgatgttcacatatgacattcagttttacaaagtgcttccacattccatcctcttatttggtcttttttttttttttttttttttttttgagacggagtttcattcttgttgcccaggctggagtgtaatggtgcgatctgggctcaccataacctccgcctctcgggttcaagcgattctcctgcctcagcctcccaagtagctgggattacaggcatgtgccaccatgcccgggtaattttgtgtttttagtagagacggggtttcttcatgtttgtcaggctggtctcaaactcctgacctcaggtgatccgcctgcattggcctcccaaaatgctgggattacaggcatgggccactgcgcccagcctttttttttcttttttttcttgagatggagtctccctctgtctcccaggctggagtgcagtggcacagtcttgactcactgcaacctccacctcccaggttcaagtgattctcctgcctcagactcccaagtagctggattacaggcgcccgccaccatgcccggctaatttttgtatttttagtagagacggggtttcaccatattggccagactggtcttaaactcctgaccttgtgtgatccacccatcttggcctcccaaagtgctgggattacagatgtgagccaccatgcccagcctatttggtctttacaacaggtttgtagcatccctgttttatatctgaggaaactgaggctaagagattgagtagtatgcccaggttcacacagttcttaaataagagcagagctgagactgagacctgaatatgtgacttcaagtgtactgtgccttctgtgacaccatgctgctttctgagggtcagggagcttgagctcaggaaaaatcccaagactagtttgctgatcccttttactctgtctcctcctggcctcctggatagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcaggtaatgaaattgaatgatcatatgcttgaacccactccttttcagtccccatttcaccttcacagcctcagggaacttgaaaagactgcgcggtcacaaatcgggatacacaaacacaaacaccttgctgagctctctggcctccccttcctctctcctcctcccctccccaacaccctctttatctttgtacccttccccagctgtggaaaacattcggttaccagaatggaaaagattcttggggcagcatctggagcctgaggcctcagactgcctctcatacctgcctgaaatgggctcacagatgtgatgtgtggtaggggtggggatctgtggggcgatgcaagtggcctcttgagagctccattataggtggctggagctagaataagggcttccttcctcaaagacagctttccaaattgaggcattaatggggatcaatggaaatgaaattgccttgtgatcacccatctccaagagcaggggagagagggggtagtgtgagaatgtagaattgaaaatgagtagaactcactcactaccttgtctctaaaggtatcttgccctcttcatcttttccctatttaaaagtcaaaaatgccttcctgcttgtaagaaaggggctttagcagctatgcagaccaaattttctatggttctaatagtagtgaggggaatgggagagcaagacagtttgcacatctccacctgaagatgttacaaatttgtaccactaactagacacctttttcctcctcatgatcctcccattcccctgcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgt

SEQ ID NO: 35853 - DNA, 26299 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctgctcttgcttgctctgccaccccccggtccctgcgcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcctcatggagagggggtggagtgagtcaggggcacacccagcataccaggcctgtttccagaacagtctccccagagcagtatgagatggccactgaggggcgtggagcgagcccaggagattaaaatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatctcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaattttttgtatctttagtagagacggggtttcactgttagccatgacggtcttgataccctgacctcgtgatctgcttacctcggcctcccaaagtgctgggattacaggcgtgagccaccgcgcctggccttttttttttttttttttaattttttttttggggacagcgtctccctctgtctcccaggctggagtgcagtggtgcaatcatagcttactgcaatcttcaactcctgggctcaagcgatcttcctgcgtcagcctcccaggtagctgggactataagactacaggcgcaccatgccaggttaattggtctttctacttttttttttttttttgagacggattttcgctcttgttgcccacgctgcagtacaatggcgcgatcatggcttcccgcaacctctgccttctgggttcaagcgattctcctgcctcagcctcccgtgtagctggcattacaggcgtgcgccaccatgcccggctaattttgtatttttagtagagatggaggtttctccatgttggtcaagctggtctcgaacttctgacctcaggtgatctgcccgccttggcctccaaaagtgctgggattacaggtgtgagccattgtgcccagcctcatttgtctttttttaaatagaacagaaaggctgggctcggtggcttacgcctgtaattctaacacattgggaggccgaggccagtggatcacttgaggtcaggagtttgagaccagcctaaccaacgtgccaaaaccccgtctctactaaaaataaaaaaattaaccgggcatggtggtgtgctcctgtagtcccagctacttgggaggctgaggcaggagaatcgattgaacccaggaggtggaggttgcagtgagcggagatcgtgccactgcactccagcctgggtgacagagtaagactcgtctaaaaaaaaaaaaaagagaatcagtggataaaaaagtggatacgcttcgtttagtaagcgtttgtggagcgccaaggaagtgcacacggctccagtcctatgggacatttgaagggagtgagatgcagccagcttttaagaagagtatctttgttaagtgcatttaatctggtgtctttgtgttgtcttttaaaaggcatagtttttttttctttttcttttcttttgttttttttttttgagacagtctcaaaaaaaagagacggggtttcaccatattggccaggctggtcttgaactcctgacctcaggtgatccgcccgcctcagcctcccaaagtgctgggattaccggcatgagccaccccgcccgaccagtttttctttttttttttaaagaatttttttttggccgcgcgtggtggctcaacgcctgtaatctcccgggttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatggtggctcacacctgtaatcccaacactttgggaggccaaggcgggcggatcacccgaggtcgggaattggagaccagcctggccgacatgacgaaaccccgtctctactgaaaatacaaaaatagccagcgtggtggcgtgcgcctgtaatcccagctactcgaaggctgagacaggagaatcacttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtgggaagatcacttgagcccaggagtttgagagcagcctgggcaacacagtgagaccttgtctctacccccaaaaattagccaggtgtggtggcatgtgcctgtagtcccagctactcaggaggctgaggtgagaggattgcttgaggccaggaggtcaaggcttcagtgagctgtgattgcatcctgcacagcagcctgggtgacagggcgagaccctgtctcaaaaacaaaacaaaaacttcttttctaaaaagtatttatgtgatcttctttaagtgagagtcccttaagagtaatgtaggaattaagaacaaaagcctccaaccataatttttagtcaaaccaactgccaagagttttcttttcaccctgtgatgtggtttaattccagaatctgggtccaggcctaggtctgagtaaggttggttgtgccgctgagtctgaggaccaggtttcagatcctgaggacatcacacagctatttctagcctagaagattaaaggagagtagcaggaagtccaaggacactttgctttccatttaacttcagaatatgtgagtttagaaactaaatccacaaggtttttttcagagttgaattacaataaggtgaagtttttttttttttttttttttttttgagtcggagtctctgccgcccaggctggagtgcagtggcgcaatctcggctcactgcaacctccaacacccgggttcacgccattctcctgcctcagcctcctgagtagctgggactacaggcgcccaccaccacgcccggctaatttttttgtgtttttagtcgagatggggtttgttttttttttttggagacagagtctcgccctgtcgcccaggctggagtgcaatggtgtgatctcggctcgctgcaatctccgcctcccaggttcaagcgattctcctgcctcagcctcccgaatatctgggattacaggcgcgtgcctccctgcccatctaattttcgtatttttagtagagacagagtttcaccatgttggccaggctgatctcaaactcctgatcttgtgatccacccaccttggcctcccagagtgctgggattacaggtgtgagccactgtgcccggcccctacaaggtgaagttctgtattgcttttttttgttgtttttcttgagacagagtcttgctctgtcgcccaggctagagtgcagtggcgtgatctcagctcactggagcctctgcctccctggttcaagtgattttcatgcctcagcctcccaagtaggtgggattacagacgcctgccaccacacctggctaatttttgtatttttagtagagacagagtttcaccatgttggccaggctggtcccgaactccgagtctcaagagctccacctggctcagcctcccgaagtgctaggattacaaatgcgagccgctgtacccagccaagaaagagaatttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaaggatcctcactgttttttgtttgtttgtttgtttttgaaacagtctcggtctgtcacctaggctggagtgcagtggcatgatctcggctcactgcaacctctgtctcctgggttcaaacagttttcctgcctcagcctcccgagtagctggggttacaggcgtgcaccaccatacctggctaatttttgtatttttagtagagacggggttttgtcatgttggccaggctggtctcaaactcctgacctcagataatctgcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttgtgatccacccacctcagcctcccaaagtgctggccaccacgctggccttttttttttttttattattattcttttttgagatggtttcgctctgtcacccaggctggagtgcagtggcgcaatcatgattcactgcaacctcaacctcctgggttcaagcaatcctcccaactcaacccccctcgtagctgggatgacaggcgtgcgccaccatgcctggctaattttttcacgttttatagagacagggtcttgctttgctacctaggctggtctcaaatttctgggctcaagcaatcctcttgttttggcctcctaaaatgcttgggattacacgtgtgagccaccacatccggcttatatacgtgttctaaaaaggcagacacactggctagttgtcctggtggaaaatgataggaagactgtttcagggtccagacttgagagagcactgatcaggtccttggcaagagcggtttttctgtggtccttgttgtgggtgtggcatggtcacagcctctgacccagatatggccatatgggccgggcatggtggctcatgcctacaatcccagcactttgggaggctgaggcgggtgtatcacttgaggttaggagttcaagactagcctgaccaacatggagaaaccctgtctctactaaaaaataaaaaaatttagctgggcgtggtggtgcgcacctgtgatctcggctactagggaggctgaggcaggagaatctctttaacccgggaggcggaggttgcagtgagccaaaattatgccactgccctccagcctgggtgacagagcaagactctgtctcaaaaaaaaaaaatatatatatatatatatttatatataggaccatatggtcccacaaccctagggactctgaccctccccgatgacgacgtggtcctacatgacgacgtggtcctataaccctgggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtggagggcatggtgtaggatatgctggtggaaatttgaaatcctcacgatctgggaggcactgcattgtcagagcatcagccagtgtggatcaagtgtggatagttttgtatgtgtgtgtcagtggtgttgttcagagtgactcctaatatttggagatccttaaactagataatagcacttcatttacttgtgctctgatctgattataacgtctttaaactgaggaggggaatatttttaaatagtctctgtgggattttttcatctgttatttagaaggaagcgctgtaatcgttgccacagaacatgggcagaaagtcctcccatgttggtctgaaaggaagcagttgctgccgagcttgtcttgaaggtcctgggggaccaggctggcactgcgtgcacatggagcctttgcgtctggtgtcacggtgggaggctggtgtcaggaaccccgggcggttctcggcatgttgccccgggtattccagggacccgggtggttcgtgggcatggctacagcagccagctgtacatctgggtgctctggggacccgggcggttcacggcatgttgccctgggtattccagggacccgggcggtttgtgggcatggctacagcagccagctgtacatctgggtgctctggggacccgggtggttcatggcatgttgccctgggttttttttgtttgtttggttttttttttgagacaacgtctcgttctgtctcccaggctggagtgcagtggcgccatctgggctcactgcaagctccgcctcccgggttcacaccattctcctgcctcagcctccccagtagctgggactacaggcgcccgccaccacgcccggctaattttttctatttttagtagagacaggatttcaccatgtcagccaggatggtctcaatctcctgacctcgtgatccgcctgcctcagcctcccaaagtgctgggactacaggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctaggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaagctccctgcatcctgacccacgtgtttgtagatcctttcagctattggcgccctggaggatggacgggaaggagaacgtggccggtgggtggaggatagcactggtgcctggccccatgaggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagctttcccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactctttaggcacaaatgcaggtgcagctttcccatccccactcttagggcacaaatgcaggtgcagcttccccatccccactctttaggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtaatcccaacacttttggaggctgaggcaggcggatcacgaggtcaggagatcgagaccatcctggctaacacggtgaaactccgtctgtaccaaaaatacaaaaaaattagccggatgtggtggcgggcgcctgtagtcccagctactcgggaggctgaggcaggagaatggcgtgcacccgtgaggcagagcttgcagtgagccgagatggtgctgctgcactccagcctgggctacagagcaagactctgtctcaaaaaaaaaaaaaaaagaatttgtgtttttgaaactaaatatagcaggtcattagttacttataactggtgttttattaataaaagaagaaaaaatttaaaaacagccatgattccagctgcacggagcctggatgggaaagtgcatcctctgggctgagcacggtggctcacacctgtcatccgagcgggctgggcgcagtggctcacacctgtcatcccagcactgcgggaggccgaggcgggtggatcacctgaggtcaggagttcaagaccagcctggccaacatggtgaaacgctatctgtactaaaaagacaaatttagcagggcgtggtggtgggtgcctgtaatcccagctacttgggacgctgaggcaggagaatctcttgaacccggaggcggaggttgtagtgagctgaaattgcaccactgccccccagcctgagtgacagagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccagatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgcagacgccaaggccctagagctttgctttgatgggatgtacccatgtgggtggacactggagggagctggaggggatagaagcggggccttcactaggggccaggacagacccttgcactgtgaaaagaggcctgggaatggaactgtccgatgttctgaaggcacacggggccccgccgtctggagcaggggcaccttgcgggctgcatggccactctgtgacgctcgttccccacagacgtggttgagcttgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctgggctacctcctggctgggcaccccagctgggcctcaggcacgccttctttcacaggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctgcctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcagtatgcaatgtgtgtgtttcctctgtgcaccctcacacgcccaaggctccacactccccagcagctgtgacttgggggggtccttgtggggcaccctacaaatgcaggtcttccctaccactgctgagctttggacccaggagggaccccctgagtttcagctgaactcagcctcgcagggctgttttcttcccgaaaatgctggtctcaccacagagcatcttcaggaagtaacaggtgtttgttgtgcctaaattatgccggccatcaggaggcgtttgcccactcttagtgtccacactcccttttgagtttgttcagaccattgtggtggaaatccaaggggcacgtggagcccttggcactgattggaatagccgtgcacaagccagtcctagggttttgatctgggcatttgtttgtatggcctgtttttctctggaagcacagggacacggtcctggttctctgtctgctcctccttctctgatggggagaaaggctttcgctctctgctcagtcctggggttggcagctgacccgtgtcgtgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctgggcccattcacctcgagttagagactgaggttgagagctcactacttcctgaaagtgaaaattgggttctgggaggtttatgtcatgagtttagggctggatgaaccccggcggacccctgctaactcttgggcggaagcccctctggacagctgcccaacgcccgtgtccatgatgggcctgtcccagggcagccccggtctgtgaggcctttggtgtgccctggggcatgggtgatggggatgggaggaagggaactggattcaggtcagagtgggggtttacagcagggtcaggtcaccgtctgactccgtggtctcagatgaggcatcggccctctcaggacctcgggcgagttgagtgtttctcagttcttcagtggctccctccatgtcagagtgggcctggctgcagtgagtggcagcagctgcccttggacacacaggtttccaggttggcgtctgtgggcacggatggagcgcagagcagaaatgctcggcgccaagggtgtcccacatcctcccacggtgcgtgtgctccctcagctgacgtgatttggggaacacgggccgctctcgttctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccatgaggccaagggaggaccctggggtcgagtttccttcgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggatggagctggcctgctttctcctcttgtctccttatcactctgctgtcccagaagtgtccttggtcttccgtttgcttctctgagagatgtgcatgaagaactgcacagacttttcataacttcagtacgagagcccagggtgtccctgtaggggacagcagagaggggccgacagccccccaactgcgcagacttttcataacctcagtacgagagcccagggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccagggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttggggg

SEQ ID NO: 35854 - DNA, 33787 bp, Homo sapiens
ggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaagtccgcctcgccccgtcccaggccccggccccgcccctgacccagcctccaggccctagccccgcccctgcgcccggggccgcgttgcccctccagttctagacctggctccctcccatccagccctgccaaaggtctcctccaagtcctgtctccttcttcatctcaactagagatgaaaatgcctttcttgaagggtaactctaaggtagagaatacgtacacagaacgcagtacagcgccaggcacccaacaaagtgcctgataaatgttctctgttatttgagggcagacgcctcttttctgtatataccattaaagtcgccttttttctcaagtgagcggtgacttgcgataataaagcagaagacctgaggagccgacaagtaccttttatttttattttttgttgagacagggtctcacagtcgcccaggctggagtgcagaggcgctatcatggctcactgcagccttgacctcctcaggctcaggtgatcctccacctcagcctcctgagtagctgggattataggcgcgcgccaccacacctagctaattttttggtattttctgtagagacagagtttcgccacgttgcccaggctgatctcgaactcccggactcaagtgatcctcccacctcgcctcccagagttctgggattacagtcgtgagccattgcacccagctgactagttccttttaaagaggatgaaattgaggccagggaagggcagggactccttgcaaggacacatccctgcttaaaggggaactcgtgcaccgtgagtcatcaggattggccctctccgctgtttctctctttcatctagaatttaacacagttcactgcctccttttaatggctgcttaagttctctctgtgattgctggctaaaaatagccacaaattgcagttctctatcctatgggttctcactccgaggacccacaagttttaagaatggttagattccctgtcactagataaagaggctctagcttggtgggtcctcacagggtttggctaaaagagccctctcaaagcccagtttctactttctctgagaaagattttaaaaggaatatattgtgttttttaaaattactacaaaaatagattcatggcatatcctagactcttgaggtagaaggtttttgtttttaaactttgttttcagtttctggactgcaagatctgttttttcagatttccaccgagacagagccacgtgtatattgtatttatatgagcaataaaataacacaaaaccccaaagaggggaaaagctgggttacttctatacttctatgcttagttacagttttatttaaagtatcagttttgtgaatgtttgttctggcaattaaaaaaaaacagttttaaaacagaagcagggaatgagattaataaaattccagaatgttgaaaatgagggctggttcatacaaagcatcattttttaagctaaaaatgacttatctaattctttttttgtatagcttttggcaaatatgttctgaaccaaatttaggtcacataatcaagaggaaatcattttatttttaaacctagagaatactagaacctctgatttctttaatatacagatgaatttgaacaagtgttacagggaagaggggaagaacattttactcaatgtgaccaaaaggcatgggttttctctttcatcatggtggccccaaaaggttaggatggtcatagcttctcttcaaaaccctttacaggtcttgtaacaatcacttagttgaaagtcagtaaaatactatctatctatctgtctatctatctgttttttttgagacacagtttcactttgtcacccagactggaatgcagtggcacgatctcagctcgctgcaacctctgcctccagggtgcaagcaattcttgtatctcagcctcctgagtagctgggattacgggcatgtgccaccacacccagctaatttttgtatttttagtagagatggggtttcaccatgttggccaggctggtctcgaacttctaacctcaagtgatccacctaccttggcctcccaaaatgctgagattacagtctgggatttgaaccaccatgcccggccaccatcttaacattttgagatctcatatagggcaggaaaaagctaagaattttattaataaacgtgaatgttacttaattgtttcaatggaagatataactgaaaaagtaatttttggtggagatattgtatggtgtattttttctcaatgatgtttatggcttggcatgatggctcatgcctataatcccagcactttgggatgccaaggtgggaggatctcttgagtccaagagttcaagaccagcctgggcaatataatgagatctcatctgtacaaaaacattaaaaaattagccgggtgtggtggcgtgcctttctagtttcagctactcaggaggctgaggctggaggatcacttgagcccagaaagtcaaggctgcagtgagctgtgatcttaccactgcactccagcctgggtgacagaacaagactcttgtgtcaaaaaaaagtgatgtttacgtgtttaaactctgtttatggatagagaggaaaagatgggtggcaggcacatacattctacctggcacctgaaggctggaggtcgatatgaaggtagatagtgcgctgtggcaggacatggataaatgttactctgctgttctgagttgcagttctctgtttcagtgattaaggagaaatgcctcaattgatcactggaatagcaatggtgggttccgactgccagagggaggcgaggaggtttggatgtgtgctcttgtagaaaagggctgtgctactggtgtgcagcctcaggtgcatcataggtttctcgtcaccagcctactctaggtccatgtcattagctttctttgggttctctccacaattaccatcttccacgaaaaactcatttttctcataggccaagcaaaaagtaggccggagcacttcatcaaatccttaatgactgttgagctctaacctggacagagaacactgactcacaggcactgttaaccccaggccttgcctggctgtggcctctaactccccggaaccacagggcctgcctctgtgtcatggctgatttagggtggctcatgctggtggctgtatctcaggaacccaaggcaaggtggttccctccatccctaccaccttctccaaaatctgcctggggtctgtcagaggtttggtagccaagatgtgtctccatgttccagctgcagagcctgagttgaagtaaataaaatcactcttttctcttcaggaagagattccgttttgtaaaacatcctaagttagaagccttaaaaatcctactctgtgcccctctttctattcctttctttctttctttctttcttttttgagacggaatctcactgtgtcacccagactggagtgcagtggtgcgatcctggctcactgcaacctccgccccccgggttcaagtgattctcctgcctcagcctcccgagtagctgggattacaagcacctgccactgtgcctggctaatttttgtctttttagtagagatggggtttcatcatcttggccaggctgatcttggactcctgacctcgtgatccacccacctcgacctcctaaagtgctgggattacaggcatgagccactgctcccggcctctgtgcccctctttctaagtgctgttctgagaattagtgactctaatttcactggcaaatgctttaaaaggcagcattcataccctctcccttccttccagctgaagactagcctttttctggccaggagtgtgaagctttctgtagggctgttttaaaggcagccctgccacaagccactaattggcattcccaaaacatcagcattgacatctgggagtctgccctcatcaccacccaccacttctctgatgtggccactgccattgtctcaaaatgacttggttccaattctggggcaattcggtaccgatatatgccatcctatgactcttagaagtctagggtataccaaatattcctttattttctctgtctaaaccgaattccctaattcccgccttggagcgtccctctggattggctgagtctctgtgcacatgcacaggtgcctgcccttctccctactaggttgtgccaagagtccatcagcatgggggccctctggttggtggtcatgagtcctcacagggaggcctctgcatccttatttgcctgccctcctgaggtcctgccataacatacctgttcttcctgaggacttctgccgtcttgaacactgccgataagtgccagccctgaagctccggggcccgcagccctgctgctctcacagatcccaagggaaacttttttcctagcctgggagattccctttctccctcttcttctcccaggccagtcagcttcttcctgcagctcctctccaatttctttctcccctcaaacctgtcaggctcttttgtgagtgcaggcttttttcaagtgaataatttgctggttctgaccagatatctacctcccctgagacagtgaaactcagaatcattggccccttcaatggagagaagacagaggggaaaagagaggaaaatgtgaattaattttattatattttatggtcataatgtcattatgttcaaatcacagatacttattgtgtcctgccttgtcctgaggactgtgtgaggcaccaggaatccagataatgaatgacacacagctgggtcccccgaggatcatagtctgatgggggagatagacgtaccactgagattgtagggtggcgtaaaatgcgggaagacagaacccagaactagcccaacagagaggctcttaattgaggccactaggagacagggagaacttaacagaatatatggtccatgcaggtggggatttttttttcctgttttgcttattgttatagacccacaacctagaaatggtgctcttgtaatatgacgtttattgctgcatgaatggatgaataagtgaggaggtggtggagtcattgagaatgttagcagaaggtctgtgggggatttgggaaaacaatatatttgtcaaggtgccagtggaaaagatatggtgcagtcatattgggtaattggaggaaagtttaagaaggtggttatttacaaaggtgtgtgcagtgcatggggaatccacaagagatagtgttctgccacaggggtgatagcagtgggatatgaccaaccctaggccaaaaggggcaggggagagagcagtgattgaaaccgggaaggagggagactctatggagagggtcaccttgagaagaactgtgatcttcaattaagggacatagcagcccaagaggactgtgcagggagggaaccaggaaatgaaataacatgaccttactctcttcccttcctcagtcatctactggggctcctcatgggtgaacctctttggaagccagagagcgagggagtctgttgttatagtccacacaggccagcctcctggggcatgtagccagtgcagagtagattgggaaaggcagaccgaggccatccagacagtcgctttcaggaaatcagcacttgtctcacagtgcctggacttggtcttgaggggccctggaagtcatggaacctttagctggaaaagttatagcaacacaaagtttctgaaggactaagcagatattcttgttttacaaaaattaccacttagcatccatggagtagcttttatgttctttgtccttttaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaagtatgtttggatttttatgtggcagttagtggcaacctggactgttaaagaaatgtctctccataagcagctgctgatagctaaggacctctagtgatttttggtgacatttgctgaatattatgacaatagaaatgattgacttttagcacaaagtgatccatttaataatgatattttgtatgccgtgatgattttaaaagccatgttccctttaaatgctacattttagaaatatggtcatttaattatttagttttaagagggtagattaaagacatatcttggaaatcatctaaaatgaccaggaacacaagaaatagaaacataaatctccagttttgatgaaatgagaaggcatatatttttatacacacttgcacacaaacgcaccctaaatatattaaggtagaaaatgaagacgagttaggaaggctgatgtgacagagtagaggacacttaaatctgcgcatctacgaagaagagttttgatgagaattagtcgtaagaacaacaataagaaagaacgatctcgcccttttgagcactcactattgtcaaggtcttctggaactcaggcactgggggcctgggtttcaagcaagggcagggcattgttgaaaatgggaatttggctgggcacagtggctcatgcctgtaatcccagcactttgggaggccgaggcggatggatcacctgaggtcaggagtttgagaccagcctggccaatatggtgaaaccccgtctctactaaaaatacaaaaattagctgggcgtggtgactcagcatgtctgtaaacccagctactcgagaggctgaggcaggagaatcacttcatcccgggagacagaggttgcaatgagctgagattgcgccactgcactccagcctgggcgacagagcgagactctgtctcaaaaaaaatgaaagaaaatggggatatgtggaaaatatccactagaagttatagttcccaaggcctgaccacagggttttctgtagagtgatcagatctcaggctcactttttgactgctagggaaaatgtatgtgtggaagtctctttttgggggtatctgtcagttttccagggaagacttcaccagccttctgcagggctggtggggtgcgcatactcctctgctggtgtctgagaaccagtgtggggagagggacagggtcacccaggtgagtaggaatacttcacctgcttcctgattttagcctcatgcctccacttggcctctgctacgtctggtccctgactcctcagcctttatgggtaaagtctctagaataaactgccactctctggtgaagagtggctttgggagatatgatctcttgggtgggtgggtaggtgctgggagcggacccaggaccccaacagcctgttcaaacttgcagccctgcttctagctccatgccttaccccagcctcccgtggtccctcatgcctgcgcatgccaatgggacatatagcttgcttcccctctggcccctcctttgtgactatttcacttcctgcctttccaaaagttgttgaaatctcatctgctgcttgctcccttcccattctcccataaaagcaatttatgcctttcatagtcttcactgttgttttcatagggtttggggaacgaagccgagtgcgtgtggtcagtgccctgggcttatctggaattcagctagtcctgttggccctcactggagcccttttggggtggctgtgctgccctcctgtgtgatcaggggcctcctctttctgcttggtccttcttgctgctgctgctgccccgctgcttctgcagaaccagctgtctggagttggctacttattgacccattcttcaggaaaggctccttcagttctcagcctgtcttatttccagggcatgtggcctgcccaggaggtttaagaaaatccaccctcggccaggcgcggtcctcatgcctgtaatcccagcactttgggaggccaaggtgggtggatcacgaggtcaggagttcaagaccagctggggcaagatggtgaaaccctgtctctactaaaaatacaaaaaaattagccaggcgtggtggcaggcacctgtaatcctagctactcgggagactgaggcagagagaattgcctgaacccaggagttggaggttgcagtgagctgagattgcaccactgcattcgagcctgggcaacagagcaagactctgtctcaaaaaaaaaaaaaaaaaaaaaaagaagaagaaaatccactgtctttacctgaggccttaagcttggtgaaaattctaggtctaaggggtgccctcagataccaccattccagagcagctgagaactccaaatggagggtcccatgcttattcagggcctgtcctggcctctgcaagttagcaggttttgtgtgtatccaggatctctacttatttcttggagaccaagctacttccttggtcctagtttatttctctctctcttttttttttgagatgaagtctcgccctgttgcccaggctgcagtgcaacggcacgatcttggcttactgcaacctccacctcctgggttcaaatgattctcctgcctcagcctcctgttatttctcttctaatcgagtctaatcaacaattagcagaaagtccttgaagtttccactatctggcatgtggttgcccttcctagtaactagtgctgatgcatggtggcacttctgtttaactgcattgtcggaggaagtggggtgacagacacctgctgatatggtttggatctgtgtctccacctaaatctcatgtccagttgtaatccccagggttggaggtggggcctggtgggaggtgattggatcatgggagtggatcctttattaatggtttagcaccatcctctctgtgccattctcatgatagtgagtgagttatcatgagacctagttgtttaaaagtgtgtaacacctccccgctctcttccttcttctctggccatgtgaagtgccggctccctgtttgccttctgccgtgattgtaagtttcctgaggcctccccagaagcagaagctgctatgcttcctgtatagcctgcagaaccatgaaccaattaaacctcttttatttataaattacccagtctcggttttttttttttttttttttttttgacagagtctcgctctgtcacccaggctggagtacagtggcacaatctcagcttactgccacctccgcctcctaggttcaagtgattcttgtgcctcagcctcgtgagtagctgggactacaagcatgtgactacacctggtaatttctatatttttagtacagatggggtttccctatattggccatgctagaggtatttctttatagcaatgtgagaacagactaatatacctgctctcaaacttacatttttcttttcgttccattttaaaaaccagttttattgaggtactatttatatacaatatatttatcaattttaagtgtataatgcagtaagttttgacaaatacatccagtcctgtaactgccatcatagttacgacatagaatattttcatcacccctgaacaatttcctcttgtccttttgtagtcaagtttttgctgtaacccctgacttctggcagccactgatctgatctctgtcatagttttcccattttccttaattcagattattatcaagggcctgctactttttgaattgaactaaataagaaatgtacccatcataagcaaagtagaaaaatctagatataaagtaactcactgattgacttcttcaagggccagtgtggcttcttcagagctaatgagagctagcttggtggtggtcttggttccctttgagatttcatgactgtctcccttcacgcccaagagcgagcttcactggcttctccatgcctttcagagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcaggttggtggtaggtcaataggctcactactcccatggaatagtcttccttagatgtctggtttctgcctgcatgcctgctagatgcctggagcagcctctgaggaatttttgagcatacttattaacgggtaactgagggtagtcaccacctgcatagataaacctttgacttggcaggggcttctagtgaaatcactgagagaaggttcaagcacaggcctgccaaggtagaattctgtgtctgccctacttgcttacagatttcctacagtcattttgaaaaataaaaatgggcccaggagcacctcagtgactcacattactgagataactttgatgatggcaattttccaacacatataaaggtagaatgaacctttaagtggccatcactaaggtagctttttgaaattttcttttctgattataaaacaatgtgtgctcattataggaagtttggaaaacacagaaaggaaaaatgaagaaaggaagaaaatgtaaaactctacacataggtagcccagatttctctatagtgcctagacatttcccaagtgctttactgggcagcatcactccagaaactgggaaatggctaagggaagctctttcccaaagtggtttgagaacactgatcctagaactgtgccttcctgaaagcactagataagtaaaatctggactgtaccttggataaaggtatcatgtctatgtacttgtaaataagtctgggaatgggctgagcactgactgcatctcccacttgaagaatcattgtgcactttaatggttaaaggcccttagaaatcctgcagtagagaagctcttttaaagttattgaatccagcgttttcggttttgtttttttttttcagtcactttttattcattaatctctttctacaaagtaggttttttttttttttttttttttttgccttaagaaaacttcttgttatggaaaatttcaaacatacacaaaaaacagagagaagagtagataaaccaccatgtacccatgacccaacttcacaattgtcaactcatggctacttgagcttcctctaattcccacctacttttcctctcatgttattttgaagcggattccaaatgccatattatttcatttgtaatatttcagtatatacctttagaaggtaaggactctttgttttttaaacataacaccaaactattacccctgtaagaattttaacaatcattctttgatctcatcattaaatacctaaacagtgtcccaatcatttcagaaatgtcataaatacatgtgtgtgcctttaatttaccatttgtttgaatcaggatccaaataaggtccatccattgcaatgggttatctcttgaaaatttttattgtggtaaaatatacgttaatatgaactttattattttagccattgttcaatgtacactccagtggcattgactacattcacatgattgtgcaaccatcagcaccatccatctctagaactttttatgtttccccaaattgaaactctgtatgcgataactccccatatccccttccccccagccactggcaacaacctttctactttctgtctttgtgaatttgactactctagatacatcacgtaagtggagtcatacagtatttgcctttttgtgactgactcatttcacttggcataatgtcctcgtttcatccatattgtggcaagttggttatcttttatggctcgtttaatccataggttcttccgccatatcttttcccctttgctattgaagaatctgcattttttgtcccgtagagattcccatggtctgggttttgctgactgtatccccatgttcctctgtcttctgtatttcttgtaaatcggtaattggatgtagaggcttgaacaggctcggtttgattttgttttagggttttaaattttggtgggagtcaactgcttcatagttgatgctgagttctttcatcaggaggcacataatgtctgtggtttctctccatctatctttgatacagctaagatatatatgtattgtaaatcaaagagtatctgagacaagtctcaatcaatttagacagtttattttgccaagttaaggatgtacttgtgacacagactcaggaggtcctaacaacatatgcccaaggtactcagggcacagtttggttttatacattttagggagacatgagacatcaatcaatatatgtaagatgtacattgcttcagtccagaaaggcaggacaacccaaagtgggagggggtttccaggtcataggtaggtgagagacaaatggttgcattcttttgagtttctgattagcctttcactgaatatgcaatttgcaggaatagtcacttatgctttagtctggcttagtgaaacaacagagcaaaggaaacaaccatatatacatttgttccatgtgagcagagggatgactgagttctgcctgtcctttgtccacaaaaacttccttgtgggcaaattatgagagagatttgtggctttttttttttttttttaaatttttgtagctatcttatttaggaataggatgggaaacacatttgtcctacatggttcccagcttgacttttccctttggcttagtgattttgaggtcctgagatttattttcctctcacagtatagatatatagatatttagagtttctttagtttttatttttaaataatttcaaacttgtagagaagtcggaagaatcatacaaagaactctcatgtacaccttacctagattcaccaatttgtaacattgattgtgccacatttactttattgctctctccatatgtgctgtgggtataattattattgttattattttatttatttatttatttatttttgacatggagtttccctcttgttgcccaggctggagtgcaacggcgcgatctcggctcactgcaacctctgccccttaggttcaggcaatcctcctgcctcagcctcccgagtagctgggattacaggcatgcaccaacacgtctggctaatttttatatttttagtagagacggggtttcaccacgttggccaggctggtctcgaactcctgacctcaggtgatccacccacctcggcctcccaaagtgctaggagtacaggcgtgagccaccgcacccggcctattatattttatttttgagactgagtctcactctgtcgcccaggctggagtgcagtggtgcgatcttggctcactgcaacctctgtctgccgggttgaagcaattctcctgcctcagcctcctgagtagctgggactactggcaggcgccaccacacctggctaatgttttgtatttttagtagagacagcgttttgctgtgttggccaggctggtttcaaactcctgaccccaagtgatccgcccgccttgccctcccaaagtgctgggattataggcttgagccaccgcacccagctctgtataattatttttatttcagaactatttggaagtatgttgcacatgcattattactctttaccccattatacttcagtttatttcctaagaacaataatattatctaaatatccatagtaattaaattcaggaaacttaatatactagatacaatgcttgtattcaatctgtagttcatattctctttttgttaattgtcacaataatgttctttctagcacctttttttttcctggtacaggttccagttcagaatcatgcttcctatttatttgtcatcttcctttagaattctttaatctggaacaatcctttggccttctttgtctttttatgccaatgatattttttaagaatataggctaattactttgtcaacattcctcaatttgggtttctattatgtgtcttcacagttacattcaggttgtgtatttttggctggaccgctatataaatgtcctcctcaggatatcacgtcaagatatgtatgatgtttgtttgcacccttattgttgatgttaattttttgttgttggtggtagtaagtatgtaaggcttttttgttggtgatggtagtaagtatggaggcgtgttttcagagtcaaccaaagtggaaataatagttcaaagagtaaatgtttctgtaaattaattttagtgttttaaggtatcattttgtacttcctaccagcaatgtttgaaagtgcctgttcctccacagtcttatgaaatgtgtgcaacccttctggagtcttttgcttctagctgcataaagggagaaaagggagggagccaaggatcatgtgggagattttagggattaggcctggaagtagcattccttaattgttactctcaacatgtcattggccacgactagtcatatggccccaacctagctgcatgggaattgtagtctttgactatatttaggttcaccttactctctttcaaaggctgtgtagattctgttatttttatatactgtaatttattaatcctcatcctattgattggcatttaggtacttacaagtttgtttgtttgttgttataaacagtgtttatgtatgcctgtgtctaaagaaaatttcctagaagtagacagctgggttggaaaatatgtgtattttaacctttgataaattttgccaaattgttctccaaaaagtttgttcctgttttgcttccatcaacagaatatgagagtgtaagtttcactgttctcttcttaatactacagtatgaatttgtaaaacttttgcaatttggtagtttaaattattttgggggtaattgtatttcctaattacaaaagaggtgtagtgtctctcaatgttttttagacattttaataatttctattaatatcatttggccatttatatagtggatgttcatctttttcatattgatttgaaacaactttgtatattaaagattttcagctccttgtaggtgttgaaaatatttttctttttctttttttttttttttttttggagacggagtcttgctctgttgcccaggctggagtgcagtggcgcgatctcggctcactgcaagctccaccttccgggttcacgccattcttctgcctcagcctcctgagtagctgggaccacaggcgcccaccacgacgcccagctaattttttgtatttttagtgagacagggtttcactgtgttaaccaggatggtctcgatcctcctgaccttgtgattcgcccgcctcagcctcccgaagtgctgggattacaggcgtgagccaccgcgcccggcctgtaaatatttttcttttaactttttcatttgggcaggaggcagtagcatattaagaaagtaatggatccactgctctgaaaatttatatgttttgtttcagatcattatgtagaagttctggaatgcaaaatacagtgtgaagagaacctcaccccagttataggaggctatccggttgagaaatttgtggctaccatgtatcattacttgcagtttgcctattataagtgtaagtaatcttctgtgacatcttgggtgaggcacttagtccttctaagactgtaaaatagaggtaataactcttagctacggttgttgagagttcatcaaggtccactgacaaccctggtgctatgctttgcacaaaaaggcagcatggcttagtgattcagggcagagcctgtaaccacagtgcctgggttcgatttcagccttatcacttactagcttctctgtgctttagtttcctcattgtgaatagagattgtagtactaacctcataggattgtcctgaggagtaaatgagttaatagatgtgaaatgtctggggtattcccacactggcacatagcaaactgtgtgtttgtttttgttatcattatttcccttcctccttatcactagctttacttttcagactgttagagtttattttcttttcttttttctttctttcttttcttttctttttttttttttttttttttttttgagacagagtcttgctctgttgcccaggctggagtgcagtggtgtgatcttgacttactgcaacctccgcctcccaggttcaagtgattccccttcctcagcctcctgagtagctgggattacaggtgtgtgccaccacgcctagctaattttttgtaattttagtagatatgtggtttcactatcttggccaggctagtcttgaactcctgacctcaagtgatccacccacttcagcctcccaaagtgctgggattacaggtgtgagccactgcgcccgtcctgttagtttcattctagttggtcctcccttgatctgaaatgggagtttctcaatcagaacgttctagtggacaatgggaagcaaacgtgggagagaaggaagttcagggttagacttcagagcctgcgtgtttcggcttttcctcctctccctgtacctgactttgccaagtgccacttgttcaagcagtgtgtcccttggcagttcagttccaagcacagaagaattattagggaaagtggcagtaggacttcctctgccctaatgaaatgccagggtctagcggtggcaggtttctggctagaatagatcccctgggtcgccccttcacactcaggagtggctggtctcagggtgccttgggaagagtgagagaggtgatcttggctttagccctcctttcccactgtggtaattgtgttttttttttgcgggggggggttcctctttatctcacctcccatcctcttcagaacacgtaagccttgcaccctgaaggtcagaaaaagaaaaagaatatgtattatataaatataaaaagccataaggtcttctagctcactgagcatggcttggttctaaatgtataaagctagaacactaggaatttagaagtgttctggatgcatgcgggctctggcagctccctgggcctctgaaatcctcacgtgccctgaaaatcgccctgcatatcagaaactggcaaagacttatcaacactggtggactgaggcctctagctatgcttgctgcttcccaggaaatctgctttcggggatcaacagtatgaatgaagtgtacttcctgaaatgagcttcctgaaaatctgccccgttttgaattttttctagaccacctaccatgctacattgcttgagggcaggtggtattatttatatttgaagagtaaatgtccctaagagctggctttaaagtagtcattacaggaaacagccactgggtggcacaatttattcatacccaagctttggcttctccggccaaccacagctttagcaaaggtactgttgtgtaaattagagtggaatgtgccagaatacataccaggggcttgtgtctcatcacctcttcctcatcctgcactcccaagacaaatcccaagccctgcaaaatccctatgctgaaggtactgtcacaggtgggcaacaccaagcagagaggctggaggtgggagttccaacctcaggaggtggcaaaactaggcgactttccaaatcccctccaacccagaggctccaccatcctttgggttttccaggtctggtttagctgtaggggagctaacctagatctggagactgtggtcccatccagatgggatccagacactctaggacccagatgagacacctgtttgctgagcacatcctccctatctccctcagccccaggacaatccagctttttccagctgcttccagggacctgagaccagctcaggtcaccagagctggaagtggaacataggcatttctccataggcatgtgcctaactagaactaagtttcaagcctggcctccaggctgccgtggagaccccatctgtggcctgcccacccagggctgccagtcggccccaggctctctgaagaaggactgtggagaaggggcttgttcatatggcctttttgtttagaagcagagaaattatagggtgtggtttgctgatttcttcatttgtcttttcttcccaaccctagtgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgtaagtctggtgcaccacaccttcccttttctcttcattcttgccttctggagactacctcgtgccttaagagaaagggttattttggaaataaaggggctgggcgcggtgactcatgcctgtaatcccagcactttgggaggccgaggcgggcggatcatgatgtcaggagttcgagaccagcctggccaacacggtgaaaccccatctctactaaacatacaaaaattagccaggcgtggtggcacgtggctgtagtcccagctacttgggaggctgaggcagaagaatcgcttgaacccaggggcagaggttgctgtgagccgagattgcgccaaaaaaaaggaaatcaaggaaaagtcatttttttctgtagttttgtgcatgtgtgtgttttaacattttactgcttcattctgatttctgaatctgtaaaaactctacaaatttcaaacattacagaaatattttactttgaaaacaaaattctctcataatcctacaccttctttctctctcggaaaacaaaattctctcgtaatcctacaccttctctctctctttttttttttttttgagacagagtcttgctctgtcacccaggctagagtgcagtggcgtgatcttggctcactgcatcctctgcctcctgggttcaagcgattctcttgccttagcctcccgagtagctgggattacaggcgtgcaccaacatatcacactaatttttgtagttttagtagagatggggtttcgctgggctagtctcgaactcctggcttcaggtgatctgcccacctcagcctttcaaagtgctgggatttacaggcatgagccactgcgcccagcctgtgccatctctttatctcctgctttaaaggtatatatttactcatatatatagtaaatatttgtgtatttttataaaaacaaggtcatatttacatagttttacaactttttgcaactttgtctttctgacaatttgtcgtgaatatttctccatgtcacatccatgtatcatcttaattattatcctttaacagctccctggtagtctcttttgcggatggaccatcatttaattcccttgataggcaaactcaccacttagcatgtgttgtcagtgaaccccattcattatatattactttcaaaagattttttctaattgatctttgctcttgtattttcattgggatttctatatgccatcttgattttcataagtttgtcttccactgagggctggccactcttttttaaaaattgagatataatttatataggatagaattcacctttttaaagtgtacaattcagtggttgttagtatattcagagttgtacagccattaccactatctaattttaaacattttcatcaccttagaaaaaaccccatatcctgttcctccctcctcccagttctaagatgaaaaggttggtcctataaactgttctctgttgtgtctgaacaggaagcagttcagttctttaatgtgaccacactccagaaggagctgtatgactttgctaaggaaaatataatggatgatgatgaggtaagttttcatgcttagcacatgtctggtggctacgagaaaatattactcacatctttgctagaatcactggaaggctgagtcctccctgaagtaagaaacagaggggaccttgagaaagacagttcctgtgggtgtttcagtgacagtcagaatgctggcatgggaaagagcggctttctaggaaacctaggcaggagtgccacatttcctgatagcgaaacgggtgtggggccacactccaggaattcacagtggtcattcttcatcttttcactttatataaaaacagtgaatttttaattgctcagcactctgaagagacatggatactcacaccccaatttttctgctagactattgctattattattttttctaaattgcatctttactgtaagcattttgtcattctctagaattgcttgaaattcctgattccaccttactcagctgaccccttttctgaccctgactcaactggttatggagtggtcattttgtgatgagtctggtcacagaaaagccatcattagcggtagtatttagagtatttgtttggaacaaactggaaaatgcttactgagaaagctggggacttgtcagctattggagctcgaagagagctgtgagcttgctctggtctgatccttcgctttatagatgaggagcatggggccagcaagtttcctgagcctccaggtctgctcttcctatacccgttttaggtgaagtacctctgaataagacatcttcgtggaatttgttttctgtctataaatatgtatgggatgaactcatcactggcattaaacaactgagtctcagttctttatctataaaatgggaataataatactgccctcccagggttgtgagaataaaatactgtgttgcatgtggaaatgctttctaaactggaaagtgatgcaatgcctatgtcttggtttgggtatccttgaagcagagcctgagacaggatcccaagatgccacaggggccattcccccattccctaaaggaaggaacaccagccagataccaacaagattggccactgtggtttacaaagtatagcagaggctgggtgtagtggctcacacctgtgatctcagcatttgggaggccaaagcaggtgattgcttgagaccaggagttcaagaccagcctgggcaacatggtaaaacctcgtctctacaaaaaatacaaaaaaattagctgggtatggtggagtgcacccgtagtcctagctacttggaaggctgaaggagtctggggagtttgaggctgatattgcgccattgcactccagactcggcaattggagtaagaccctgcctcaaaaaaaaaaaaaaggaaagtatagaaaaatatatttagaaaaggtaagagaagttgagttcccagttatctagaggcaagctaatatggatattttggtatatatctttccatttttttattattaaagaaaaaattttatagttttaaatttgtttttctacatatttattataaactcagctataattatgtctcatgactttttcactttatattattatgtgagcagtttctcttgttatatttttctaaaacagctttatttagatattattcacaaaaaatgaaattctcctttttaaagtatacaattcagttgtacttgttatatccacaaaattttgcatccatcactgttatttaactttagaacatttttattgcccccaaaagaaactccatagctaagtcacttcccatttctcctctgggccaacattcccactcctgcctccacctccagcccctggaagactctaatctactttctgtttctgtggatttgcctgttgtggacatttcatataaatggaaatatagggtatgtggtcttttgtgactggcttctttcactgagcatatgttttcaaagttcagccatgttgaacatgttgcctgtaaaatttcctctgtactaccaagtaatattcttcttttggatgtaccgcattctgtttatccattcttcagttgatggatgtttgggttggttccactttttggctattttgaataatgatgctatgaccatttgtgtacaaatttttgtttgaacataagctttccagttttttatacctaggagtatatacataggtattatgttaggccatttttgcatcactgtaaagaaatacctggctgggtgcagtggttcatgcctgtaatcccagcactttgggaggccaaggcaggaggattgcttgagcccaagactagcctgagtaacatagtgagactctgtctctacagaaaatttaaaagttagctgggcatggtggcacaggaagtgtggcaatggcatctgcttggcttctggtgaggtctcaggaagcttatggtcatggcaaagggggagctggcgtatgtcacatggcaagagcatgccacactcttttaaacaactagatcttgtgtgaactcagagtgagaactcacttattatcatgaggacagcaccaagacatttttgaggcatccgcccacctgacccaaataccttccaccaggccccacttccaacaccggagattacatttcaacatgagatttggaggggacatatatccaaaccatatcaggtacatacctaggaatggattgctgggccatatggtaatggtttaacctgttgagaaactgccagactgtttttcaaagtggctgcaccatttacattcccatcagcagtgtatgagagttccaactttgcaatatcttcaacaaaacttaatattgtcttttttttttaatagccatgctagtggatgcaagtagtatttcattgtggttctgacttccactttctgttgtttttcttttctttttgagacagagttttgctcttgttgcccaggctggagtgcaatggtgcgatctcggctcactgcaacctccgcctcccaggttcaagtgattccctgcctcagccatcctagtagctgggattacaggcgcgcaccaccacacccagctaattttttgtattgttagttgagatggagtttcactatgttggccaggctggtctcaaactcctgacctcaggcgatccacccgcctcagcctcccaaaatgctgggattacaggcgtgagctactgcacccagcttgacttgcaccttcttagtgactatgttgagcatcccttcatgattggccatttgtatatctttgaagaaatgtctattcaaatcttttgtccactttaaaattgttacttatctttttattattgtgttgtagaagttctttagatattctagttataagttccttatcagatatatgaattgtagatattttctcacaatttgtgggttgtcttttcagttgctaaatggtgtcttgaagcacaagttttcaaatttgatgaaattcaatttatctgttctttcttttgttgcttttgtgttgtgtgtcatatctaagaaaccattgcctaatccaaggtcacaaagatttactcctgatttttactcctacgatttttgtaattttaactcctgcatttaaatttacaacccatttgagttaattttatgtgtgatattaggaagaggtctagtttcattctcttgcatgtgaatagccagttgttacagcactatttgttgaaaagactttttcaccattgaattgtcttggtaccctttgaaagaaatcagttgaccataaatgtgagagttaattttccagactctcagtctataccactcatcttgatttctatccttaaagttagtactacactgtcttcattaatatagctttttttttttaaattacgtggactttcaaccaagattagattactgtagctttatactatattttgaaatttgaattgtgagtcctccaacgttgttcttcttttccaagatgattttggctattttgggtcctgtacatttccatatgaattataggtttagcttttcagtttttgcaaaaggcagctgggatttttttataggaattccactgaacacataaatctctttggggagtattggcttcttaatattgtcttctaatccatgaacatgagaagtctttccacttatttggattttttaaaaatttatttcacagtgttttcttattttattattcctaaacattctattcttttttaaaaaattaaaataaattctttccaacccctagtattcaagcattttattctttttgatgctattataaatgaaattgttttcttattttcacttttgggcatattctaaaagaatagaaatacaatagattttgtgtattgattctgcaaacttgctgaacttatttattagtttgtatgtgtatgtgtattatttttcttgcgtaattgttctagttaaaacttctagtactatgttgaatagaagcagagagagtgggcctggcacaggggctcattcctctaatcccagcactttgggaggctgaggcaggaggatcacttgaacccaggagtttgagaccagcctgggcaacatagcaagaccccatctctacaaaaaataaaaaaattaggctgggtgtggtggctcacacctgtaatcccagcactttgggaggctgaggtgggcagatcacctgaggtcgggagtttgagaccagcctggccaatcggtcgaaatcttgctttactaaaaatacaaaaaaattagctgggcgtggtggcacatgcctgtaatcccagctactcaggaggctgaggcaagagaatcgcttgtacccaggaggtggaggttgcagtgagccgagatcacaccactgtactgtagcctgggtggcacagtgagacactgtctaaaaaaaaaaattagctaagtatgatggtgcacatctgtaatcctagctactcaggaggctaaagtgggaggattgctggagctcaggagtgggagggtacagtgaaccataagcatgccactgcacactaggctaggtgacagagcaagaccctgtctctctggaaaaaaaaagaagtggagagagtgaacatccttgtcttgttcccagtcttaaaaggaaaaagcatacagtcgtctttcagcattaaatgtgaaagtacgttattagctgggggttttttgtaggtgccctttattaggttgaggaagttctatttttaattcgttgaattttttttttttttttttgagacggagtttcactcttgttgcctaggctggagtgcagtggtgtgatctctgctcactgcaacctccgcctcccaggttcaagtgattctcctgcctcgccctcccaagtagctggaattacaggcatgtgccaccacacccgggtaatttttctgtatttagtagagacgggggtttcaccatgttggccagtctggtctcgaactcctgacctcaggtgatcaacttgccttggcctcccaaagtgctgggattacaggcgtgagccaccgcacccggcctgaatgtttttatcatgaatttgtgttgaattttgtcaaatgctttttctgcatctattgagatggtcacatgatttttgtttcccttgttaatattcattataaaaatgacttttttgtgactaatattacatgatatagataattttaagaaatatagcctttttgtaggcatttagtttgcttccaactttttgcttttacaaatagcatagcagggactaaattgtttacttcttctctaatcatttccttagaaaaaattcccagtggtgaaattcctggcctaaggctgtgaacattttcaagacttctgatgtacaagaacaacatatatagaaagcaaatcatagatactagaacacgaagagatttttcacatgattcagtaaagctctctcatgtcacagataaggaaacaaactcagaaaggcagagtggcttgctcatagtcacacagagggttagtaatcatctaatgaacacgccaagcttattgcaggctttaaaattcctaggattcttggatttggcactttcaagataaaaggactttgttgaaggttctggagtagtttgcttattaattgaggctttagaattgtggaagaactaatccatctctaaagaatgaaccattttcttactatataccaaattatggcaagtaatactttgaaatgaaaatataaccaaaatcatcaaattcttagttagtccttccattttccaaaggacataatactcctttgaaacaaagcatcagtacactttagctgctgatatgtgtggcattcttccttattatctttctggtgttgaaatgtgtataagcactcctgaaagtttacgcactggttcagaattttgcagaggtttattacagtttcagaaactttttaaaacaggctgaaacagatgcttcaggtttcaagttctgatggttgtttgcttcagggaagtccaaaagaaatagaatataatttgttggaaggatgtattgagggagtgctctcaggtaggaacggaatgagggtcaggggaaggagctcaacaaatacgtggtctcagctggagtcaagcttcgcctgctcccatgggggactctggagcatgaattgcaccacagagttgttcttgccttttgtagtcccccttatcagtctgtcattcgttcttcgttgccaggaagggctggtgtgtaacctccctgtcaagactgctgtttttttttgtttttgtttttgtttttggccaaaggcaattgcccagagaaggggcagctgctagccattagcaagcagccctcacaggagttggggatgagtgcactgggaaggagatctgagtgaggccccaacagtattcactacaacagccatgcaggggatgcatttctttcgtctgtgctgcctcgggcacttattactagtgagctaaaagcaaacaataccatcatcccgcaagtcacaacagacacacagcaggatatagtaactccctaagcagaagtcatagctatacacataatccctctactatgctgtgttttccttttggggtctagaaagcaactgaaaaacaatttttccaagctgtagtgtctacagtttgagtttctaatctcaggcatgacatagtagaagtatttgatgataatactaagaccccccatttgtgtctcatgtacttgataggttttccagttattcccaaatgctgcaagatttttataaatttctctgtgttaaaacatcaaaaggagccaacaggctcttggcctgggatggtgagctcagtgaaggaggtcgagttttagcagggttggtggggccagtctgtgttgactcttatggaaggggcctcagccttggtcattcactcattctctgcagaaaagagaatgggtgtcatcagctggtggtccaggagggttatagaagagaagtcaatgtggagaaagaaattgggaagggtgctgggctgcttcaagttgaagtataaggctgattgcagaaggagggagcaggtgagctcctggtaccgacactgggcaagtggatcccactatccctgtgtgtctctcctgtaagaggagtgattgcttcagtcacaccagcagtatgtatgcaagcactcaatcattcatccttcaacacatgtattgagcaccttctgtgtgctggactctggggaagaaaaatcaacccagtcccctggtccttgagaagtttgggttctggtggtcaaggcagaaagggaacagatagaaaatgttcctgtgggagacctgcacacatgagaggggaggaaggggagtaggcagagatgcacacaggagggccacttagtagagctgttcacaggctgggctgtccgcctcacacagcatgttggcggatctcgcagagcacttgataccaagttcaaatggagtggaagccgaggtcccctccacagggagaaatcaggtcctctgggccccagaccagcagaaaaaacctgtttcagccaaagcagacagtggtgatggcctctcgggatactgtttctgctcatcagtacttttaaaagtccaatagcccatttaataaagttgtcctgttgtctcttacagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaactagagatacttcacagaataacagggaaagttccctgtgctcatggagcttacattctacagggagaaagagatagccaatacataggaataaatatatacaaggtatcatgtagtgataattgctgtggagaaaaataaagcaggggagggagtaagaaatcctggagatgaggctgcagttttaaatggggcctcactgggaatgtgacgttgagcagagacgttagggaagtggatcctggacaaggcattccaggcagaggaacaggatgtgcactgccccaaagtgagaacttgctctacgtggtcaggaaagagcagggagaccaagcagagtcgtgggcaggggtagaatggaaggagaggcggctggggaggacaggtggtggagggccttggcttctgctaagtgagatgggaaccactggagggtttgaacagaggagtgccttgattgatttatattttgcaagggtcattctagctgccatattgtgaaaaactttagtggacaagggcagaaggaagagggaagacctgttaggaagctactgcaaggttccaggcttgggcctgggccacagcaacagcagtggtcaaatatctagatttattttgaaaagagccaataggatttgctgagagtttgaatgtggagtgtaagagaaggaagagttaatgatgacattaaggtttttggcctgaatagcaggaaagatggagttaccagttactgaaatagggaaggatgggctgggtaagtatggaatttggtgcaaagcaggctgtctgtggttggaatgggaggttctggctgcaaatcaaagtggagagttctctcaggtcaggtctgcagcagagctcgagacagggatctgaatgcacttggtttattgttgggggtgctctcagaaggaacctgtgaaagcctttatcagtcatttattggctgtgagaagttctctgggagtgtgggtacatttgaaggcaagtgacttcagttgagggcaagtctctggaaaagaggctgtaggcatctggcagctaccatgcatggtagtgtgttgggggtgggggtcctgggcactggctgtgtgaagggatctggcagggcaccacagcgccccctactgaaccatcagcatgtcagtggcatttaaagccatgcagctggaggggccactgagattgtctctgagtattactgagaagcaacagaaaagagccatggatggagcccttgggctctctgggaaatgggaaatcagccaaaggactgagaaggagttaccttaaggtcagagaaaaccaagagagtgtggtgttctggaagctgagctttctttattcaacctcattcccttctccaaataagccacttgtgtagttgggcccctccagggttgaaggcaagaggagaaaggcacagcgtttgggaaacaagacttttcctgcaatagcctgggaaggaataaaaggatagagtgtttgggtttttgtgtaatggtggttaattggggtggaacactcacacgttgtgctttttctgggcttcccttatcccccagaacactctaccaacctcggggaactcgggcacatccttctgtttctccttcagctctatcctgctttcctcatcccttctgacaccacgtcctcactcacctgcacaagaatccctgcatcaggttctcctttgagggtacccacccaggacagtcccctaccacttctgtcttgggctgaagttgcccacgtccacaaaatctgtactcccagcgggggtgtttggcccgaggagtcagtgttattactggtggatgcaccgtgtccacagcagcccccaatcccagcgatgcgtcagatcttacgtggcttcctgctgggggagatggccttcacccacgggatgccgggttctcctttctttcctcaccccaacctttactccaccagagaaacttccttttgaactcagtggggaagagggtgatgagacaggactagaaagtagtgggggacccagcgagtggacgccctgctccgggattcctgagtctgtaaatagtgtgcccagcagctgtgaactccccttatagcctcaggctgcagtgtccttcccagctgtgtgagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccctgagtgtgcttcttggaagagcctagaagattcctggatggagaccccattggttcagcctcaagtctggcccgtcttcgaaaaaacaaacacatttgtaagctttgtgggagcttccaggcctgctctaagatgccttgcttgtcctttgacccatcagcatggagctcagtggttgctgtttggttctgcaggctggtggggaggccgcccatcgtggtggggcatctgtccagccccattgccactcagggcatccaaacaggaggcacccgctgggaagggtctaaagatactccttgtggccactgctactgttcacacttgacttgtggagaagcgaagggctgaggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagattgtcagttggaaggggtttattatgactgctggtgaaataaacagtgaccagtttctgccaacatttatggaaataacgtttctaggttttaaatgtgagccgtaaactgaagctacttcagttaaaaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtacaagggaggaaagaaaaaaaggaaaggaaccttaagtaagcctcagccaaaggttttatgcattggacttcctgtgcctgcccccaggggcaagactgatccccatgcctgtgcccatgacatctccctgaaagaggacaccatgacagcccggctttgccttgactgacccactgctaccccagaaataagaatcaagagcagctattgttatccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcagccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgctta

SEQ ID NO: 35855 - DNA, 57077 bp, Homo sapiens
ctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggtaagccaggccgggggcgcgaggcggcagctcgggctttgttggggtcctggcagggagcgggccggggctggcctggccgagcgggtcctggagcccgagcctttgtttctctctgggctgggttcactagcggcgggtaggagaagcgcggcgcccgttcggcccggcaagggcgcggggggttgcgtgcgacggggccgctgcccagcccagtccggagggtggagaggcctgcagtagccatgagggcgcctcctcccccaggccgaaccgagcgggagtcatttgcgagggcgtcgggcgggagtgaaccgcggacctcgtggcctcggttcccgaggaaggcctggagccggaggagagggtgggggagggcgcggtgggagtattcgcttccaagggcagcaggcacttcccagccagaggggccgtggggagggcctgggtgggggcgcggccaggcactccagacgggaaaggcggagggcggaaagtgagagcagcgcgtggatcataatgtaggctgggatgggggtggcgggagttgagagaagccagcaaatagggagttctcgggggaggtgggagtagaggacctgccgggagaaaggaaaacgtggagtaatatacctgatgggctggaaggctggtgttttggggcgactgagtttatagtttggcgggagagagcgtgccttggtccattcaaacacttcaaagtagatactagcaaacttccgctctctgcctacgctcccgccatctcctgtatttcctgctttggttaaaactggttactgaacatcgtcccatggggagggattagaaggcattgtttttttttttcatcatttattttctatgcatgtcccacttttcttcataagtagcttttgaaatacagggatcatgttcaaaacgtgtttttagtatttatggcgaaacaccgcccatgtggaggttgagagttgaaatacttacacaaactcttggtgttccagattcctttccttaaaggtacagaggaatttagcagttaatttaagcaatttcgtgaaaatcatttcttgtcccttgtgtgttttcattgatgaagtacaaagacctgtttggataattcaggcaaaacccacaaaagcccgagtagccaaatactttgcataattgtatcattttattgtgtacttgtgatacagaatcactgtgtcaagtcacctgtatagctgttttgaatttttcagctaaagttcttcattgaaattgatttccagggatatgtttagtgtcattgtagagtataagccaggatagggtgtactttttgaggctttgccatatgttgaattattcaatagaaagcaaaagcatgtcacattttaattttgtgagttatttagtttacgatattaggcattgtaaaaaagacaatgacattgtaagacagactctctttaggctatcaccctcccccaccattacgccccacaaaacgttaatacctctgagctgtatgtcacagactcagagctggaagcaacttaaaaaagactatacgcggctccaatcaaggaatgagaagtggagaacagagttaaggtggcttgtgcaagtttacagcaggatctggaaccctgcctttgtcattttcactcagcagcacacagttcagtactgtagttaagagtcattacagcctattttaatgacatttataatgcgttggtaaagtagggaacacttagttcttgatttctctaaggcaaaaataaattgctgtcatctggaactgatgtctctcacaggaggtcagattggaacaaaatattctgggagggaatgaatgaattcatttgtatttgtgcatatgtgcaccatttaaaatgttccccttgggattagtggtcccaccatatgtatgtgcgattgtttactttctcttgcaaaaacagatatccttagtaaaaaggttgacttttggagtctaatggtagctttatgattcccttgtatattatttagaatttgcctatggataaaggagagttcatctttggaataatgcccaagttataagaaatagtagagggaagtttttatactcatttctatgtcatttgagtgccatttatccttgaactggttttatttaacagtggacttaaggtgtttatcggcctcagaattttttcatactcgataattttaagtcacttgttgactgccatgcaatcctgcagattttttttttccctgataagcaagtggttttattggagagcataagcttgtcagtcttacaaactccactgccagatagggtttctgcagtactgagaagggaaggtaattcagtgggagatttcacttatattaatgctcccaaactatataaggctttatttactcctggcatattttaactttgaaatcaggtgaagttattataggtttctgttgcatattctggcctcatttcttctttttgtcaacccacagaatcttcactatacaattaccgaaagtaataattttccatacttactgttgaagtatggaaaaaagttttcgatgttaggggcgtttttcattttgatgttggtttttgatattaccacctgataagagttttttctgttaattatgggaaagtaaagctaatgtattaatactgtgataacatttgtggagcatgcacattttcactacaatcctgtatggtagatgaggttaaatgaacttgccacagggaacataagaaatgtttatactcaaaggtttaaagaaggcattccctaaaatcttcatctccatctttggataacagtttttggtgaacattttctaagatctctgcatattgactcaaaaatatgaactataaaatttaatatcagtgggatcaacgcgtgttattttgtactttgatttttttttccactcagaaatgtcattaactgtaggtacacattacgcttttaaattggctgccataggccgggcgcaatggctcacgcctgtaatcccagcactttgggaggccgaggcgggtggatcacgaggtcaggagatcaagaccatcctggctaacacggtgaaaccctgtctctactaaaaatacaaaaaattagccgggtgtggtggcgggcacctgtagtcccagctactctgggaggctgaggaagaatggtatgaacccgggaggcggagcttgcagtgagccgagattgtgccactgcactccagcctgggcaacagagcgagcctccatctcaaaaaaaaaaaaataataaaaaataaatagattgactgccatagtactccagttgtaaaggtatgacatcacttatttaaccaatatcctgttcattgatatttaggtagttttccacttgttgctattttataaatgagaagtttgatgaacatccttatacatacgtatttgcacacatccttgagaggttcctggaaataagattgacggataaaaagcagtgcttattgccgggtgtgatggctcacacctgtaatcacagcactttgggaggcctaggcgaatggatcacctgaggtcaggagttcaagaccagcctggccaaggtaataaaacctatttttgtctctgttaaaaatacaaaaatacactgggcatggtggcgcactgctgtaatcccagctacttactccggaggctgaggcaggagaattgcttgaacctgggaggcagaggttgcagtgagtcgagattgcaccactacactccagcctgggtaacagaggtagactgtctttaaaaaaaaaaaaaaaaagcaatgcttatttaaaatatcatgattttgatgaccagttaatgtcttccttagcagtacttcagtgcctgttattattccatgtagaatttttttattttttagagacagggtcttcctctgtttcccaggctggagtgcactggtgtgatcatggctcactgcagtctcaaattccagggctcaagtgatcttcccgtctcagcctcccaggtagctgggactacaggcgtgccaccccacctagctaagtttaaaatttttttgtagagatggggtctcactgtattgctcaggctggtctcaaacttttggcctctggtgatcctcccacttgggcctcccaaagcactgggattacatgcgtgagtcactaggtcttgccctccatgtagaattttaacatggtattagaacttaaaaagatctttaataataaccaatattggtggggcgcggtggctcatgccagtaatcccagcactttgggaggccgaggcagtcagatcatgaggtcaagagattgaaaccatcctggccaacatggtgaaacctcgtctctactaaaaatacaaaaattaactgggtgtggcagcatgtgcctgtagtcccagctactctggaggctgaggcaggagaatcgcttgaaacagggaggcagaggttgcagtgagctgagattgcaccactgcactccagcctggtgacagagcaagactccgtctcaaaataatagtaataataacaacaacaaccgatattgggcatttgcaatgtgccagacaacacttaaagcacatcacatatattaactcatttaatcctatctatactctacaaaacatattgatagccacatcttataggtgagggaagaaataactgtgatcctatagttggcttaagtcttgagccaagattgaactgagacacagtacagagcagtatgttcaacaactgtgtcatgtcatacctccctccctgctcgtggtgtggctgtgtctgaagcactgacttgataccagtttttaaaaacccttatacttcaactagtaaacttttaagaacaaaactcctttataataaaaagtatcttttaaaaaagaaaacacgcatgtgcacaatagttgacaaatatttatgaagtggagggtttgattttccccttttactcacctttcatttgtactccctctctcatcgaaggaaggtagtttgagccataagcaacatttccaggtgtctgaatttgcctcctgcatcctccctgttttcttactttaatctgagactaaaagtatctgaaaatgctcttcattttgcagatcagtaaattgaggcagtgtcttgcaatggtgattccagcattccttttatcttaataccacagctgtcgccattgcttgatcagcagctaaccttttatctttagaatgtattttatacatcctttgtttggtttggtaatgaagcatctgatgaagtgggcccctgaaaaaatctttgttagtataggtattactttaacaaactaaggcaatatataatacatgatttactttgtcacctctcttcccccaaattttgtaactcttgaccatgtcttaattgcctggtactatgctagaagtatagaaatcattaaactaggctgggcatggtagctcatcggtaatcccagcacgttgggaggctgaagcaagagattgcttgatcccaggagttgaaaaccatcctgggcaacatggtgagacccttatctctacaaaaataagaaattagcgaggcgtggtggtgcatgcctgtagtcccagttactcgggaggctgaggtgagaggaccacttgaacccagaagtttgatattgcagtgagccatgatccagtgagccactgcactccaacccgggtaatggagcaagatcctatctcaaaaaaaaggaagttgtttcaattatattttttgtcatctcctccttcccccatggttgagtgaatactagaaacatgaatcctttttgttcagaccagatgttctttaagagttcttttctagctgtatgatccatgatctttaaggtgtcaagtatttgaaccatttgtgagtacagtgcttcttactttgctgggcacatttctgtgtactcttattataaactacacctcgttggcattttggagcaatgtaaacacttaattaacagtcaccttaggccagaagcaggagaagcaaagatagttgatggcatatttcagaagataggtccagactctcaagtattgaattgtgagacttcattttatgtttattaagttatcctttgacttttctttcccattgattttctttctgtttatgccaggtgaaatgagaggcttcatacagttctggcttgtatgctctgtgatttttgtagaaggtgaacattgggatggaagaggggaaaatcacttttcatgtttatatatgcatatatatggcttttcccctttttgagtaaatttgtacatgtcacacaactgcacttggagcacagggaatttgtacttttgtgtattgtgggtaaggaacaatgacatgtttcggggcttgtgtcatagctccgtcatgtctcattatttcaagtctgggtttaaagatcttgaggcaaatttctctgctgatggacttggtctgaagtaaactggattagtaaaatgaacaagcatagattattttattttattcccaccaccagtctcccagaggctgctttcagccacaacgcatatgaacaacctgcagccattctgcttgtgaagttcttagcatagatacttttaaaatgacttattaaggtcaatctctagtaactggaagtagataccagcattgactacttaaaattgacccaggtttaatagagtggctacctgcataattttaacatgttaaacaacttaatagtgtttagcaaagcttatttttaatttggctatgtttcattttatggtagaccaaggtacatagatttatagagtgctttcagtgttttgctgttgctgtttaggttaaaatgcaagagtaaacaagcaagaaggaataaaagttttaatttcagtttttttaataaagcaatatacatttactgaacaaaattgggaaagtgctggaaagtataactaagaaaacaaattctgcagtcctgtaattcgtatttgtattagttgagatattgacaggtataacattgtactatgctcttttcactttgcattacaaccgaacatcgtcctatggcaaagaaaggaatattaaagtaatttattagaagtggattataaaagtattgagcaaaacccaccactgttgactgtaatgatgtgaggtggagttgtctttatctccagtagcagtgtttgtgctaacttctgaatatacttttagtgcacaaaatacctcttcacaaattgaaggagaatttgagaaagattgagatgccatcttcttttactcaatttggacctatcctttcttcatcctaccctcagtatctgatttctgttgtctaagtaggaggggttttacttgcagcagactgagttcttgtgttacctcacctaatgttaaaagttaaggaaggtggggcatcagcaaggaagggaaagatgtttgtggtggagaatgggaaacccttgattgtagggtattttttattatttctgatagttacataatccattggactttttattcatttgaacgttggacatttactctctttgtgattataacgctaccgtgaacattctgcataaaattcagaatctgaattctaaatttttgtttttaggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacaggtgagttattgtataccatggtacatatttcatttatgtttaagtttaccaaatgttgcatatttgattctggtggtcatttcccttgtctgtcctatagaacatcttgaagaatagctgatttgatgtttaattggcactctgaatttcagagtggaaatcctatagagaatacctctcccctgaatctaggggaaaatagtggtgctcgcttttcaaattttgttaccttatgtatggcagaggtattttgactcccggacagtacagatttagggacccacagtttgttttctggtacttgggtggagaaatcactggggtagatttttgtcgtttgtatttaatatggtattttgaaccatgcaaaaaatgaaatgccaaagtaatataaagtctataccggtgacttttgtccatctagtcgtcctccctcccatagaactaaacactgttactagtgtgttatttgtaatatagctaggatattttttaaacatggatgggctattattaactagacccctgttgatagacatttagactgtttcccatggttgttttgcatgggtcaagtgtttctgtaggaagcagaaattgctgggtcagaagatcatttgtaattgtgatacagaaagctggatagccttccagagggagcgtatcaatttacctttccatgagcatgtaggagaacacgtgggaaactattaaaacgtgaatttttacaaatccaataggtgaaaaattgcattctaatgtactttttaatttgcattttcttgctgtgggtgagaagtaactgtctttatacacttaagcctgaaccatcaattaaaaatttctggtttcaaaagtagcagtccctgatcattgtagaaactttgaaaaattcaggaaagtattgaagtgaattacctgtcttaccatgcagagattgaacataccgcatacacaatttatctttttctaaagttacatgtgcatggagacattttgaaggtactgtagcaaccaaaataggaagcttttattatagactgagccttagtaccattcttcttttcttttcttttttttttttttaatttttgtgttgttgttgagacagtctttcacccatgctggagtgcagtggtatgaacacagcgtcaacctcctgagctgaagcgatcctcctgcctcagcctcccaagtagctgggatcacaggcatatgccaccagtgcctggctaatttttaaataaaatttttgtagagttgaggttttgaactcctgagctaaagcaatcctcctgccttagccttgccaatttttcttttttaatgaaggaaaacttagaattgatgttagggtattcaaaaatcaccttacggaaattttaagaattttcaaactacaagaaagactgtaactctgaacttactatttaattgatatttgggtaaagccagacactgtatactttacatgtattagctcatttacgtttttctataaccctgcaggaagatattcatcaccactttacagatgagcaaaatgaggtttaagtttatgagaaacttaggtttagtggattgtcctgggttacatggattatggattttggtgggctcaatatttaaaactttgtaccttttgtctttatatctaaagttttatatttcatactgctattctgtggtctgattatgggtagcctcatttcagagatgagtttattaatggttagtgtagaaggaggtcaggtcaactcaagatgaggtttgtgattatttggattaatatttaacttttagaggggtaattaagatacttggatactgaggattgcagcacatctgggggatttgaagggaaaccaaacagtttaaaaagtgaatttcattcaaatgtttcctagcatgctcttattaaactttgactcaaaccattaaagccagtctttttttggtgatttgttcttgtcagaaaaattctctaaacaaaatctaaagtaatgactttaactttttttttttttttttttttttgagacaaagtctcgctctgtcacccaagctggagtgcagtggtatgatcttggctttctgcaacctcctcctcctgggttcaagtgattctcctgcctcagcctcctgagtagctgggactacaagcgcgcaccaccatgcctggctattttttttttttttttgtatttttaatagagacagggtttcaccctgttggccaggctggtctctaaatcctgacctcaagttattggcctgtctgggcctcccaaagtgctgggattacaggcccaagccactgcaccgggccatgactttagcttttgacagacctacaataaagacatttcacattgctgcttagtagacacataactgcacatgaggaaggaattgaagctaggtcaaccaaagggacagtgtgagcaaggacgcatgttgagctaagggaatgcaggtatgctctggctagaatacagagggtttgggaaggtggaggtggggcaggtgagactggaactgtaagttgagccttaatatatcttgtatagactggaagccatcagagctcttgaattgaagaggaatgatgaggatttttttttaaaaaaactcctgtctagtgaacatattgatgatacaccatgtaagagctcataacaaaagtttcgattctgtgaagggccttgggaatagaaaataaagaatggattggagtcaggatattaggaattacaagtattttggaggaaggtgagaaatggctttgcttttgaatgtgtgaatttgggataccaactaggtggaaatgaccgttagctctaagatgaaagctggagttaggattggcattgatgtattataggtagtattagaagttagaacatataagacttcacaggatattatgtaaaacaagaagactagaacaccgaggatcagttttaagatgccctcaagtggaggaagcaaagagctgaaaaggaggaatggctttagaataacttagacctggctgggtacagtggcccatgcctgtaatcctggcactttgggatgctgaggcgggcagattacctgaggtcaggggtttgagaccagcctggccaatatggtgaaaccccatctctactaaaaatacagaaatcagctgggcgtggtggcgcacacctgtaatcccagctacttgggaggctgaggcaggagaatcacttgaaccctggaggtggaggttgcagtaagcctagattgcgcccctgcactccagcctgggcaacagagtgaaactccgtcttaaaagaaaaaaacaaaaaagccggatccctggcttgaatacaccagtagcctacatatttcaggacctctttcttttcctaatgctgttttccttagaaatgtgaacagatgcattaactgactggttctccagctattgcctgggagttcttgaaagtccttgaaaccatttcagggatcctagaatttgtaaaaatacaaggaaacgcactcttctagctaagtttttttgtttgaaaagtagtcatttttatagaaagcgttattttgtgttaaaacagaatgagttttattgttaggaattaatattttagcaatttttcagttttaatttcttaacagtaaatttattagtagcttggcatcctcggtcattttcagagtgagtgcacaggggtcctgagagctgctaattgacttgttggtcttgtttttaaagtggaggtaagctgttgattttagcggagtgaattaaaaaatctgaacattcttggccaggcatggtggctcacgcctataatcccagcactttggaaggctgaggcgggtgcatcacctgaggtcaggagttcgacaccagcttgcccaacgtggtgaaaccctgtctctactaaaaatacaaaaaattagccaggcgtggtggcacgtgcctgtagtcccagctacttgggaggctgaagtaggagaatcgcttgaaccttggtggttacagtgagccaagattatgccactgcactccagcctggtcaacagagtgagattccatctcaaaaaacaaacaaaaaaacaaaagatctgaacattcttgccttgagaattttgaattaattttaaatatctttggttcaccagtgagtgaatttcactttctagatctttgaaagtacattttgcctttgtaaaagggttgccgaattgaggatatatcagtaagtaaggctttatagcctgactagaaaaccacttaaacctaggtctgtggatttacagaacccgatagatactacttctttagttatttttgttcatttaaagtgttttaaagatatatatgattttagagaatcagcataattaccctccctttcagatatttgttagtgacaagttacccccaattgcagaagcaacctaactaaaatgtaataatagtgcagccaccaatattccttatcagttttactgtactgatactgtgcagaaaactccatgtttcctgtagcattagagtttgataggcgtttggaagctttgatgtaaaccagttatgctcttctagcagtggatttccatataatatggtgagcacttacatttttcccatggttcttttccagttaagtgactggaaaactgtaaaattggggaatccattagcttatattgataatggaactgggggaaaatgtactgccgtcatggcaaccaatttaacttgtgcttgggggtcccccaaccctttggctgcccttaacgaagtggtgctgctctaggtcctgttaaatttgagactggcagttcttaaaattgattttaagatggtacctaaggtgctaccattgtgcatactgctcctgagggggaaaggataggattacaaaagagttgggtgctaagagttaggttctgctggcttataaaccaaatttgaattgaattaaataaaagtacagcttcagagttacaagggggtatgatttccacttgattttgcaactcaaattatgtaagaatttaaaagttacactttcttagaaacgtttgttataaagtagaatttgttgtaagttggattttttaaaattgcatagagaaatacttcatgatgggatagtcacactgtcgagtgtattcctgattgtgtctacccaacttgggtgtgtgtcatatcagtattacacataactgttccttggtttagagagcttgtgttgttacaagttttgaatcacaagtcttatagtcatttgcctaattggatttggttttaaatcattagaatgagataaagtgctttatgttacatatacttgatatgcaggcagaatagaattaatttaaatgtgaaattatttgatagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtaagtactatatctttaatgacgcttttagtcctctgcttgccattttctgctattagatagaagactttgctagtgcaggcttatgtcatccaaatttagaattatccaaagtaggccttcttagacttaccacatgaccttagtttaattatatattattggtaatctatagttacttggtagaaattgaagttcaaaggtcagattttagttacttggttctgcattttaggtgaaatgttactgatactgtaaaatgtgtggttttagtagacacaatggtgtatgacttaattgtgaaagaaaaggaaagtgatatgtcttacttagtaaaagataactacttttagaaagaagaatgtataggatgggatgtgatttatttaggggagaggggacttttaatgttaattatgcagctattaccgtgcatctgttataagctaaaaagaggaatcttttgttctgtaatacactgttagagctgcctctaggtccttgttcctctatagctatggtgcagataattgactactgtattgagctttctaatgttttaactctaccaactttttattgtcttatacttgcattctgcataagttatgatgtatgctacctgatgatgattctttctcaagtcttccctctggttgcttctgcttattctgtatttatgtgatatttaagtccttttaaatgtgacttgtttgagtggggctcagtggcatatgcctgtttattcccagccacttcgtaggctgaagcaggattattgcttgaggccaggagttcaaggctacagtgtgctctgatcatgcctgtgatagctactgcatttgaacctgagcaacatagcaagaccacatttcttttaaaaaaaaagaaaaatcatatctatgtgatcttctccctgaggtttttaaaaaccattttggagcgttgtgtaggcagtgatatgagtctttgttgtcagagtctttgttgtcagagagatatatagtgttaatgggataaatgaaacaagagtctctcttttttttttttttttttttttttgagatggagtctcactctgttgcccaggctggagtgcagtggcgccatctcggctctctgcaacctccgcctcccgggttcaagcgattctcctgcctcagcctctcaggtagctgggactataggtgtgcgccaccatgcctggctaactttttgtatctttagtagagttgtggtttcactatgttggccaggctggtctctaactcctgacctcatgatccgcccgcctcagcctcccacagtgctgggattacaggcgtgagccactacacccagccgcagaaattgaatagaataatgaactgcatgtgtttatcatcgacttttaactatttcagtcttatttatttcatatccaatcttaatttatttccctgtcccatgttatttcgaagcagtcttagataccaaataattatatatataaatatttcagtgtgtatctctgagatagtttcttaaaatagagctatcataacttaaaacaatttattggatcaaaatatccagttttcattcaacatttgtgtcagttttttctaattctttgatttatctcattttattagaactttttattcagcgtgatatttaatagcagttgaactttaaaatatttaaataagcttatccttatgactttatgggacatatttttggcttaaaccttaatcttcactgaataaattcttgtagttgttcagtgatacgttattgatcactggtaattacagtataattgacaataattgcataagcaaaatcatagctcattatgttgtattactttaaaatgcaggtaatgtcaaggacttgaggataataagggggagattttactcatctttaggaggaatatcattattctgacttgattcacattgcattgaatttttttggtaagccacagttgagaacagaatttggaaattgggatacaagaaagttatgcaatattggtgctgtgtgtatgtgtagtaggaagtgggtggaggataggctttcaaaagatgagtacctctgaaagattttggttcacttcatagggaatgacaagtaacagattttatagttcaaatgaagtatttttggcattgtgatttttttaatggagcattttctagaggttataactacttgtaaaagcttacttaagacagggtaagcttattggggtttcttctaggagctaacctggtgttgcctttaagtaatataagtaaaggagtgtattattacaataagttagcttaaaatttaaaaatttcaaatgtaactttgctatttgataggaagaacttaactaatgggaatgcttcattaaatgtagctcttatcatatatagatataaaatgcttatatatccattgtgtagccagggcgaactttaattttcactctagggtggtaaagaggctaacttaggcagattatgtttgaggagcacagaatttaaccatagtttgagagcattttagctaaataaagtatctttaaattgtccgcatatagattaagggtctataagatagtttcttcagtgtttgggatacctattcataaattttaggttatagatctgacactgtgctcttttcggaagattggatctggtataacttagtgcacactctgttagtctagccttaaatggctaccccatcccagtgaacaagtaagtttacaaagctgccactcctaaatggtttttatatttccttttttatgtgtttgcttgtccccatccttttcttctgaagcattctttttgcaacatacttactttcctgttttcttggagtggaaattatgaagaaaaaacccaaagagatacctaaagagcttaccagtcagggaacaatatattgctgtatttgtgactagtcagtgtaaaataccttgattcattttgatgtaaggaaggagaggttgttggcttctggtgtagcccttttgcagtggattttaagaagcatttgtctgtggttgtaactttttttttttttttttggagacggagtcttgctctgtcgcccaggctggagtgcagtggcacgatctcggctcactgcagcctccacctcgcgggttcaagccattctcctgcctcagcctcccaagtagctgagattacaggcccccgccaccacgcccagctaatttttgtatttttagtagagacggggtttcaccacattggccaggctggtctcaaactcctgaccttgtgatccgcccgcctctgcctcccaaagtgctgggattacaggcagccgccaccacgcccagcctggttgtaacatattttaattcaggaaatcaccttcagttttttgaaggagctgataattttttagggaagaaaacaatttgataatcttgtaagcgtagaaaaacgtaataattgaagttgttaatttggtaggtaattttactgttattttaggtgatatgcttcctttttattttttcgtaagctgtaaaattagagatttttgtgttgaaggaatctaataatttgtacacataatgattagtcattcagtcagctaatagttaagtaccttctatgtgttgggcagtactaggtataatgaaaagtgaatctagtccctgttcttgttaaagcaaataaaaatgtaaataaaaagtttgacattgtgattaaccttctgaagtagaatatgggtgtttatatgaaagaatgatttgagaataagtttaggtgggaagatgttggatttatttatttatttttgagatagagtctcatctcatctgtcactcaggctggagtgcagtggtgccatctcggctcactgcaacctccacccgccgggttcaagcgattctcatgcctcaccctcccgagtagctgagattacaggcgtgtgccaccatgcccagctactttttgtatttttagtagagacagagtttcaccgtgttggccaggctggtctcaaactcctgacgtcaagtgatccacccacctcagcctcccaaagtgctgggattacaggcgtgagccactgctcccggccaggaagttggaatttaagtcaagggttgaatttaaagtagtggttagccagaacaggggttatgggatagggaattacagggcattgccatagcggattctttggtgcctctggaaacagctgactgaagcaccaactgtataaagactacttatgcagattccagagtgggtttccaacaagacaacttcgtttaaaaataccttgaggccaggagcagaggctcacacatgtagtcccaacactttgggaggctgaggcaggaggatcacttgagtccagggtgggtaacatagtgagaccctggctctccaaaaagatttatatattaaaaaaatgagccaggtgtggtggtatgtacctgtagtcccagctacttggatgaggtgagtggatcacttggacccaagagtttgagactgaggtgagctaggattgtgtcactgcgctccagcctgggtgacagagcaagactccatctctcttaaaaaaaaaaaaaaatggtggtttgtgaagagaatcaaaaggaaatagatcctagagcatagcctctagggtcagtgtctgagttgtcctagctctgcccacgtattagctgtgacattaactatgtgttaagtagccctcatgtgcttgtttctttttcaaaagatggagctggtactaactacctgatagggttgttctgagatcaggtatagttgtctgtgtacaactcttcgtcatttatggcactctgtttaggggtgcatcagtcagcattgctgattcttgctgctgttggtgatgatggtagatatccagttggagaaattattggatctttttaaccagttaacccagttagagagggactcaataaaaccaatttaataaagttccttttggcacaataattgaattacaattggggatgtaaacttaaaccttgacgtgacttgtcaccggaatgaatcaattcaagtattcttttagggctggaggtaaaggtgaaacagatgtggcactttaaggaccattaattatacaaacaattataaactaatttattgaacatctgttatgtggcagtcttggttctagttcatgtgtagcacataagttaggtaagggtaattttattggactcttaaaaagaggtgggaataaaggataaatgtggttatttaacactgaggcagtttctgccagaggactaaaaagttactgtggtcaccctagaagtagaattctattggcttttgctaattcctagaaagctaacttggtttgctgaggctctacatgttttgttaaatttgacctttgtacttaagtatttgtgaggattagatagagaaggctctctttgtttatacagtgccaatatcttaaaaaatattaagtagaacctacaccctacacattcattctagctttctgtgagttctgttgaggatgaaagaatattccctttaaaacttgtgaaaatttgaggaataggcaatatatttttagttgtctttattttctattgttaacttaggcattttttcgtgattaggtatctaactctgaaatacataccaaatgtattttagctgtttacactaacaaagctgtatggtttgattgtggtcttaaacatttcagctctctttaagagtccagggtttgatgtttcctttttgccctgtttgatgtattgaacattgaaacactgtagattctaaattattcaaaatatgttccctttccttgtgagcatttacatctagtagtttgttgtcattgtaaccagtattttgctatatgtagtgctattgtgattacagtaagttagtgttgctcatgttgtgtaatatggttgctaagaacataccaggttgaactagagcctgtctttgtttattccttcaccaataaaagaaacattatgtaaggactcggctaatatcactggctcttcactgacttggttggggaggggaaaactgtcaagccaataaaaggtgatttgaatgtatagagatttcacagaggaggaggtatttcatctgagttgagaaggacggagagactttgataggcagatggactagccagtagcaaatagtatcaatcctttcctgatactataggtagatgagctggtttctattaaggttgaagttctcacactgtcttaattgacagcacacgtaatatctcaataatttcttcgtagtaccccagacctaaagaaatatttcagaattccatttactaagtagttgggtcctaataacctaagtatttatgtttcttttaaaaaatactacacatacgttgaaagaaaaattatttcattcataaataaccaccattatttattaagtgtgttaatgctatttgatcactcacagtttctcaaaccttgataacagattgaacactacctcttttatttcctgttctatactgatgtttgcctcatgcttttttttttttttttttttgagacggagtcttgctctgttccctaggctggagtgcagtggtgcagtcttggctcactgcaagctccgcctcccaggttcacaccattctcctgcctcagcctcccaagtagctgggactacagctgcccaccaccacgcccggctaatttttttttgtatttttagtagaaacgggtttcactgtgttagccaggatggtcttgatctcctgacctcgtgatccacccacctcggcctcccaaagtgctgggattacaggcgtgagccaccgtgcccagccttgcctcatactttttgaaacagcaactatcaaaagtctagcttccacaaatacgacatcaaaaggatttacggtctacttttgaaactctcagctaccttaaacttgtagttcctgggatgtcctacatgttgaacatggaaaatagtaaaaaaattatgttttaaatcattaaaatgagaacatacatattctaggtgatcatttaatgcatttacagatggaatcaacaacttactctaccatttgagtgatctgtttatacccaaaaaaagtagtttaatcttcttttggctgcatggacattaaggttgtaaacaagtccaggtgcagtggcttatgcctgtaatcccaatactttgggaggctgaggaaggaggattgcatgagtccaagagttccgggatgtagtgtgctagtttggcatccatatggtaactccttggagagcgggggactatcaggttgccccaggaggtgtgaaccggcccaggttggaaaatgagcaggtcaaagctgatcagtggtgggattgtatctgtgagtagccactgccttccagcctgggcaacatagcaaggccttgtctctttaaaatatatacatacatatatatgtatttcttatatatagattatatatatttctttatatgtatataaagataaacctgaaagatcagttgtaaatagaaaaattatacctggacatttaaatataagacctataggttcatttattgttaacattaatcaacaccattttgttgagtatgggttcatttgtttggaattccatttaattctaaagctggaatttaaactcaaacatttagaaaatacacaagttgtttttctggaatttaagacagttcaatcttttggaatgcttggtttctaggctcttttaaatctttcagaattgtctcacagatttgatagttctgtgtgtgtgaaagattcatcttgttctaaacttctgaaacatatgacttggtgttcatatatatgactcttttctatgcttggggtttatcatttcatgtcaactgtaattctcttgacccaactgatggagacaggattatgtgtatattacactatgttttataaagtgtatggctatcccaaggatttatgagttacatggaggctagttaagagtgtggtatagaaccgtttattgaatatttcccaagtgccaggcagttagtgtactgaggactttatatatgtacattgttttattttaaacaatttttaccctgttcacatttttacaaggggaccattacggaagaaattgtccaagatcagacaataataggaaaacagggacttaaacccagttttgtcttgcagcaagtatgtattcttaacctctgtgttttatttccttcatcattgttcctcatcgctccatgtaattctctgagtgtattgtaaagctttcctaggtaatatggagaacagtaaatctaattactcagattaaacagtgccattcatttataatagatgcctttttcaggttgctttatttatgcttttttaacttttaggttcaagggtatatgtgcaggtttgctgtataggtaaattgcatgttgtaggagtttggtgtacagattttttttttttttttttttttttgagacagtgtctcactcttccaggctggagtgcagtgacccaatctcagctcgctgcagcctgtgcctcctgggttcaagcgattcgattctcttgcctcagcctcccaagtagctggggctacaggtgcacgccaccacgcctggtgaatttttgtattttttggtagagatgggatttccacatgttggccaggctggtcttgaactttgacctcaagtgattgacctgcttcggcctcccaaagtgctgggattacgggctggtgtacagattactttgttactcgggtaataagcatagttacctgacaggtagtttttctgattctctttctcttcccaccctccatcctctggtttgttgttcctttctttgtgtgcatatttactcaaagttgagctcccaactgagaacatgaggtatttggttttctgttcttgtgttagtttgcttaggatgatggcctttagcttcatatatgttgtcacaagaacatgatctcttttttatggctgcatagtattccattgtgtatatgtgctacttttaaaaatgaattctacttttaatggacatttaagttgattctatgtctttgctattgtggatagtactgcagtgaatatacacaggcctgtgtcattatggtagaagggtttatattctgtatacccaataatgggattgctgggtcaactggtaattctattataaatctttgagaagttgccaaactgctttccacaatggctgaactaatacaatcccaccagcagtggataagcattcccttttctctacaaccttgttattttttgactttttagtagccatgctgactggtataagatggtatctcattgtggttttaagttgctttatttttaatggctgcatagcatttgtgattgtaccttagtttacttaacaaattctattgatggaacctcatttgcagtttttgctattagaaacatttgctgtcctccgtatcctcttacaaacttgtacacacatttttttcacgcatacacatctgtgaaataaattccctacaagtgaaattgttcgggtcatagagtatacttgaattttatcagcttttggcagattgccctccatagagatttttatatactctcaccagtaaggaatcagtaaatgagcatctgtttctttacccttgccaactcagcattataaaactttttatctttgtcaatcttgttaagtgaaaaatgggattactttatggttttaatttgcatttattttctgtgaaattgaacatttttgtatattagccatttgtatttctttttggaatctgagactggtgcttttttcatcttctcaggatttctacctagttgatagctgtttttaaggtgctattttaaaatgcatcttagtttcagagaatttaaatttgaccaaatatgcggtattataaaattgatagaattagatgtttcatcatatgctttgcccatatttctatagtggattggcctttttcttatagatttgtaggagcttataacagaattagcaccttggatataagttgcaatttttgctcagtttgtcatacatttctttgctttatgacacttcatgctacatagagacttgaattttgtacacgtattgaattaaccacttttatgatgtccaggttttgcatcataccctgcccagtgttggtttaaataatttaatccatgtattttactattttgtttttgttttaaacatttaaccaagctggaattttactggggagggatcataagctttgaggtagggatttctggttttcattttataaaaatgattttttgcctttcttaggcttagtttgtaattttttggaatgtttcataaaatatatatacatatatataaatacaaaaatataaataagtaatatatttgcaggatgtaatgttttaccatggtttgttcaaatcagaattagtgatgtgttaggtgtcgtcatcttgctgagatcatagttggcagttggcttgtagttatactacgccatctacatgtgcctgttgcaaaaaaatacttaagctaggttgatactgttcagtacatggggtttttggtatattttattaagcagtcacagttgaaaagctgaactgttacttactccaaggatgtttttgctactttagacatctttaggtaatctgcttcttgtttaatttgattaatttagactagtgtttcttaaactttagcaatcatcagaatcacttgaaaacttgttagagcagattgctatgcctcaccttcaaaatttctgattaagtagatctgagatgagactcaagttttgtagttcttactagttccaaggtgatgctaataaatttttaagagcatctctgccctaaaacagttggaaaacactgtagatagtaaggcacccagtaaagtgtggagtttggctatcctgtggcacttttattaattcatcattgaaacttcaaacttaaaattttactattgtgactcattccttagcctggataaatatttcattactactaagaaagttagtaaaacttgactcttacataaaggaaaatggactgtagtttttatctccagtgcctgattctgcctttcctgagttctgtgtcaagttagttttttgttgttaagcaaagggtttcatacatttaacagtatagcaaatcgtcaagtactgtttctttttttttttttttttttttagtggcttaaaattgacaaattcattctctcacaattctgaaggtcagaagttcaaaaacagtatgttggcaggttagttccaactggaggctctaagtggcaatagtctttcatgattctctcctagcttttggtggtggctaacagtccttagcattccttggcttgtagctttgtaaccacagtctctgccttcatcttcacgtggctttccttttgtgttcaaatctccctctctttacattttgtaaggatactggtcattggatttagggcccactcttaaattcagggcgatcttgtctgaaatttataacttaattacttctgcaaagaccctatttctgagtaatgtcacgttgataggtaccagaggttaggacctgggcatatctttcgaatagctttttgctatgaaatttgtacgtacaatgggttcctttatctgggactttgtgaagagtgtgttaatgtaggagagacttaggactgggaatcagtacagtgatacctagtcttagtaactggttttgagagtctggaaaagttgactacggtttttttcgttttcttcactggaaaagaagtaaatttgactatatccttgagacctttgaaattttgaaatttcatttttcttgaaattattcattgtacaaacagcagtatcccatattaactggtgatgcaagaagtaattaagtgcagcacctcatggaatgggatcactgggtgatgatcagtattgaggaaccattgggaattgtctggatgatagaagttttggccatttaactaagtacttgcaatatgcatagttaataaagcacaataaaatatttccattaatctaatttataatatttatagtctgccatctgtaacatttcttcccttagaaaaataaaaaggaatgtctgttggttagctctgctccatattgtgattgattaaagcttgaggaatgtgaggagaaaaaagatcaaaataaagaaggtgacttttaaaactagttttaagaagttttcaacttaaagtcatattttatcatttctgtgacttttttctcaagtttttattgtctgaagttacaatgtgtctcacaatctactgaggtcttgtagttggtggcagtttggttattattgcctgtgaatgcttgaactcgatctagctgtacatattttcacctcaaataatgtgaattgttgggtctgtatatactgagagtatttgctaatttaaatgccttcagaaatattaaatattacactatgattccatgttgaaatgagcactgagtatcaagaggctgggaaatggagcaatagggtgtaaatatgctagtatttgagcaaatgttggaagagtaaccaatcctttttttttttttttgccttgcaaatcaacagaccgctctattgaagctaagagaggtaactcacaaatagaggaagctgtatgttatgttctgctactgagatcatgtacaagagtattgcctctctcgtgtctgtgatatatcggaagacaggaaaaattaccaaacgtcctcagatcaaagaaatttcaaagcagctaagggctatagtgttgctgattcttgcactatgctttactgtctttaaggcactgagtcataatttaattggcagtgttttttctttcctggtcttacataaaataaccttatagctaatgctgtttgtccctcccaggaatgtggtagtttatttttaaaaatatgaccaaggacaagaagcataaagcatataaatgagttaagatggatttgtttgccaatagtttatgaaatttagaattaagtttaggtgaaataaagagaattcacttctttttgttgtacactatcaatttgctgaacttaatgctccagcagatggcatgagctaaaaatatccagttggtccatgaaagattaggttagactaatcataaaaagagccaaaatggtgaattcataaatgatggcttcagattttttaataccacttttaaatccgtaaataaaataatgggtttttatctaactggatgagctgtgacttaagcatctaaaggcatcctgtgttttgtccaggtgccaaaaggaagatagttgtttttcatagtgacatcagtaaccagtgtggaatggacaggagatagctgacccctgcaaagttatacaatcttgacccttgatctcattgccttcattcttacgtggcgcctgtcttgtgataactggagtccatattagcagccttcacttgagccatccctaactaagcctggtttccctttttggttcattgatcaatctgacgtcatttgtttttatcttccatttatgtatcagcatttgtttagtgttgatgctgcccctcagtcccacttcttttattattgaattccttttgtgctttaagattatttctttggggtgggaggactcacgctttcagcccttttgaaccaagagcctgttgttagcttattaagtaaggaattgttaaggcttaacaaaaaatgtttatttgcatgtggtaacattttagtggtgtgacatgaagcaacttaaaatggtttattagattttgcgtgttgaatatttgtatgtttttaaaaggtttaagaaattgaaaatgacgaattttgccttggcattcatgtgaaaccatgtgatcattatgttccataattggtcatatcatgtcttcccagtacatttcagtattacatttttcaagaattgatgaagcatatcttgtttcattgtatactcttaaaagattttcttgaaacttaattttgcaattgatcatgaaacagtagcacatttgtttggggcagaagtttatttttaatttaccttatgtctttgcatttcatttttgtcacgaagtttggttttaaaatgacctaacggaacctttaaccaacatgttctttggaatataggtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggtgaagtaatttcttctctccatttaactatatatgtgtgtatgtgggcataaaaatggggaatacatactgatcaataaccaactgtaagaaatcacctgtaaaagaaggaactagtaagtaccttcttgttttgtttctgctttgctgtgctttcattttagactttatttctccccctttatagtaatgcatttttaagcccaatcttctcaatttgtaacccacctagttcttttataatctaataacatatatgtgtaactgtgctactcactgtacccttcattaagtacagaggcttattttacttaaggatcaaatctttctccctcagatccatgtccttgtctcatcacaaacacccattgtaacttataatgctggagagtggaaataactatacacaggacaggcagctccttagaaatgtagtcacttaccctcgtgtattacttctttcctccataccacatgtaccttggcccctgttactgtattgattaagggcctaaaactattttctgacatttttgtcccccaaagtctatgatgttcccctttttgctgtgttgtgtgtgtatactattcattggaatgtagactcatcccttgttgatacaagtgttatagaagggttcatagcctggtgacagagtgagactcttagcagaaacaaacaaacaaacaagggttcaacactggcaagaaagattctgggtctttagaaaaaaaactgaggcctgagcatgtttttgtttatacaaattagatcaatgctttaaaaaatatatttaaagaataatgtgagtactatcattatttattaaatttattgtgctaccaaggttttagtgagaacctgaaagtagaaattaagaactcttatgaaactttttatggaggaacctttttatatctggtccacttattttttttttttgcattttctgttttttcctatttgcaaagttttgttttaataatggtagcaataattatactgcatattaatgttttcttttagcaatctgaattacatataattttataaaatctgattttaaggtattttatgaagaaatgctgtagtttgtgcatttattttttttctaaatttttaaaaatgtaaataacttttactatagttcagccattatgtatttgatttttcatttacagtttatttgaaggttttcatgggcatttttatagctgatatatgtagaatagtaaatattgctatactgtaagaccatgtaagaatccttgaagacagcttcaaataatttactgttttctttcaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggtattgttttaattttcttcattatttagcttttgacatactgtttctaatatgcagcaaccttaatcataagaacatgttaatcatattttttatttcaatgttcttcaacctgattgtattaatatgtaaaatatataaccccttttatctgcatactgtaggaatacttctgtataccactagagtttgtgttataattattttaagagtgttaaatgcttttggaatttcaagattttgcaattgtagtttaagagatccctgggatataagtgctattatgctgaagcatgaatgtgcatcacagctgctttgaaatcaggttatcttcatcagtatttagcttgtgagtgaacttgggtgcctattcatcatcaaaacacttcagtttggttttgtcttcccatatgctcatgaaatttgggaaggattactaaaagttcttagttagaatttacttcatttaaaattttattctcagatgtagcatttcttttttttttcgagacggagtcttgcgctgtcgcccaggctgtagtgcagtggtgcagtcttggctcaccgcaagctccgccttctgggttcacgccattctcctgcctcagcctcccaagtagctgggactacaggtgcccgccaccacacccggctaattttttgtatttttagtagagacagggtttcaccgttttagccaggatggtctcaatctcctgacctcgtgatccactctcctcggcctcccaaagtgctgggattacaggcgtgagccatcgcacccggccagatgtagcgtttctaagcttcttttcaatagggtgtttataggtgtgctgtggaatacctgagtggctaaataaattcagaagctatttggataatacaaagttttaaaaagccttttacgaaagggtttttctttttctttttgggggtggggagggaagacagagtcgcgctctgtcaaccaggctggagcgcagtggcatgattatcggctcactgcaacctctgcctcccgggttcaagcgattctcttgcctcagcctcccaagtagctgggatcacaggtgcccaccatcacacctggctaatttttttttaatttttagtagagacggggtttcactatgttggccaggctagtctcgaactcctgacctcaggtgatctgcccttctcgggttcccaaagtgctgggattataggcgcgagccaccacacctggccccaaaatgcttttttgatggcatataaacagcatttgtgctgtaatgtagtattgaggctgttgggataatcgttttgtcctcttgtgtctggtctctagtttctcatttcctccaaagtgcatagtatatttttatttttatttattttgttttattatttatttatttgagatggagttttgctcttgttgcccaggctggagtgcagtggcgcgatctcggctcaccgcaacctctgcctcccaggttcaggtgattctcctgcctcagccttccgagtagctgggattacaggcatgcgccaccatgcccaactaattggtatttttggtagagatggggtttctccgtgttggtcaggctggtcttgaactcccaacttcaggtgatccacccgcctcggcctcccaaagtgctgggattacaggcgtgagccactgcacctggccatatttttattttttaaatcactatttaaaattgtcatcattctcagataacataagcgtattgagattctatcagaaatatcaaatggcctcatggttaaggacccgaaaggtttttctctgagacaactttgtgcggtattttctgtgaatcccacagctggggaaaggaagggagtaagccgaagggttttcagatgtatgctagagtgtctttcatgaaataaaatgctgctctagttgtcagctgtttttttgcataccattgcttctttaagttatctttagattcccagtcttgaatttgaagagttttggggagaaggtagcagaaaacctaacgttttgtttacatttcatttgttgtatttagtagtagagctggtctaaagtaaatattaccttctcatttttgtgaaccttcattatttttacttggtaagttaaatgcaactgcgaaatcagtactcctttcttcataaatttgaatagcctccatgaaattgagtaatctcataaaaatttaaaactggtttttaagaacatattctgaccactaaataaaagtgcttctgtagtcacatgagttaatttgggagggagagagaacagtttaaagtgttgcctagatagtaattagataagagtgattgtaattaaataattttatttttaattttgcttagtaaatttttttttcaacatgcagtgagttaattggtaaggtccagattaatttactaacatattgctgcttttggagttaaaaatcttttctcaaatcaaaaactcctgaactgtctgtctttattctcagtattgctaatgactaagcagatggctgctgttgaaacttcttttcctccactacctgtttctgtttatattctgatgaatgcagataagttttgtggcattctcagctgatagtgttgacttcttggaagtttggcaaacctcagggaaaatttttattgcaagttttaaagctgtttaggactttatctaaaaacttaagtgttacgggatttcttccacattttagagatgcctttatatcctacatagtcatcattttgttttagctccttgcatacttagcagattgggtagtctaatctccagtaaagttggaattgtcattttaaaatactggaatcacaaagcaaatgtctaatttaagcacttaatttttaatgtgtgaaatctggatattttgtgatttctgagcatttatttttcatttatgtacagtaaaattaacaaaattgcagatactcttaaatgttggaatcctagttttatattatgttcaaatgttttttaagttggagagctcttaattttttatttgcatgccagcagggggcattctaatctagatacaacatttgaaagcagtattttcaaaaaatatttgttcgctttgttatattttttatttagatgaatagcatctactttcattttcttttagaaacttgagatttcaaaggaggatctagtaacattgaatctttaatagttttctgtgtcacaatttttgagacagataacctttaaaaaaaactgatgtgtttgaaataagtgaaaagtaatttatttgttcttactgtgtttaagaacgttgtgttttttgatatagagacacagttggacattaaaaaaatataaagtaaatgtcctaaaattcttcctcaccgtttagtatcattgtcctttgaaaaaaacacgcactttgttgacaagggtagcttctgattgggtcatttattggacaggctgcctagtgtataataagcgttttacatacttctgggtttaattgaattaatacttcaataaaatttagaatacatttgtccgcagtgctgccttccatttttaagttcctttgcctctcccagagctatcatacataatctgtctctctctttttttccgtcttgatattcattatgtctcctcttgaatgcacatgtgttagaatatagtcatgtgccacataacaacgttttggtcaagacaaacttctcagatagctgtggtgctgctcccgtaagattatagtggagctgaacgtaaccttgcagcatcacagcacaacacattactcactgctttgtgatgatgctagttcaaacaaacctactttgctgccagttgttttaaaagtactatatagtatgtacaattatgtccagtacataataataatgataataggacattgttagtggtttttgtatttactatactacatgttttatcattattttagagtgttctccttcgacttaaaaatgttaactgtaaaacaggcttaggcaggtccttcaggaggtgttctaggagaaggcattgttatcacaggagatgacagctccatgtgtgttactggcctttggagaccttccagtgggttaatacgttaaggtggaagatagtgatattgatgatcctgaccctgtgggggcctaggttaagtgtgtgtttgtgtcttttaaccaaaaagtttaataagttgaaaaagtaaaaaattttaaattggaatgaagcttatagaataaggatataaagagaaaatacttttgcacagccatacggtgtgtttgtgttttaagctaagtgttactacacaagagtcagagttaaaatttagaagtttataaagttaaaaagttgtagtaagctaaggttaatttaatgaagaaagaaaaatatatcaaaaaaaagaaaatacatttttttataaattttgtatcgccaaaatgtacagtgtttatgaagtctacagttctgtacagaatgtcctaggccatcacattcactaagtactcactcactcacagcaactttcagtcctgcagacttctttcatggcagatgccctatatgagtgtactgatttttaccgtttttttttttttttttttttttttttttgagacggagtttccctctttttgcccaggctggagtgcaatggtgcaatctcggcttattgcaacctcctgcgtcccgggttcaagcgattctcccgcctcagcctcccgagtagctgggattacaggcatgtgccaccacgcccagctaattttgtatttttagtagagacggggtttctccatgttggtcagggtggtctcgaactcccaacctcaggtgatccgcccacctcggcctcccaaagtgctgggattacaggtgtgagccactgtgcctggcggtttttatcttttataccatatttttgccatgccttttgtttagatgaacaaacacttcccattgtgttacagttgcctactgttattcacttcaataacatgctcctcaggtttgtagcctagggagcaataggctatacagtttaggttcgtgaatacactagaatgtttacacaacaacagaatcgcctaacaaatttctcagaacatattcctgtcagtaagcaacgtgtgactgtagttttctgagaaaaaaatttgtagctgcctaagacatttgggttagcctagttcttaaatatctgtgttgatactgtaaaggtgtttgttctcattaggcacaatgaagcaaatcttccatataattgcattagtgatacgtgacattaaagcctaattggcttatttaaaatgtctagcacatcaatttcttttagattgtgaaaattgaaaaggtcgtgagtgcatttaaatattcctgagtgagaaatttcaattttagtacaatttgttgagaattaattaggaaatctgactctaagaaaaggggtgtggaatgcaaataaggcagttatatattcatttgaatacaaaaatgaaagtttcttggattgttttggaaatcccattgaaatttgctaaattagttttggttactaaattgaaaacagggtatccatgaagtgaaagaagatggcatacataaaacagactgcatagaactaggattataataaatactttaaaatgtttcagtattcgtttttagactcacttttattttgtaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtaacattagaaatgctctttataaatatttcactaataatgatttatgagatataaactgtattcagttataaaggactaagttatgggtgattgtgatctaggttttatacaacaaaataatatccatttgtagggttccgcatatctcttgaccctaaagtaagaatgagtactgcttcttctaggtagtgcctccttagcaaatggaagattagttaggatgggttaagaaaggatgttggccaagtactgtcttttctcctattaaatcacttgttataaagtaagcactttttctttggtgccttggccttctgcccataattttgtttaaggcttcccaaatgtaatgtctataggtgtgaaatgttgaccctgtgcagacctctaataacagtagcactgatctggccgggcgtggcggctcaggcctgtaatcccagcactttgggaggccgaagtgggtggatcacgaggtcaggagtttgagaccagcctgaccaacatggtgaaaccctgtctgtattgaaaatacaaaaaaattagccgggcgtggtagcgcgtgcctgtaattccagctactcaggaggcagaggcaggagaatcgcttgaaccctagaggcggaggttgcagtgagctgagaccgcaacactgcactccagcctgggcgacagcgcgactccatctcaaaaaaaaaaaaaaaaaaaaaagtagcactgatcacactgcataagtatgtgagttcctggaatgcagaagcttcatctagatcctgtcaaacggacaggaacaagattatttcagccctatttctgagatactttgttgaggggctgggaagacatctttgattccccatcagcagatatatagtccccatcagcagatagatatagatatagatatagatatatatatatatatatatatatatatatatatatatacacatacatacatagagagagagagagagagagagagagagacatatatgtcttaaatatttatataataagttaatgcatcctccaggcaaagctttaatttttttttttttttaaacaacatggggtctcactatgttgccagggctggtcttaaactcctgggttcaatcagtcccccctcctgggcctcccaaagtgctaggactacaggcattagccactacgcccagccctcagcctgcctagttttcatttgtcttgaaatcatgtgtactttgtatatctgtatttgttttatttttaaaacgttgtgtttgtttaccattgagtgaaactggtgtacaacaaagatgtcctgtttgtgcatccttttgtgtacttctcgtttcattgagttcttctttgagatatatgggcccatatttactacagttacacatctgagctcttgctgtcgttgaagtaaattaaagtttttgtttctgttttgctttttgtgttttaaatccttaggatgctgaggagaattttgtcttactgaaaagagtgactcagcagtggctggatatgtgatgatggccacagctggtgatgggctcactctgaggactgatcatgagcttataattcaaaactaggggctatattgccactttgccatccagtgatggtgtttcagccgaaactgtaggacctcttgctgggaaatcatgttatccttgccttgagtcaatttcatcttagaggttgagaaaagcactgatgtagcttccctggacagtcctagggagagtaaaggaagacttccttggcagttgctgcatcattttcattatgaggaagaacattctgaggcgcagcatgttaagcacaaatttaaagttttcatacaagcctggcttatagaggagggatctatacaagttttactgttcatatgtaattttaaacttactgtttgtgtctaattgtgaaaaaatatttgatttttttgttaaactgttctaatataaggatagtagctagcataaagcaaatatataaaagttgaaagtttttgaacaaatataatacttaatacaaattttaatttccatcaaattaattgtgattctgtataactttatatttgagtcccttttataaggcagtgccatttcttatttctctattagtttatgaaaaatagattttataacttgattgtggtactaataaaaaacagccttttaaacatgttacagcactaatggtgaacgatttcaagtttttagcaatcaagaaaggttgagaatgcaacatatatttatatgagggtaaatatttttacctcttgataatttttgaagtttattcaagtatttgactaagttaaaagttacagtaattctttacatgcattcaagtttactcttcagtagataacttctgcattttttgactgagacttaaaattgctattttgtggatttggttgttattaaaatacaactataattattttttaaatatttagtgttcattaattttgttcatacaaatagctgacttttctatagttgatcctacatttcgctgattaatatggttcagagcatacattgctcagtgaaaaagagaaatggcccttgtggagatggtcctgtagttttaaagaaagacttaatgatccaggatctgaagatagcttactgtggtgctgctgggatgtttataagcaaataagttgatgtccttgtgttggagaccaccacagagttccctggggactaaaagtccaaattagtttaaatgcattattgtgtccagacagtattcaggtagggcaaatgaagtactgcgagttctactttgaagtggagttattgggggcggagtggggggaagtggttctattagaaaaaaagtgagttctattagaaggcaggttattgagggaggaaaatttactcttagcatgtcctgacagtgatgccaagcttttcaccatagggtctgttccatattagtcaatgcggtttgaacactttttaaggctctttgaacgcttactgcagtgttgcagtctagaaagcatgtaacaattatattgattcttactggtcataatgtaaatcccttgacaaattcaaggtcattttgtctcctgatgggttcctggttgtatggtgtgccatttacaattagaacatggttagggcttgcctcactcaactgctgaagtaccaaagaagcttttatcttgtcatttattagttcgcttttgcattgtgtgtgtgtgtatttagccttagctatttttagtccttgagaaaggcctaaaacttgtgcttttttgttaaggactcaatttaacacttgtattttagggtttgacttttggctggcaataggctcttactaatatcaataatgacgagggtttgccaagttggcataaatcatttgattcttaaacacttgcagaatcatgtatccgcgaattgttaagtattacagaatttaatacactcacccagacaaaaaacatacacacaggatgaaattattttgtggagaaaaattaactttttataatggtaactaaagagttggtcacatgagaaatttttatcacattgtattatgttatagaagaaatatgtgaaatgtattttttcccagaacaacttttttaaaagtgattttcttcataaatattttcagaactatggttttcaccccagaattccagaaagccagaagacgtcttctgtatttacaggcatgtagttggttctgtatagatttgagatagggtctcagtctgttgcctagggtggagttctgtgccatgatcatagctcactgcaacctgaacctcctggactcaagcagtcctcccaccttagcctcctcggtagctgggactacaagcatgtgccaccatgcctggctaatttcttttatttttttgtagaggtggggttttactatgttgtccaggcttgtctcaaactcctggactcaaataatcctccttggcctttttaagtgctgggattacggatgtgagccaccatgcctggcctattctgtatagtttatagagcatttccacatccttacataatttattccctacaaccctgtgttatgtagactaagtaatatgcaagttataaaaggaatacaagcttgggggtgttaaaacctttccagttactttagccactcaggtttgattgctaggtctgccagttacctctaaattcatcgcttctttaactacaagaaactgactttctagaatattaaatgccggttatgcttattcaagtttcacctgttaaccttatgtatgtcgttgtttgcttcagttctagttgctgattatttttctaaatgtcctgaagaatgtatttcagcaacatcatcaaaccacatgtggtttcttattcctttgctagttgtcagtcttttcaactgacaaaaggaaacattttggtttttgacttgtaaattattctgaaataccctcttggtagattgctattatgtttttaaatccctgaggtttcctgttagtattttgggaagtctactacttagtaaatatgaaatcagaaaatgaaagtgttaatattaagtaaaatagttaatgcagcaaaagcctatgatttttaaagctatttgatttataaaattaagtgtttttaaaataaaatagggataaatataaatcttttcattttttgtatgtgcccataggcatttctcccacatgtgtttttttaagatggaactttagtgctagtgctgtttccttctctcatgagtaggtcttaaccttaccgtcaaggactgtcctaaatgctattatttttcagtaaagcttttcttgactttgctatggaagtaaacctttttaaatttcacagtgtgtctttggtgccactcacactttctatccatgtctaatcatcccttacaaatggtaaaagcagactctgtttgattcatcttctgtatcaattgcttgcatatacagacatcttcaacttaatatcagtaacctgttcctgaaaatcatgtcctgagttaaaatactaatgaggaatccccatttcccattgtttaaaaaaaaattatatgtaacatgtatttcccaagtccttaactaattttctaaaacatatgtaatatatagtaaaacatgcacgtataccaaacaagctatcatattagtatgtaaatgctttaaacattttccgtcaataaagaattatagttcttaacagttgctttgtatgtagtaacgtattacatgtcatcccgttgagaccatgcacttaccgaaatatttacatttgattctgctgatctgtccattcttactggattataacttgagtttttttccatgtggcattttgtttaaaatgttgagttgaattttggtgatataaataacgaagttttcatttgtaaatattgcccaaaaacattgaaatatacacttgtggaaatttgaatactaattataagggctgttttatcagacgttttgtaaggcacgttatattgcttcatcagtatttttctttttatgctgtccattaatttgattaagcaaaatgtaatgcggttgagtgataacctgaagtaatagctttgttgagaaagaagttgctgttgtggtgtaaacaaaattttggttccttaaatattaatttacctttttaaagcattggccattgaagatcaaatgatatttctagtttatttgctggcttgaaattccttgtgtcagtgaaagttagtggctgatctttaacagtcctgttaattttatttgatatgtaatataatttatatactctatttcttaacaggtagttgtgtcaactaacatagcagagacgtctttgacaatagatggtgtggtgtttgtgattgatcctggatttgcgaaacagaaggtacatatttagtggatactttataaattagagttggtttaacagtacttacaaccaattcatttaatggctaaaatttacctttcagaattattttcctatctttttttttatttgcaaatttctgctgtatgaaccctttatgttttggctggctctcagaaattaagacagtatttaatatgtaattctaggcttttttttcttttagagttgctttgctttctttgtttcagtgtagtgacggtgggtgttttggcttgtatattcatttaacagtatgggtttagtaataaagtacaggatttctatccctgcagttcagtcacttctcccaacattattagagttactgctgtcaactaggcacactatttgaaaacagtactatgttactcctctagtttaacagtgctgtatactaaatgaagtgaaatgcaggtgaagtggctattcaataaatacgttttatttttcaaatatcttttggataaattgattacattttgttattgatggaaattttttcattaaacagtaacagagtaatagtactcagaccgtcgagttttgaaagtgaaggtttcttttcgggcagaatccttgactgcccagcatataaaaagcaaggaacaaggtcagcctgatagaactgaaattaggaggagtaaggattatataagctgtgtgtttgacaagaagtttttcatgttagagtctttcagatgatcgaattagaatgtctgaaagaactttaaggttcaggatggtgggttgtctattgtagcagcatgatttatggctatcgatatttctttatttattttggaattaactgtgggctttggatacttctgttgcatcacaattttgtgtttgactgaagaaagactcttgtgttatttcaattccaataggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggtatggggtattgtcgtttcctgccgatatgtttaaaatgttaggttgaattatcttaccagaagaacattgccttatttacttaatcttgccttttaggattaaaagctccttagcttttccaggagtgaaatgtatggtgtaattaacttagatagtcgtacacccccttattccaggctgatacattccaagaccctccccctcccacgcctaaaaactggaatatgctgaaccttacttacatatactatgtataaatatctttctttacaatttcactgatagaagatgcattctttctttagatgtgatttttttgctcttttgttactaggtttcaactttttttctttccttactaactttcagcgtttcacttaaaggaagcacttcagggcctctcattggcatatccaaattgccagcatcaatattcttggcgctttggggccattattaagtaaaaggttacttgagcacaagcactgtgatactgcaaaagttgatctaataacagatggttgctaagtgacaaatgggtgtatagtgtatatagcatactactaagaatggtgcacaatttaaacttgatgaattttttctggaatctttaaaattttttctgttgacactgcttaactgaaaccatggaaattgcgagttcagatgagtgaagactactatacgaatttctttctgcagttgcgagttttatggacagtagcaaacactgaatactataaagatagttggagaaaaatggtttctctctagtctagcctacaagtatttatctctactgagacagtgtagaagtaatgccaaaacaaatagctcaggaggcagcagatttttgttttctggaacgaggagactgaggcatttttaacataaccaataaatgtttttgttctttgctaggataacacctatcctgagattttgcgttctaatttaggatcagttgtgttacaattgaagaaacttggtattgatgacttggtacattttgattttatggatccaccaggtatgacttatcaaaacacatttttatcagatcttttaaccaaaattgactcttagtgtttttctccatcctatttaatatatgtattaaatacattttgctttttccatccagtatgcatcaagattaagtcttacatgatagcattaaaactaaaaaaggtgacagttatatgagcacattttttttttttcttcaaaagttattatgggggggtttgggtaaattgaattatcctctgggcatgaaaatgtgagaattcctaagttttctttggggaaaaacagtttgataaacacattgatgaattagcaattatttaatgtatttcggaagaagacagttttgcctacaggaaaattttgcaatgtttttatgattcattgtttgctagatctgtataattgaattggatgacagtttgagtttgagtttggtccactgcaaaatgaaaaatgagattgcttataatagtttgtactttgtcacatttttgcttgcttaaggcaccgtgtctaatagattgtcttttaccactagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcaggtaatagagggaaaggaacaaaaaaaagcccagctcttcaaagtttgggtggacttcacttttgtttttgttttttaatttttagtatgatagtggattttatagatggttttaaggaattaattttgttttctaaataccttgtaaatagcttcgtaatgacatagtgcttacaaaagtaaagtaagtcattgtgcacaaaagataagtaaagcattggctctcttgagtgctaataaaaattgcagtaagtttgagcacagttgtaactgaattctttggttaaaggtccatcactgctatctttgtggtttttttgttttttgttttttactgcaagtacaggaagaactttgctctagtacttagctctattaagtgtgcctgtgacaaactgaaagctatacattaagttgagccttttctatatatgtactccaatggcacccgaacaaacatgaatttcaaacttcatatcaagtaaatagaaatagtaatgtataattttaggcttaaaatctaatctgataatggtattcttttacaatggtagaaaaacttggtaaaagaaacatacctaatatataaaatcgctaattttgtaaaattggaccattaagctaaggaaataatgctgtttttagtaacaataaaatgtaatccacaaatgaatagtaacttggaaattagattttccctaaaggagaagaaatattgttaagaaacaaatgaatagctattcttacagctaaaaatagaaaataagttcttactgacgattaaaatattctctgctactagttttagcacgggagagaactgactccctattgctgagtggtttattgaacttaatgctgcaaatatttcaaaatattctgtggaattaaaggataaattgaaaaaaatttaaatgtaaaattatggcttagtttagacgtatggtatattctaatggtgtgaattttttatttaagaagtagctaaaatgttttcttgcagagttatgactgatcagactcagagcagatgggcagggcagtattgagtcactttaattaaattgtagcttcatttgcggaggtggtggtaggttgttgtctgcctttcttatatgttgttttatagattctcccagttgtacttctcccaagattttagtttttagagaaagtgtggggcaagaactaatggattgtgtacttacttgtctatctgcctagtttttatttctctaggttctcttatcagatatacttacatgattactgttgtttgagtttagaatattagctctttaagaagtttgttgttgtgatgtagttgtaatcttccaactacatctcagttttatttgtaattaaaaaaaacttatttttatttattacaaataaaaacctttagtttgtcaggagaatgagcatttatgtgcagcaatgtaaatggactgtttttaaatggtccatttataggaaaagtgttgaaataagaggcaagtaagaagtcagggaataaaaaatagtttgctgagcttgtaatgctttgtttgacattaaaatagtttttgaagttttgaggtcctgatactaacagtgcaaatctagaggcctttgagagcactacttatttattcccacttaactctagtggctagttcacattaaaattcacagctgtgagaagtttgtgtgcttttatgaattaccttgcttcaattaaattaagcaagagttttaatatttattatgatcatgttttgttgtcactatttggctattttggcatctttttaaaggggaaactgtatgggaaagagtaatatgatactgtattttatcttgttgttgattattcccattatcttctatccgaaccgataatttatgaattttttcattgacaaggttttaagagcttttaaaatgtgttgaaaaagtcccaagctgttaagtatttttattttcatactgcttttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacggaggccaagaaagccgcagatgaggccaagatgagatttgcccacatagatggagatcatctgacactgctgaacgtctaccatgcttttaaacaaagtaagtgtaaatttgattggagacactcttgtctaaatgtcacttgcagtgtataagatgtttctttgtcccactttgatttattatccgtgacaacttatattagaaacccagaggtacttttgaaaaactcctgacgagcatttaaaatagaaattgccaatctttttcaaagttgtttatgtttataatcaggggataaagcaccaattgtagaaaacctgaaaaataacagtgataaaaatgacagacttgtataacatgtatcactaacatacacgtttttatatacttttatttctgtgcattttacatttttaagaatagttttatattgtttatacaatcattactctaacatttttactaataaagaactttttacaccaaaataaaactaatagaaaaaaatggacaagtatgaatgatggttcttaggctaccagtggtctctaaacatgatatggaaaagttcagctctactgttagcccaagaagtgcattattattttggcattattattgataatgaaaggcattaccattttctcacataaaatttgcagatattgaaaaatattccttagctgtatgggagtggggttagttgtggtctttatgaaaagttgattttatgttaccaggaactttagcaactgtatactctttgacccagaaataatttagaaagttattttttggtattctgtggacactgatttgattaaataatttcaccagaattatttatggtggtaaaaaaaaaattggctacctaaatgcccaccagtggaaaaattgtgagttatgctgtagacatatgaagtaattgttctagctttaaatcatcttatcatagaatatttagtgacctgaaaaacatttgtcagtgacttgtaaatgaggaaacataataacaatgaagttattgctagctgctgctgttggaatgtaccatttgcaaaaattgagaggaaaccttaataaatttaaaggagaaaaaaaatacagaaattgcaactggatctgacattttttttttaactgatagccctacatcatcaccctgtgccaaaaatgtggaattctgtcactaagtttgtagtttcttctcatgagaaattggtttcttaatttataaagttgacgttccaattttgtatgtctggttttatttgtaactcatttttattatctcataaacatctcagttatactcttaaaatggggagcctgttgactttggcacatctctgtaggggtgatggtgaatttatttgtcttggggtccagaagtgctagagggccagtgtgtgcaccagacgtagtacctaacttgatttacatctgttccttactccagaaccctgatatgagttgaaaagaattgatgactagcagtgagaaagaatggagcccttctctgcccaggcccagaaaacttgggggcagatatgagagttaagggaaatgtggttatgaaaccacaggctgaagaccagcacatggtttaccttagaacagttatttaatctttcttgtatccaaatactggtattacctagcgttaaagacttacccctgattagacagatctactcaaaaaacctactgtattcctcttctatgcgaaacatgctgggtgaccaagagatacataacctattaaagccttgagaaggaacagattcagtcagaggggatgtagtaagttaaaatggtgttatccactcactagatgtatgacctatttctgataaatacatcaaaatactactttctacatcaaaatacaactaataaaatagaaaaacggacaagtatgaatgatggttcttaggctacaagtggcctgtaaacaagaggtggaaaagttcaagtctattgtttgcccaagaaatgcattattagtgagaggtactatgatctctcactgccaaagggatgattagccattggtggtttttaggggtttgcagtatgtgatgacttgacatttggtagagctgtccttattagttaaaggtgaggatttagcctttaatcactgattgccaccttttcaaataagagaagctcttaaaaaaaaaaaaagcaaaaaactttgccagatccccacgtgttattatttcgatatatccatatatatatggatatgaaaatatttggaatattttcacgaaagctttttaaatggttgtatgttattaattgaaacattgagtatatttgaaaaaagcgtgtttcagatactggtcaagatgttttgcattagagacaatagttgattacatagtgaagctaaaatgtcatgtcaattaaaatgttgtcttaatactatttatgtaaataaccctttgaaatcgaaaactagattcaagttattttgcagtaccttgatctgtctagggaggggagatttctctctaaaaatcagacaaatggtttggctttagatcttaggggtggtttactgtattggtgagagataaacagctagaattatattaatgtttccagttttagatttaattttcccatttacccaattatttctcacaagtttagaaatacagtagaaccatcagatgttagttactagtcatttgttcttaacaaataacttagatttgcaatttttccatctgtagtacatgaattctaaaaattgagaaccacacaaaaaagctacatttcaagccatagtctgcaaatcaacaaccttttcaaaaatttgcctttttattgtccagcttgggcatttttctgcctttcagcttgttacagagcatcagcataagtaaaattacctctaaggtgtgctgtttcagctcccaaagatattcagtgctttgatttaaatgtcaatggcttcagatggttaacttttatttctcattccagatggattaattaatgggtgttctaatatgttattgtattctttaattcaaaaatctatttcctatctccacctcacccatccttaatttctgaaatggggatgcattttgtaatggataaaaatgtacttatatatttgttatgtctaaaaaacattaaggcagagttatacactataactggtagaatcctagaaccaaagagaaaagagtatgctgaagataagcatacatcacagtagcaagagaaggatcaacagttttaatttttgttttctctctcccatttcacaataaccctgttagttttatttatcaaaggtcctctgaaataaataatgcaattctttgccatgactgtctttggcacatgaaagatgtcactgtaaaatttctttcatgatgctacaggttgagctctttaagtgagcaacactaggctagttggaagcttatcaaggattcatcagtggagaaatatccttttgataatacatgtaataaaattacttgaagtgcttagacttaggtcttgtttattaaacatgagtggaggtttcgggcatccttgtaaactttcttctgtttcaggacttgctcataaattgctgagagacacgtgtgtcgcaataaaactttgccgtctttaagtctgaggtgctctgtgtcaggcataaagaacaatacacaacaattgtttgcagttatcttaatctaaagctgtagtttcattgaaaatgaacaggccatgacttttaccaaatacttccagccttcccttatctgatagaccatcttttggaaacaaccaggtggatgttaatgggagaagtaattcactaaaaacagttaattcaaaagcattgttttggcatccaaatccaaaagccttgttactgtttctaatgttgaatcacactacagatctttgagaaagttggtaacattgcagttcatttaaagaaaatgttgtgggtaaatctcctttctggtttatttagcttattctttataacaatttttttaattagagaacattcctgtgtgggtgattcatggtgccttcttttctccccgccttctacctttttagatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtatgtagataatatgggaatgaataactaagtattcatatgacactgatttctattaacagtcctttgaatccactcaaaagcaaaagtgagtttgtgcatgctcataaaaatttatcttaaatgttggtacatccagtttctttgagtgaattaatatactaagaaattttaagtatttaatgagtaacaaattaatgtactaaatggctaaggtagtctagttatacaggaatcgtttttagaattattttattaatagagcctttgttatacaaaatggaaactttggctactttcagatgtgattaggcacctgtttcttcaggaatgtgaatattgatcagtgcattaaagtttctctgaatctagggcttaattggaaatacattgtcataacagagtactaaaaggaagcaattgagcggatccaaaagtacatacagttggctttagtctttatctaaaaactaagcacctccaaattcaaatattcaaatacgtggatttcatttacagtcctctacagagtgatcattggtaattatgaccaagacccttgcgtactgcaaaagccaaaaacgtctgttgagtagcaataaagatgaaacataatttaaaaggttttatttagtttaagtatgctgtgttaacggctataagaacagaagtaaaacttgtcaagtaaatactgtgaacagttattttaaggtgtttataaaataagagaaactttgagaaaaatgcaagaaaattttgtggtgataaaattgaaaacaaatcacctgatttgggataagtctcttctatctcttttctgtttgttcattctctctttggctgtgtcttttaagcacgatgtggcttacccttaaggccagatgggctcagtagctagaatatgagcctgaggacactcagtttcagaatcaaaaatcaaaggagattggtgagatgtctgtatttgaatctaagtaacacagtgtttattgtggcatcttattatataataggcttattagagtttggtgaatgataggtatgagcattctttcttgaaactcttaactatattcttaatatttgatatgttgtactggcttctctttgacatgttctgttcttttttagggggaggggatggggtgagggaggcaatgtctcactcccaggctggagtgcagtggtgcaatcacggctcactgcagcttttacctccctgggctctggtgatcctcccacctcagactcctgagttcctgggactacaggcacgcaccactatgcctagctaatttttgcctttttgtgtgtgtagagagagggcctcgccacgttgcccaggctgatcttgaacttctggcttcaaatgatcctcctacctcgacctcccaaagtgctgagattacagacgtgagccaccaggcctgggttgacatgttcttaaatttgctttttatatttcagaaaaaaactggccgggcgctgtggctcacgcctgtaatcccagcactttgggaggccgaggcgggtggatcacgaggtcaagagatcgagaccatcctggctaacatggtgaaaccccgtctctactaaaaatacaaaaaattagccgggcgcggtggcgggtgcctgtagtcccagctactcgggaggctgaggcaggagaacggcgtaaacctgggaggcagagcttgcagtgagccgagatagcgccactgcactccagcctgggcgacagagcgagactccgtctcaaaaaaaaaaaaaaaattgatgaaactatattcaagcattatacttcttaattatgtagattaaaatttgttacaaacagctaggcaccacagagtgtgcttgtagtcctagctactagagaagttgagtggagagcaaggagcgttgaagccagcccaggcaacataggaaaaccctatctctttttaaaaacaaacaaaaaatttattagaaacagcatgcattatagtacctgacacctaataggtgtttagtaaatatttcgaatgaaattgagtttcttttctattattcatgctcattctttaagcacagaatattagaattggaaagggagaactgtccattttgatgagtatcaccagtcaaggtgttaccaaaaaaagaaatgagagggaagcacgtgcaagctcttttttttttcccatttttattttcctgtctttgtaggttacctttttcttttcctctttgccctctttagttttctaccttattttttattctatttctttattttcttttttgaaatggagcctctcggtctgtcgcccaggctggagtgcagtgacttgatctcagctcactgcaacctccgcctcctgggttcaggcaattctcctgcctcagcctcctgagtagctgggatacagacacccgccaccacgcttgtctaatttttgtacttttagtagagatgaggtttcaccgtgttggccaggctggtctcgaactcctgacctcaggtgatctgcctgtctcagcctcccaaagtgctgggattactgcacctggctttagttttctaccttagacatgaatgttctggtaattgtctgctcatagttggcgcccagtgctgaagagcctgctctagatggtctcaggcaggaaagatcagatagtaaatgttgggctctgtggacccatgaagtccttgtcaaaactacctaacactgcctgctcttggagcataataggtatagacaaatgggcatgcctgtgttctaataaaactttccttatggatactgaagtttgaattttacatgctactcatgcttcacggaatgttttttgtatgatattttttctttctaattaaagataaataaaccattttggattcacagaccttacaaatagaggctatgagttggatttggcccacaggcagcagtttgcttatctctgcttttatcagacagtgataaataagtatagccatagaatgaaaagtaaaagggaggcctgcctcttcctaattatgtaggtagctttacaactagcaagtcagaagcattgtattaataatatactgggttttggtttcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggtaagtacaccttttgttctaacagttttttgttagtactttgctcaaaatggaacctgactgttgctagagtcatggccttgcattcactcattgagaatttatatttcagtgtgtaggtatgagggaattgactggatggtgtgattaatctttcacacccttcctttgttaagtggacagtgggattgttgatatttatgggcaggatttgaagccaaatgtgaagttacatttgaatagcatgaaaagtttcttcaggggctgggcatggtggctcacacctgtaatcccaggactctgggaggccaggatgggaggatcacttgaagccaggggttcaagaccagcctgtgcaatatagccagaatccatctctactaaaagatatataggtgtgtacaaaaattagctgggcatggtggtgctgcacgtctatagtcccagctactggggaagctgggcaggaggattgcttgagcccaggagtttgaggttgcagtgagctatgatcatgccactgtactccagcctgggtgacagtgagaccctgtctctcagacatacttttaaaaaagggtttttttttaatttttttaatttttagagtttctttggagccattctcttgctgttgtgattctcaagtcagtactgtttcttgcttgcagaaatctgtttttttttgttttgttttgttttttaacattttttttgtcccattacaattagccctcaactatttattatttatatattggtttttaggaactgtgcaggcataaaaatgatagctctttgtgttttaacatactagcttctacaaaatgtagagtaagaacggattgttttattttaagcaaaataaccctcaccttcatggttttttgttttatttatgccagaatctattctataacctatgacaggaaatgtcagccaagagtagtgggactgaaggcacatattctaggtgctgtcaccgctttatattgtgcagctgctttcttatacggatttgggacttttgacacttaaattgtgtaggacattaccattttatcttaaacgctttgttgagaaaaaaattatatagctaaactttataaaagatttcagtcaagtgtattttgggggtatagagttacagttattaaaacattgaaaatgaaaagatccaatcatttgaataccacgatgtttcctacacagaacctgttatatattactatatccttggagtggcaaattaatagtgtgccagagtaaagaaatcagtgactttatctgttatctttacattaatgtatcttgaggggtttgttattaagtttatggtaagtccaacatcagaaaattcacatcttactaaataaaatacttaacacatttctaaaagtgctatttgtaaggattagttatttgtatttttctgagacttgaattcatagatttgccttggttcatcagtatattaatgaataatgcctatcctattaacaactccagtacttcaattaaatgttaatttggaaatttttctgcccacttctaaacaggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatac

SEQ ID NO: 35856 - DNA, 11517 bp, Homo sapiens
cctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcctactcatgagttccctcgaacttgggctttttcgagcctccggttccggggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccaccacttgcacacttggtttttagcctcttgaatgtatttcttaaagcttaatcattttgtgtatggtttctgtgtgggaacctccttcctcttcacttatccttgttcatctctgaccttgtagctaactgaaatagggggttattagctcagttttgaaagcacctttgcatttcccttgaaatgattttcctcctacaagtgtgcatggatagatgtatctgaaagacagcgtcagatttttttttttaaaggatagctaggatatttgcagtcttgtgatgtatggaatcccagtcattagcgcatggcattgtcttatctcctattgctgtcacttgaccgctgatgtgggagtgactgaaattagctttagcaaaacttggggcatcactctaaagagtgaggttaactgaagcaccgtcctaaggctaggtgttctggaagcatctgtagccaaaatcaagagtatgggaagttccaagccttcctcctagtaagtaagctaagtattgtgggtaaaaacacttatttacagctaataagatgatctcactgacatgtttttattgctaaagtcttttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacacttactggtcaatgaatactaagttgaggatccagttagatagaagcgaaaaagttctgctagttggagtttaagttgatcttctggggtaagagatcttactcttctattagtaccagagagcaagcttaaacttcagttcatgtacagaaatgcaaagctactagaattggaaataggtttctgatggtctgtctggttttgctcgttatgggaaatcagtgtttctatagtgttagtaccctactctttaactgggaagtcctaacttatttattatatttttattttttagagacaaggtctcaaacttctgagctcaagtgatcctcctgcctcagcctccctagtagctgggattataggtgcaagccactgaccctggctcaagaaatcataacttctaaggtctttaaagctagttagtgaaaagtccagataggcttactaaattactatacagaaagctagcagatgctttgaggaaatccgtttcctagtccgattcatttaccagtctctatcctcctcctcaaattgccagtctgtcctcaaagtaaactgtttagctggcaaggacaagctagtgtcacatcttcctcttgtaaaatcacagcccaataccctggatcagttgtcttttccttaaaaagagggcggaggtaatggttaatttctttcacttgttcttttcagcagttaaggccgtttttgtttttgaagcgaagtgtacttaagccgagtagaagtagaactttaaagaataatgaaatgtaaaccagctggtgctcttgttgggcattcaattgactgaagcttgatttaggatgcctatgtgaaatagttgttaagtgttaaagggagaaaataatgaattggtttctttgttttctgacttcgtgacaccattttgggctgaaaggttgcagtggtgtctagacacagccttgggcagtatccaaggcagtcactgcactgcagcaccagggtggagtctccgaacctctcagagccccactggctggcgtgggtggtgtgggaggcagacagacgggcccttctctgggagtcagccaacatctagaaccaggggttctggtcacacatcccactggtgtttccatttagttggtagaactcatgtgctgccatctgttctttgcactttcattctgagatgtaaaaacgctttttacattcgcagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttggtaggtgtgggttttgaggccagccatcctaagcttgaacttgaaacatggagttcagaaacagctgttttcccgaggtcagagatgctgtaccttttgaaaccattttgtaatgatggtgtcagacacttaatctgactcacagtcctcctcagaaaggattcctagcacttccaaattttgaaatggtcccatttcacaaattttagagctgaaagttcatattgaggtcttttgaaatatacattgttattgctataggtttgtaattagtgtctcttaagcattttgttaatgctcagtgtggataagcctatgtcagtggttagccagtcagatgtctctatgctggactattttgtttctttacatttctattcaagatctttatttttctatctgaataaccgaattactaaagttgaattttctaccccataatcttggtttgggaagcatttttattagaacatgattatagcgtcatgtatataatagatgttaactgtacattcttagatgctgtagatacagcaggtaaacaaggcagccccggcttttatggtgctagaaatctcaaatatgttttacaaattaagaattgctgtgaaaaagtgacaggagatttgagagatgagtgaggtgggagggaaaaaggggtccagggtagaagggaacagaggcaagaaagagcttggcatattgggagagcggagagacctctctggcctgaaagcagtgaatagagaggggttagaaaaagaggctaggggaaaaggtacagctcatccacaaccctggaggcagtattaaagattcaggttgctcagcatgttcagcaaaggcttaagtcaacaataaatatgtacccacttgtattattttacctatactaacacatccattttttttttaagaggatggatcagttctgaaacagtttctttctgaaacagagaaaatgtcccctgaagacagagcaaaatgctttgaaaagaatgaggtaagagaacttacagagcatggcctttaaataactctagagatttttgtgctaattattttcttttttccgcaggccatacaggcagcccatgatgccgtggcacaggaaggccaatgtcgggtaaatgcaaatacaaatcggagccaggctgcctgggtgccatctgtgtttctactgaaattgtgcaggaatctcttactggaacacagcaaatgttatccacccaaggccaaatgacaccagaaagttctacccaaataatgctttgactagacctgttcataaaaaaagttttcttcagaaattgtattggtcattgaagtcttgagtaaattcaaattgacagtattttgtttagatccaaatgagtcttataggtcaggcatagtggctcatgcctgtaatcccaacaatttgggaggccgaggagggtgaatcacttgagcccaggagtttgagaccagcttggccaacatagtgaaaccccgtccctacaaaaaatacagagtagcgaggtctgtagtcccagccacttgggaggctgaggtgggagaattgcttgagccctagaggcagaggttgcagtgagctgagaccatgtcgctgcactccggtctgggtgaccctgtctcaataacagaaacaaatgagtcttatagagtgtacacctctcctagtaagtgagcatttcaaataatcttcacaggctgttggggagaatgaaatgcccaacgaaggacaagttctagaaggcttgaatataccataatctgatgagaacctctgagtcagctgctaaatttaagtcagatctcagtgtcctttttaaaaaaaaaaaaaagttgacaaggtcagcctccatttcccaggctggaatgcagtggtgtgatcttggctcactgcagcaattctctcatctcagcctcccgagtagctgggattacaagtacacaccaccacacctactaatttttatattttttgtagagatggggtttcaccatgttgttcaggctggtcttgaactcttgtgagctcaagtgatctgcctgcctcagcctcccaaagtgctagtattgcaggtgtgagccaccgtgcctagccagatctcagtgtctttataactacaactggctgccactttctagcattgaccttggttgagatagttagcctctctaagcctcaattttctcctcagtaaaaatcctgtagtaatagcatcctcatagagttgttctgacagttaacagtatatttaccttagtgggcttagaatagggcttaatgtaagacatacattaaatattagctataatttctaaaaatcaagtcagttcaagcacatttcacttgaattgcaagataatttttaaaatacagcttacactcattttcaaaaatttcttgactttctttaggtagatgacaaggtgaatttccattttattctgtttaacaacgtggatggccacctctatgaacttggtatgttttactccatttttggaacccagtgtagtttcatgtgttctttcagactgaatttctcttgatatattgtgtgactttatggcacttggcatatcattgtttataaagccacaataacaaagtattctcatgagggcacttaaccccttatcatccccagagcaacttcctcaggcaactgactagcatcccctagtatcatcctttctgggcaaagagtacgtctgaaaaaggatcagtgcctgaatatgaccttacttgtctaaaaagaatctgaacatgttggaataacttctattaactagtttatggcatcaagaaagacgacccaccttgtaagattcattccttttgtattaatggagaaagacttgtaactcttgtctcaagccaagatacgacctacaggcttacaaaggcaaaggaatagtgaaggcaatctacagtcattggagggcagataaaatctcaggcgtctcctcctctcgcctccatcttccctatccccagagactgcatctgacttttgttctgtggccctttccaagggttggggcacaggcccctctattagggtagctgacttgagcttgtgcgatcttgtcaattgtagactagaattgcctgggatggatgcctagggacacttgaacctcatttgcagcctcttgcttcataaccaggcttccttctgtgggtttggcagtggtttttggaagaatctaaaacttccatctaggctaggtaagcacggtagccagaaaacatgcagagaaaattgacatgcctggcttctttgttacagatggacgaatgccttttccggtgaaccatggcgccagttcagaggacaccctgctgaaggtcatctttggaatgcatctcttcttaatgtgcctcacaattctttggctaaattttctattctaaagtgctaacactcttccagtatagccagcatcagttgcctgggttaatagcagtctttagggctgcaagatcctcttagtaactctatctaccttattttattgcaagtggttttaaacagggcttcagagacaccctgagtaatctgtttcatgtgttgtctttagtccacagttagaattagcctgaaagctgttgctttgcttcctggtgggattaaggtgaccattgtcctcccatcagattacatcatagctaaagactcacaaaacagcagcctttcataatccctctaagacaacgggatttgggtcagtcttggaggtagtgtactatagattctagttaggtggttaaatttaggagtttttccttcccacatggtctactgttacaagaacaaaataagcagatttaaaatccacctgacaaaaactgttaatatccaggatcactttgtaaccatcctggacagaaaagtgattctgggcaaaggttggtagacgaccctaggcctcttcactaaaaaatgagcctctagagttgaatcaatttgctattataaaggaaaattgcttaattatgatacacaaaatactgtttttagcttgctgtgctgaagaaaaatatacaaactgctattaagatataactatacttaatttgagtagtaatagtataaaatctttgcagaacttactgtgtgcagaccaggactcagcaagcattttctataaagagccaaacaaaatattttaggctttgtatggcatatggctctgttgcaagtattcagttctgctgttacaactcagcagcccatagacactctctaaatgaatgtatgtagctgttttccaccagcacaggctgggttgggcccacatgctgcagtttactgacccctcttcttaggtgctgttctaggtgatctacgtcttttatagaaatcctttaatgacacagtgaggtaggtattatccccatctcagagctgacaaaactcaagagtttaaggcctgaggtcaaggacttacatggcaaactgtgattcaaacctagatagtctggcaaggtgcagtggctcatgcctataatcccagcacttgggaggctgacgcgggaggattgcttgagctcaggagttcaagaccagcctgggcaaaatggtgaaaccccatctctactaaaaatataaaaattagccagacctggtggtgcattcctgtagtcccagctgcttgggaggctgaggcacaagaatcacttgttacctgggaggtggaggttgcagtgagccgagattgcaccactgtactccagtctgggcaacagagcaagactctgtctcagaagaaaaaaaagaaaagttagtccgcatctagagtctgtgttcttagccattgtacaataccaatatgacctttctttagaaaagacctctctttggaacttcacagacctgatagccctaagatgctagtggaccacattatgccactcttaatagggaaggttgatttctctcatctgtcagacacacctgagatcagttaaagctaattcttggtattcaagaggtatgtgggaatagtaatatggaatgaagaatagacctggagagccaggatgggatggaagggtttcatgagagtcagaatttacttggtgagaataagaaaacaggcagaatttctggtctttgatccatttggaggaaagagaccctggtccttcctagtaaagcttttaaggtacatgctaactcatctaacactgcactaataccataaaaatgtgtcccacataggatacaagtgtcacatgagtagaatttataaggtgtggggaaggtaaaatttttgtatagagatggggcggggagggactcactatgttgcccaggctggtctttaactcttgggctcaagtgatcttcctgcctcagcttcccagagtgctgggattataggcgtgagccacagtacctggctaaaactttttttttttttttttttttaacttttctaattagaaccttatttaaaattaaaagagtttctaaattaaaccagcattttagttaaaattcttaccctaagtaaggctggttctatatggttaaggatgttttaggttgtctaaatgtcacactaaattattaaactggttagaatatacatgcacttaacccaaatatcttaagcttgaatgaattaggtccctgcacgttagctctatagaagatggttattctctttaaaggtacatctttaatagtgaaatcaatattgtatgtcctatagtaaggtcaattcagggaagacaggtctggaatactgatatattaaaaaacttggtagaggataaaatgttgatgtcaatccagatactctttggttgctttttttgagaaagggtctcgctgtgtcattcaggctggagtgcagtggtgcaatcatggcttactgtagccttgaagtccttgctcaagcaatcctcccacctaagtcttctgagtagccaggactagaagcgcacaccaccatgcccagctaatttttaaatttttagtagagattttgcccaggctggtcttgaactcctgagctcaagtcatccgctgcctcagcttcccaaagtgctgagattgcaggcctgagctgtgtctggcccaaactcattgagttggtgatttctaaattttaggagtgatgtttcattaccattctgtatcatagagcattccttttctccttcagggtcttatactatggtttacagagctatctttccactgggcttttttacagattgaacagagtaatatttttgatcccaaaacaattatatcctagaagttggtaaataacactgggatcagtttcctgttaccagtctttgtcatctagatcttagaagtagtaacgcatgtcacttcaccatcaatctctaaggttccatgcttgtctgtacctagaatatcaggtaaacgttaaggctgtttttttttttgtttgtttgtttgttttctgagacggagtctcgctctgtcgcccaggctggagtgtagtggcgcgatctcgcctcactgcaagctccgcctcctgggttcacgccattctcctgccttagcctctcagagtagctgtgactgcagatgcccgccatcatgcccggctaattttttttgtatttttagtagagacgtggtttcaccatgttggccaggatggtctctatctcccagcctcgtgatccgcctgcctcagcctcccaaagtgctgggattacaggcgtgagccactgcgcccggccacgttaaggctgttttttaaaatgtttatttgaaagacaattttctttattccaggaatttctgagttacaacttttcacttatgccaccttatggaagaaagatcaatttccaatctttagatttgaggaaaataacgttcatagttgtgtttttgttgttgggtttttttgtttttgttttttttaacttttccaaaaccaggtacaaagtgagagaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagat

SEQ ID NO: 35857 - DNA, 17153 bp, Homo sapiens
agaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgctcccactgccccgacactcccgactccaggcccaatgactgaaccttctctccaggctgggaaccactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggggataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcggtgaatatacagaagtgcctaagaaactactcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcctgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcacgaggtcaggagatcgagaccatcctggctaacacggtgaaaccccgtctctactaaaaatacaaaaaatttagccaggcgtggtggcgggtgcctgtagtcccagctactcgggaggctgaggcaggagaatggtgtgaacccagcaggcagagcttgcagtgagccgagatcacaccactgcactccggcctgggcgacagagtgagactccgtctcaaaaaaaaaaaaaaaaaaaaaaagaactccttgcctggagtggtgggggactaggagtgaaagtgacatcattttcttctctgctcttcttcagacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagaggtgagtgagtcaggccaacttaaagggtgcaggcctggcctcagatccccaggaacagcattgttttccatcctaaagtcccatcttattacctgtggtagcatgaggagagaagccaaagcagtccatttgaatactcatctgcacagtgacaagggaaccgtccactgccctgtagtgtcattcttcaaagtcaggggatcaggaccctcccagccaaactcatttcccactaccctgcaacctgtaccccctactccagttgaggttgcgttgggtgacctctctgttgttctaggagagagaaggtgctgctgcctctttcttctgaagcttcaccatggaggaggtagagaacagtggttaggaggagcacagctgtcagggccaggcacagtggctcacacctgtcttcccagcactttgggaggctgaggcgggcacagtggctaacatcgtcatcccagcactttgggaggctgaggcgagcagatcgtttgagtccagcctggattcaaacaatctgcccgcccaggagtttgagaccagcctgggcgacatggtgagaccctgtctctgcaaaaagtacaaaaattagccaggcatggtggcacctgcctgtagtcccagctactcgggaggctgaggcaggaggatcacttgaatgcaggaggtggagattgcagtgaaccaagattgcaccactgcactctagcctaggtgacagggtgacccccctacctcaaaacaaaacaaaaaaaaccccacagattttagaggtagagttgaatttgaatccaaaccctgacagttagtacctgtgggacttgggcgagtgacttcattttgctgtgcctcgttttcttcatttgttaaacgtgatgaacggattgggaagcgggcagtataaagctcctagagcagtgcctggtacgtagtgaatgcagacgaagtcagtttggtggtggtggtggcgcctccgtgccaggagagacctctccttatcctctgtagctgtaaactctccctcatgattcatggcatgggccaggtctcagccttctccaattccactgaccttccagcacctgcatttccttaaaatcctgtatactcagtcagctccgtggatggggaaactcagaacatccctggaggcagggcagtgaagagtttcttgtctgggaaaggggaaaagcgtactgttcccccaactccaccttgaatattttctgaccttcacatcgctaaactcacgaaacgtgattattttgggggtgactgtaacacattattttttccagtgtcagtgacaacataggaaaatatgttttgtttatatgttgactttccctaaattttctttgttcccacaagaaaccattttttggtctcattattctgatttcatctctagaattatttcgttcagccctgtccagtagtatttgcagtggatccaggtgtggtggtttaatgtctccacttaggttgtagcctctttgaaggttccttacatcgtcctttgtctccattatgttgtgtaaagaaattttttgttctcctgtaacactttattgtgtttattaatattatattgccagcctccttgacttgttttgtttttttgagatggggtcttgctctgtcacccaggctgaagcacggtggcacacttatggcccagtgcaggctcagactcctggtatcaagcagtcctcctgcctcagcctcctgagtagctgggaatacaggtgcatgccaccatgcctggctagttcttttttattttttgagagatggggtctcactgtgttgcccagactggtctcaaattcctggcctcaagcattctcctgcctcagccttccaggtagctggcactaccggcgtgagccaccacacccagctcctccttgatttctttgggaaagactgtaatctttatttttttatccctagcacctaacaaaatcttggcacatggtagacactcaataaatatgttgaaatacatagtggatgctcaataaattcttggttacttgatcagactgagcttttccatggtaacttctgtcctctcctagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggtatccaggatgcagtgagagcgattcataagccccaagtgatgcaaggggtttggcggggagatggtccctggtgaagaaatggaaataatcattgattcttaagaactgtcccccacactctttccccatagaggtatgcgtttgatcccacatcccaggagaacccactcttgctctgggcactgtgggacagggcttgcagtggtcatgctgtaccggtctgtgggggataccagcgtagtacattcttggggaaaagtaggggcatttggagacagaaagacctgggttccaatcccagccataccctaggcaaattaatttctcccagctatatgtaagatggggataatagtgcctaccttacaagatggttagcgttacataaaataatttgtttagaaatacttagcgcaatgatctgcatatagtaagctttcgtgatattttcataaatggtagctgttattatggactaatagctccatttgcaaactgcacttctaccactcccccagctagggccagcttctttgttcatcatagccactgtcacaggagcacactcaggaagtaagtcgcactccttaattccctggtttgtttcctttccttaccacactatttttggttgttgtttggttgggggtttttttgagattgggtcttgctttgttgcccatgctggagggcagtggtgtgatcacagttcacttgacctccccggcttaagtgatccttccacctcagcttcttgggtagctgggactacaggcatgtgccaccacgcccagctaatctttgcattttttttgtagagacaggatttcaccttcttgccaagctggtctccaacccctgggctcaagtgatttcctgggctcagcctcccaaagtgttagggttacaggcatgagccactgcgcctggcccactgttttgtttttactggagatggggtcttgctatgttaaccaagctggtcttgaactcctgggctcaggtagtcctcccgcctcagcctctcatgtagctgggattacaggcacgtgccactgtacttggctgtttgtttttgagatataattcacccctttaaagtgtactacaggccaggtatggtggctcacgcctgtaatcccagcaccttgggaggccaaggcaggcagatcatgaggtcagacaatcaagaccatcctggccaacatggtgaaaccctgtctttactaaaaatacaaaaaattagccgggcgtggtggtgtgtgcctgtagacccagctactcagaaggctgaggcaggggaattgcttgaaccagggaggcggaggttgtggtgagccgggattgtgccactgcactccagcctggtgacagagcgagactccgtcaaacaaataaataaagtatactacaattgagtgggttttagtatattcccaaagttgtatatccacccctaattccagaacattttcatcaccccacaaagaaacaccatacgtattagtagtcacttttcattttccccttacccagcccctggccgctactaatctgccctgtctctattgaggatttacttactctggacatttcatgtaaatggaattacacaccgtgtgcccttggtttctggcttttttcacttagcatcatgttttcaaggttgacccatgttgtagtgtgtgtcagtacttccttcctttttaaggctgagtaatattccctcgtgtggatgtgccacattttgtttatctgttcatcagctgacgggcacctgggttgtttctactctttggttatgaataatgcttctgtgaacattcgtgtacatgcttttatgtgagcctaagtttccagttctcttggcttgcatacctaggataggaattgctggctcaaatgacaactccatgtttatccttttgaggaactgccacttgattctcttttggcttcctccccaggcacagaagatctctgatgatctgatgcagaagatcagtactcagaaccgccgggccctagaccttgtagccgcaaagtgttactattatcacgcccgggtctatgagttcctggacaagctggatgtggtgcgcaggtacaggcagccaagcatctcacttggggtccgtggggtcagagacttggtcagtcacaagcacacagctgtggatctgcagagggcgaagaacctgtagatgtaagcagggaagaggggcagtggttcccatgccctgcgccacgtgaggggtgtgggagagagactggtgctagatgaagaagtgggtcactgctgggctgtaaagaactgtccccaggttcttcccttcaccccacatcaaggtaggactgagggtgggttaggggtggagggacaggctagaaaacattttacttctttgctcaaaacctgcagtggcttcccgtctcaaggaaagacaaagtccttacaatacctcataaggcctgacgtgatctgctccattttgacctcccagacttcacctcctcctgctcctcagccccactggcctgcctttcctctggtgtgcccggcacactcttcttcagagcctttgcactggctgcccctctgtccagaacactcttctctccgcctccttcaagccttcccttaactgatcccttctcagtgagtcctgccttggccaagctattgaaaagttcaactcatctttctcacgtcctgcattccccattgcagttcccctggcctcacaggcctcccatcttctgtcacactgcaggctgtgcttctttctcatgaccattgcctcccccactgcactgcattccctaagggcagggttttgtccctttgtcgcacccagaatagtgctgtacaccttaggcactcgatagttaacagtattcagcaaataaccagaaaagcaatttgtataacttttttaaggaattgagaaagagcgaagagttaaaggcagttcagagagttgtgatttgaaggctttgacatctttctttccttcttgaagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacaggtgagcagaggggcccaacccataaatcagaaggtgtctcaggcctgcctggtgcaaattttccaaggggtggtgcataagaggcccatttggcaccctggcttgtcggtggggagttggatgaccctactctgttgaccaactctcctctcctccactcccagggcgaatcaaagccatccagctggagtactcagaggcccggagaacgatgaccaacgcccttcgcaaggcccctcagcacacagctgtcggcttcaaacagacggtgagccacaactaccatcatccctttgcctcttttttttttttttttttaaatggtgtcttgctatgttacctgggctggtcttgaactcctgggttcaagaagtcctcccacctcagcttcccaaagtgctgggatcacaggtatgagccaccatgcctggcccctttgcctgttactcattccctaccacttcagttctcttctctatgctaggggctaggaaaggcatccttaaccttcctatccagaaggacttcaacttttattattattttttgtgtgtgtggagacaggcatatcactgttgctcaggtgagaactcctgggctcaagcaatccttcggcctctgcctccctaagtgctgagattgcaggtgcgagctgccatgtctgcaaaaggttgcttcacatctatttgtgggtgtcaatgaagcagacactacctgcacctctggcagtggatattcagagtgtttctggcagataggtttagaatattcctgattccccagcgctcctgacagtcattccaggcttggacctagattgtgttgatacaaaccccaggtttttatctagtccttcatgttcacatttggaaactgtattgtctgtggccaaggaacccagaaaatctctgcaaggctgagtggctcaagtaaacataaaacttggccacttaagagctgtcagtcagcaagtatttaagcatcaaccttggtattaggcactgtaagggataggaagggaggataataagtgatctttctttcttttctttcgttttttgttttctgagacagagtctccctctgtcactcaggctggagtgcaatggcacgatcttttctcactgcaacctctgcctcccgagttcaagtgattctcctgcctcagcttcctcagtagctgggcaggcgcctgccaccacatccaactaatttttttgtttgtttttttggttcttttttttgaaacggagtcttgctctgtctcccaggctggagacagaggtgccatcttggctcactgcaacccctgtctttggggttcaagggattctcctgcctcagcctcccgagtaactgggattacaggcgcctgccaccacgcccagctaattttttgtatttttagtagagatggggtttcaccatgttggccaggctggtctcgaactcctgacctcaagtgatccacccacctcagcctcccaaagtcctgggattacaggcgtgagccaccgctccaggccaggtatttcttattattagagtatttcaaagagataaagaatgttgtgtcagaaagcttgagggtgtatgtgaagtcacagagcccagtagccaggatgtagacccagtcttcccaaattcaaacctctgctcctaccttcacacaacatccacctccatggtgtcttgacagggaacgggagacgtgtgttgattaggtcaatgtagtaggagattcattttatttctgttcagaagttcagagaaagtcagatttgtttttgatcaaataatgaaagagaaagggtcttaaagaaaaagttggctaggtacagggctcacacctgtaatcctagcactttgggaggctgtggcaagaggattgcttgagaccaacctgagcaacatatggagacaccgcctctgcaaaaattaaaaacctagctgggcgtgatggcatgcacctgtagtcccagctacttgggaggctgaggtgcaaggatcacttgggcccaggaagtcgaggctgcagtgagccatgatcgtgccactgcactgcagcctgggcgacagagcaagactctgtctcaaaaaaaaacaaacattaaaattgaactggtctttgaaagatgggtaggattttcacaaggagtaaaggcttttcagacacacagggtgcgtgagcaaaatgttagattgcttacaatatgagagacactaaagtttcttttgaaaatcactaaaaatactagtaattaacatatataaaatgtgtcatgtaccatgagagaggctttcaggcatttaaatctcagtggcaggaaggcgtagagagctggaagagaggtctcgggctgttggtgagggagcgcagggagagagagggcgggagtgaaggcatgtttgggagaaggcctgcaaccagccctctgccctctgccctcacacacctttgccgtacccctgtcaccacccagcttacagaatcacctggggctctgatgaagctgtagattccgattcagagagtctgtgttcctaacaggccttgggtgatgccagtgctgctggtggcacagagcgctctgaggagggcggtgctggctcatcctgttcaaagcggaggtcagctagcattcattcctgcagccaccttgtctcttgtaaacttgaatgtctctctccgcccattttcaccctccctgtctttacttaacaccagcttcactacctgtgttttccatcacactccttcctctctcttctagccttggcccatcacctgtttgcttcagtctccgggaagaaaacccccagccctgctgcttcctctctcaggcggccgttcctgtctcccctggctccctccccaacagtgcactggccagccccttccctccagtgttctctctgctccttctcaccacctgggcctcagcagagcactctgagagcttctctgtcgatagtaaaaccctcattctctccttgagtgaccttgtttgctttcccagcttcagcgctcgcctgcatgatgctcttcagcctgtacattactaactccgttactctgctggcactgccaccgcaaggtcccacagacttggcggcttaaacaaccgaaattgatttcatcacaattctggaggctctaagtccaacagcaaagtgtgacacgattggtttcttctgagggcctctctcgtctgcttgtcgatggccgtctcctggtgttttcacatggtcttccctctgtgcgtgtctgtgtcctgcttttgtcttagaaggacaatagtcatgtaggattagggtccacccatatgacctcactttaccataattacctctttaaaggccctgtgtccaaatagagtcccattctgaggtactggggtttaggtctctaacatgaacttgagggggatgcagtttagcccataacactaactctgacccctctcacgagcatcaggcctgcagatccagctccccctcccactccccatgtctctctctacagcgtgtcccaaagagatccctcctggcccccttaccattccttcctcctgctttcccgatccagatcagggccttgggatcatctctgactctcccccatcctccttcccatcacttggtcgtctgttgaattgtctgcacatcttctgtgtttgcctgttccttcatattgccagtgccatggtttgagccactaacattcccagacacttctgcctggtcatcttcctctccagcagcccagcttacattcacttgccttactaagcagagctccagctctgtccttcccttgcctgggaagcttccattgctccccactgctgtagggtatcataacggtcttgtgaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgcggtcccaactgtctctttcctaacagctccccaggcacccacacttttctgcctctttttcaatctgtacccttgaccctcctcctttttctgctttgtcagactccttaaggcacttcataaattaaccatttccagggatttcccctcacacatgagttattccagtggacagggcagcctcatgggtgcctgtggagggtgaagggtctgcctggccgtaggtgtgatcacacactcccgttgtaacccctgtctcctgtgacacttgctgccccacgatttagctgctttgtgttccgtgcctcctgtttgctggtgaactcctgagttggggggcgtcattccctccactgtagttcttccgcgatgctgactccacccacggtcagcaccactcggaaatacttcacagtcctgtagaggaagacaggtccaggtttccagttacccttctatgtctggatactctgctcattcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgcggggtggccaggtgaaatgcagctgacggctctgcgaccaaatgtgaccaaagggccacattcccagcacccggctccaaaggcagagcttggattctatgcccagcacaggttttcagggcttcctcctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtaaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacgcctggcagcagcacacccctccctccacactcatggattcctcagagaagactggcttaatttgtggcccacgtcccagccaatctctgtaaaatcactgagctgcagcacagggggcccagaatggggaggggacttggccatagttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtg

SEQ ID NO: 35858 - DNA, 24004 bp, Homo sapiens
attcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacgggtgagtgaggagggctggagacgggatgggggtgggggagccgcctggagactgggggcgcggctggggtctggaggggaccagggcttaagtttgagggtggagtttgtaaggaatagagctgcagttgggggccctggctagagttgggggcccgcgctggagtagggagggcaccgtggcgggtgaggaggggccctggcgtttgagatcagtggggagacatgtgtccggtggggagaggacacggagctggagaagtctgggcaggggtctccgggccaagggagaggagagcgcgtgaatggagagctgagggtctctggctgaagtctgtgggctgctgggacctggggcgggtgggggcgcagagggggcgcagaggccgggaagggcttttgggggctccaggagacctcgggatccgtaggggccattgtgcggcgagagaacgggtagaagccgaatgagctacgtgtagtaggaggaaagtcaaagactgagggggtcggaaggttaaatgggggccagcctcatcctcccctcccccctcaactcagaccggggaaagacccgagagaggacggcggctccctctcctttctcctctgtctcctactcctccctccgcccccaatctctgttcaggcgaggggatccgagaactgggggcgagtgcggggaccctggcactggggccctggggctgggggcgaactcagccaagggcgggtgctgggatgtgtcgggaggggtgtgtgcgcgcgtgaaggggggtgggcggtttccctcttcctctggctcttgggaggaagagaaaagctggtttcctgtagctggtcggctggagctgtgctgagaccgggacttctggggctggggtcggaagctggggagacgggggctccgtggggccaagaacgtcagaatgaaggactcaggaccctggaaatctcaaaggaggatccttattcccaactcagcacagtgataagcagacccggaccccgagtgcctagaaaatggggtactgacaggcttgggaaacaggagttagagtggaagcaacattagaaccaagggtgtctgtttaaatgtgggatggcggggagattgggaagcaagagaggtaggtggttgctcctgggctaggccatagatgccagattcctggtcctccacaatgactggtgtaatcctttttcttctacatctctgagctgggagcttcctactgctcacccccaccccaaccccaggatctcagggtttgaggggaattctgtcagaagcgacctgtttttacacatgagacagttaactgatctctactcagtccctatagtttttggagaaaaggggttaatctagctaatacaactggggagaaaggcaaattctcctttgtctggaggacttggggatgggagaaaagaaaaatgattaggccccgactgttgttctgggctattcaaggtccccacccaacccccaccccacccccctggccttttgcccaaaccccattgcatcatcaccctggcctggagcctctgccaggcctggtctcccccaggttccctcaaacttcttatcacagccctaatggagtagaaaagagggaaggaggaaggggatgaggtctcctcccgcagatcagagtatctagttgtctggcatttaaccttctctttactcccccctcccctaaatttccctttaaaacactcctctaaaacatctggacttcacacattcctggtcccctaggtgtctgtctggcccctggcctgatcctgtagtccctaaagtcctcttctaaaacaggacctagctctctcatcccttccccctccccttctgctcatctcccctcccaagagaacccaggtgtccagcttgcactccttccctctcatttcctatttacaataccctcttacagtggaacattctacctccccagtgacctcctcccaccacagctaggccttcaccccctttcccacaacacaagacaaacacagcccctcacctacagccattgccaaagagggagagcctcagtgttcttgttcttcctgcatcacctcttgtggtgaacaccaaaatagtattaaaggacagggcgagcaccaaagcagttagatggtaggaaagggcaaagctttcagtcagacagaggtaggtgtgagtccccactacttactagttttttgcgtggtaccctagtacctagggagaggtatttaagctcttggagcctggtcttcccgtgaaaatcagacacctgactaacggagttctgaggactaaatgagaaaacatatacaaaaggaacctggtccacagagagtgatcaatacatgggcggcatggtttttatggggtagctgtttctgtttctggttctctccttcctggctaccgcctagttccctcatttcttacttgctttgagtatttgcttatactagtgatagtaacaatagtctgtcatattcctttagcactttcatatcgatttttccattggattgtaacaaaaatccttgtgttaaagcaaaggaagcattattgccccatttttagatatacaaaaactgaggctggccaggtgcagtggctcacgcctgtaatgccagcactttgggaggcggaggtgggtggatcacctgaggtcaggagttcgagaccagcctggccaacatggtgaaaccccatctctactaaaaataaaaaaattagccgagcgtgctggcacgcacctgtaatcccagctactcgggaaactgaggcaggagaatcccttgaacctgggaggcagagattgcagtgagctgagatcacatctgtactgagcgaccccagactgggcgacagagtgagactccatctcaaaaaaacaacaacaaacaaacaaaaaataaaaacaactgaggcttcaggagtcatagaaattttgaaccagaagttagtttaggaaacattcaagggaaatccatcattttatgccagagaatccaaagcttgaagagaggcagtgacttggcccaggacacttgaaagcttgagaggcaggccagtctcagctcagctccttgttcccttctgcaactgccacaagtggagacagctgttcttccccagccaatcatacatatcccttgtgaatgcactaggggaccccaaaccaggtgtcctcctctggcctggcccatgctgctgtaggacctgtaggagctgggcgctggtccacttgctgctctccacccctgaccttgtcaggccaacagagtcaaacagtaacccagtattgaactgggacttggttaatcaaaagctggggagatagcagatatgagaggagggaataagttggcaatggggtagactagaatgctgtcgtagaaatcaggattcctgatttctgcttcatattctgggagggattatgagtgacctaagcccattacttaactcctctgagatagttttcccatctgcagaatgagaacatgggacgaggtgagcagctttgaactttttcttagggagtgtcagaacgaggccagtctgcctttatgccatgtggcctcaggcacctacagtgaagtcttaaaaccagtggatgctctctacagtgccttctagctgtggtagtctgtgtctccaaggaccaacccttccatttctgaggcttcagaataaattctggcagttatttcttctctcagactctatttcagaaaagtgtacctgccaacctgcatttagtaagaaataatgaattccttttctcattctttttatttttattttttatttttttgagacggagtttcgctcttgttgcccagtctgggatgcaatggcgcaatctcggctcaccgcaacccccacctccctggttcaagcgattctcctgcctcagcctcctgagtagctggaattacaggcatgtgccaccacgcccagctaattttgtatttttagtagagacggggtttcgccatgttggtcaagctggtctcaaactcccgacctcaggtgatctgcctgtctcagcctcccaaagtgctgggattacaagcgtgagccaccacgcctggccgttgttgttgttgttgttgttgagaaggagtctcgctctgtctctggactggagtgtagtggcgtgatctcggctccctgcaagctccgcctcccaggttcatgccattctcctgcctcagcctccctagtaggtgggactacaagcgcccgccaccacgcccggataatttttttgtatttttagtagagacggagtttcaccatgttagccaggatggtctcgatctcctgacctcgtgatctgcccgtctcggcctcccaaagtgctgggattacaggcgtgagccaccgcacctggcgcttttctcattttttattaaccaaaaacatctatagctgccaatcagagtttctgaccagcatgagataaccaggttcccacataagttgatataattccagccaaaagcaaatacacttgaggttttaattagcctaggccaccttatctggtaaatgcatgatttccgttaggctttctgaaatattgaaaatagcacacggaccctccattgttaccttcttagacccctaaaagtgcccaactgctgcaggatttaggaagcaggaaaaagatgtgggaaaataaggacaaactagcttgcatgccatccatggcaccagtcacctcacttggcgtgttggcaggggaggcactatttattggattgactttaggttgctgggatggaagggccactgcctgtccaggaataagccatgggtagtgtgccgggaggaaaggaggcctaggtctgtgtcccttgcctgcatgccaggtatcctgaaccatcgcacagccggaatggatatgcccctggcttgtgggctttacaagctttgtaaactctctgtcttgcaaccctgctaaactccaggctacttcctcaggccaccccaggagtgtcaggctcagctcctctccaagagcagtgggtgttggagaaattggcagcaggaatagggtcccttggccttagccctgtgctccaggaaactttgagagaacctcttcttcacccagaggaagagggagagggtattgcccaagtccacagttagtgcctgaaccagaactcttggctcctggtccagtgctcctttcactgcttcctgtacctctgctgttctggtctagttcaggttggtggccctttctgctttctagagcctgaaggcagcaaccaagttctctgggggctgcccctgctgagagaggggtctccttctctcacatcacccagccctagggcggtgcagccagaccccacaagtggatgtcatgcctaagtgagaagggtggggcctggcacggaggtgggggtgtgggagacaaacggagaagtgagaggttggaaacagacaggaagccacaggcagtaaacatttcctgtccccagagtaacggagactggcacctcccctccccacccctcctaacttcaggagctctccctcttcagcctacccatctcctattcctctggaccctgccttctctcccctccattctcaccactggccctcacagacccctcctcactctcctcttccgtcccctcggacctgtcctctctgctgcttccatcccctatacctcctgggccactcctccccgcctcagtatacctggtcttcttggaaaatacccccagctcttgtgacctctaccataatccttcactttgggccttcttgcctagtgagaaagctgaggaaggtattcaaatatcagggaaagggtaggtattggacgggttgaaagctgaaagtgaacagaaaccaatagagatggagaaatgtaaaatctgagatagagagataggattcaaaaaccaaaaccaagagagcaagcagtcataggggcagagggacagagggattgagaagcagtgccagaggcagacacagagcagagcagaggccaaggctggcaggagcactggtccagaggctgggtcgagttgcccaggctgccagatacaagtcctggcaggagacccttaggggaaaccaagagagccaagagcggtgtggaggtcttggaggcaagagacctagggatgaatgaggcagagctgacggcaggaggactgcccaggcccttagctatgaccaccccattacacagggcaaacttcccctcatatcagggggaacagaagcactgtgtccagaactgggaccccggtagagcagactctgaattcagtcagctgggggtggtctatgggaaaggggttcaagggctgaaacacagacccagccaggaaggggaggcccacaccagggccggggtgagggcaggcccaggcccagtggaacaatctgttttcactgtcctccagctcctctctccactcctgctgcctgatttccaagactcacattttcctcctacacgccccaaggctgggtggctgggcagccggatgcctgggtcttggcccagggaggggatttggcttgggaggagagtatataggctagatgagagaccctgaggctccacaggaccttggcgctccagaagctatacatctaatctcagcaggtacgtagaggagagggagaagccaggggtacaggctctggcccctcttccccttctagaaattgactgtggttcctcctctctttatgaacaggataaggtaggagaggacagagaatggcgggaggaggggagggttgtgttagtgacagcggcacatggggaccgcctgactccagcctgtgcctctggcatctgtggcatcttctgagatataaatacaacgcagggggcatctactccacccccagccagccccagcctagaggcctgggtccttcctgcctccagacaccaatgaaaagctaggagccatcctcaactgcctcgcttttcccccccacagggtcagtgtgctggtgggagcacccaaggctaataccagccagccaggagtgctgcagggtggtgctgtctacctctgtccttggggtgccagccccacacagtgcacccccattgaatttgacagcaaaggtaggccagtgaaattcagggagggactggggggtgggactgcagcctgggggcaaggcctgggtggggcctggggcgaggggtggagcctgctggaaccccggccacgtgacctctcagcaccagctctggtgctccaactgcttacagtggatccccatggcactcactccactctcccatccagcccagcccaaggaggacgggcatgattcagaaacatgtggctctcatttcccctgaatcacccacaattctgggaggccagggccgtaacacagacaaagacagggaatgttgcacaaactattcagttcctttaactaagtactgactaagtgacagtgcatgacaggcactgtgctggtgctgcagggactgaaagatgactaagccactgccctcaaggagctcaaggtctgagtagacacagatggatgggaggaagatggagactaacagctatcagttgctctgtgccaggcccagttgtgaacactttacatatattagttcacttaatcttttcaacaactgtataaggtattattatccccattttctaagtgaggagacagagggtaagtagcttatccaaggttatacagctagcaaacattggagagaggatatgaactagggccatctgtctccagaaataaaaactggacaggctgggcacggtggcatgtgcctgtaatcccagcactttgggaggccgaggcaggaggatcacttggtcccaggagttcaagaccatcctggccaacatagtgagaccctgtctctaccaaaaacattagacagagctgggtgtggtggctcatgcttgtaatcccagcactttgggaggccaaggcaggtggatcacctgaggccaggagtttgagaccagactggccatcatggcaaaaccccgtctctactgaaaatacaaaaattagccgggcatggtggcacttgcctgtaatcccagctacttgggaagctgaggcacaagaattgcttgaactcaggaggcagagattgcagtgagctgaaatcatgtcactgcactccagcgtgggctacagagaaagactctgtctcaagaaaaaaaaaaaaaaaattagccaggcatagtggtgagcacttgtagtcccagctactcgggaggttgaggtgggagaatcacttgagtgattctccgtcactgcagccaaggctgcaatgagtgctacttgccccactgccctgtagcctgagtgacagagcaagaccctgtttaaaaaaaaaaaaaaattaaaataaacctggtcaacatggcaaaaccccatctgtacaaaaaacacaaaaattagttgggtatagtttccacccacttggggggctgatgtgggaggatcacttgcacccaggaggtcaaggttgcagtgagccataatcacgccactgcactccagcctgggcaacagagtgagaccctatctcaaaaaaaaaaaaaaaaggaggtggaacaagatggtgttagagacacagtccaagtatagacaaagaagtgcagccaaagggttactctcttgggaaatagccactgttccccaccatcctcctgcccctgctccacagcaggcatccttgtctcagttgggtgagaaagcaggaaccttggggaggcaactctagaaagcccaggttctacgcgggcgcagtggctcacgcttgtaatcccagcactttgggaggctgaggcgggcaggtcatgaggtcaggagttcgagatcagcctgaccaacatgatgaaaccccgtctctactaaaaatacaaaaattagccaggtgtggtgacgcgcacctgtaatcccagctactgaggaggctgaggcaggagaatcccttgaaccagggaggcggaggttgcactgagccgagatcatgctactgcactccagcctgggtgacagagtgagactccatctcaaaaaaaaaagaaagcccaggttctgtgtgcgtgtgcgtgcgtgtgtatgtatgtgtgtgtgtgtatgtgtatgtgtgtagtggagagataagtcaggctacacaaacagactacacaaagcagaattaagctccttaccaattccacactcccagcgagtcatggagtctcagggcttggaagcgtttgttgggtatccccaggctgagggtaggggctgccctagagctcaaatgtccatggctcagtaagactcccccttctcacttccacaaggctctcggctcctggagtcctcactgtccagctcagagggagaggagcctgtggagtacaagtccttgcagtggttcggggcaacagttcgagcccatggctcctccatcttggtgaggggccagcaagctcagtggtgtggtggccaggggatgggcagtggttgggtaaggccgggcctggagggagggaggaagggccttattggactgaatctgaaggcccctcctcctgggccctcccaggcatgcgctccactgtacagctggcgcacagagaaggagccactgagcgaccccgtgggcacctgctacctctccacagataacttcacccgaattctggagtatgcaccctgccgctcaggtaggggcaagagggggcctgtgccccatgtctgccttctcatatacttgaagtgtctcacatacttagggttgactcgcacctaccatgtgcccccatgaggttctaggttgcttaagataaaggctaacccagttcgttagcctttatgcttactgtctggtccaggaaggccctttctctggttctctctcccacctccttccctatgccctctcttctttcctggatgacccatctatgcagggctcattttcaccaccttctcccctcacagatttcagctgggcagcaggacagggttactgccaaggaggcttcagtgccgagttcaccaaggtgagagagtggtctgggagagaaggggccgtgggtggtggacatggggggattgggaccagatgttggactcccctcctttcacccacagactggccgtgtggttttaggtggaccaggaagctatttctggcaaggtaagtcctgtctctgccattcttttttttttttttttttttttttgagacgaagtctcactctgtcacccaggctggagtgcagtggcacaacctctgctgcccaggttcaagcgattctcctgcctcagcctcccaagtagctgggattacaggcgcctgccaccgcgcctggctaatttttgtaattttagtagagaaggggtttcaccatcttggccaggctggtcttggactcctgacctcgtgatccacccctcttggcctctcaaagtgctgggattataggcatgagccgccgcgccctgcctgtttctgccattctttaagtcccctggcacatagcctcccaccctactcccaattctcctcttcctttcctgaagcttacatgccaccaccctccccatgcttccctttcttgaaccagacttctgaaatactacccagtcagcccccagagtcccaagccccctctgccacttcctctccatctactccctcttcatactctctccaggccagatcctgtctgccactcaggagcagattgcagaatcttattaccccgagtacctgatcaacctggttcaggggcagctgcagactcgccaggccagttccatctatgatgacagctacctaggtgagcaagcaagtggggaagggatggcagagggagaacctcaagtgctcctgtccccactcaccccctcgcctcccctctcctactcaggcatccccagcacccctgccatacttgtcatgtgcctgctgactatgaaggcccagtaggggtggggaagggattggtggataggccagagcagaggggtcctcaaagcaggaatcctaacatccacccaccctgtcccccaggatactctgtggctgttggtgaattcagtggtgatgacacagaaggtgagtgtgtccccaggctggggccaagggagggggatggttagaggcacagggccagagagcccatgaacttggccacttaccattatctgcttccctttccccacccttaggtcacaactttctcttctctttgcagactttgttgctggtgtgcccaaagggaacctcacttacggctatgtaagacccagcctgacccctcacttcctctcctcccctgcctaatcacaaagaaccgtgcatggcagtttgcaagggctcaaaaaggtggatcagaacatgggctctggaggcagactggcattcaagttctggcacttactctggcagaatcattctgctctttattcatactctgcttcctgctgaacctctctgagccttcttcttctctgtatactgggataacaatcgttctgacctcacgaggctctggcaaggatgaaatgagaaaatgcatgtgaaagtactcagtgaattgttaggcaatgtacaactggcagatgttattattagaccaggacaagtgctttttaaaagatacagataagagtgccatcggatttcattcaattaacaacatttattaaggcaaggtaagagataagatgaataaggtatcataccccatcttataagatgcttctaatcaagtatgttagataagacacacatacaattatgatctaaagtggagcaactattcattctctactcagtgcatcaggcactatctattcatgatttctattcttcacaacaagcctatggggtagatattatcatctgtattttgcatatgagaacactgaggttctaagagaccaagtaagttgcttaagatcacccagttagtaagtaggtttaaaatcaggtctctcttaatccaaaatcagcattctttctgcattttggtaaacttcagcaaagtggatacagtggcatagcagtttaggggaaagaataatctcctttctaggaaaaggatggtaacaagtttggggagtcaggaaataaaaattttaaatttttaaaaaggaagaggacagatgagagaaggttctatgaaggttcagcagagatgaggcaggagggcatcctgtgcaggagcatgaatgaggtggaagaaaaggaaacaatttcagcccaacttagcagactcatgagctgattgaggatgagtagaatatggaaaggttgagcaaaaacagataggttagggccagattctccagagctttggaggaccagccaagaagttgagactttgggcagtgactgcagggggccactggatttccaagccagaggtagcctcctagatctgctgggagagctggaggcagggacattgtcaagacatctgtccagcagtcctgggaaagggctcacaccaggattcaagaggcctggtggggccagtcactaagggaatataggggagaaatggtgtttgtggttcgggggactggaggatgaggatgacttaggttttgaacgtgatgggtttgaggcaccagcacacattcagtcataattattattgagtgcctactactcaccaagcatgactttaggttctgaggagaaagcaaagaacaaaatcaagttcctgcccctattgatcttacattctagtgggtagagagggacaacgaacagataaatacaaaatctgtcagtggttggtgattgatagggagaaaaatagtgaagcagacatagggtggaactacctggcatagaggtgggaatatgagggcaaagctgaagagggagctagggacagtggtctgcgtctctaaggaatgcctgcccctgggtgtcctgtacacatctgttctttaaccatgggatattctgggagtccaggaccaatgggcctatctcttcatctcccaggtcaccatccttaatggctcagacattcgatccctctacaacttctcaggggaacaggtaaggatacccctcaaccccaccccagcttggcctctgtcaacgaagccccagccctgacctaataatgtcagcccaacttcccagcccctcttgatcctgtggattgaaccttctagttctgacccagcgctgcccctttgtcctccccagatggcctcctactttggctatgcagtggccgccacagacgtcaatggggatgggtgagtggtgggaaatgagcgcactgtgataccctcccagaaccaagagggaagagtgggaatgggacagaaaatgcaaggagagtttctccagggctttttctctagactctcgctcatacctgcattccccttgctcagggacaaggaaagagctgagagctgatgatcagagacctcaggtcttctgacgtgatggaattcagagtgtccgggatttctagcactaggattggggtggggtggcaagacagggtatcgagatgcctgggtttgcccttcccctcaggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatggtgagtaccatgggctcagagagtgaaagaggaggcaggggcccaagtcagaagggatttggggagagggcatctgtcagctaagatacccagacctccacgacttcccgaggggttaaaatcccactgtctgggtcttgggatttgaagattagaatatagggactgacagatgggaaaaaataggatcctaggtcctggggtctggtagtagagattagagcccatggattcctggcctgctgactagtgtgtgttctgtgtcttccagatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctggtgagttgtgcctgaggccccttttcaccttaaaattccctggtcactgacccctactctctcttctgcacctttccttaagttcctgggtgcagttctggctaattccaacagagggcgctgtcttctcacttcaacctccctgagcgttgaaaccaggaggggttaggaagaaaggatcctgatctggggcttgctgtaagaggtgatttcttgacttcttacagatctgattgtggggtcctttggtgtggacaaggctgtggtatacaggtatgagctccaaagggagatgaggggacaacctgggtggactggaactggaaatttctcaacagagctgaggttgggaaaatcaatgcagaggacacacattctggcgcttgggcatcagtttcctgtgtccaggttacagaggagtcctaattctattgaccccacattcactcttggcaggggccgccccatcgtgtccgctagtgcctccctcaccatcttccccgccatgttcaacccagaggagcggagctgcagcttagaggggaaccctgtggcctggtgagctggtgcccaggaaattgcagagacctgagcctgggagtgggcaggggcaccaagtctgccttaaaaaggggaaaatggtggtgtcctagtctgggtctggctgggagataggtagaggataggatgtctgttccagttggattcaccagctttcttcttggtctctctccagcatcaaccttagcttctgcctcaatgcttctggaaaacacgttgctgactccattggtgagggagactgcctggatctctcaggccctaggacagagaatgaagggactggggacctggggacatttcttctctctgaaaagatgaggaaagacaggcagtttccctttatatgtccctggcttcaggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcagggtatggcccagagggcggggtgtggactggccagggagggtggccacacagaactgagggcacctcctgaagggaaaaagactgggggactccagtgaagggcttgggactcttgtaggggctgagaaagggagaccttctgtcagaggagctgggaagcaggctgccagggcctctgaaacaatgaggatggtcggaattgggccctaagcagacaaagggagatgagagaggctgaggagcagggccactaagtctccagagtcccctgactccgtgaactctctcctctggccccagaacgagtcagaatttcgagacaaactctcgccgattcacatcgctctcaacttctccttggacccccaagccccagtggacagccacggcctcaggccagccctacattatcagagcaagagccggatagaggacaaggtgaggacagggcagggagaagggacctgggaagacagaggcctgggtattgggggggcagggccatggaaagagaagagcctacagcccaggaatgggtctaaacttcccctctcaaggctgccctgctccccaggctcagatcttgctggactgtggagaagacaacatctgtgtgcctgacctgcagctggaagtgtttgggtaagtagggctgacggtaagctagggagctccaggtgcacctggcacctgaaaaaatcagctagggacatactagctgtgtcgccttgggaagttgctgagctgctctgagctttaactcctttgtctgtatagtgggaatagtagcatttatttctcagactttttggaaagattaaatgaaataatctacataaaaaatctagcctagtgcctgccatagagttagaactcagtaagcagtgtctattgttactttattattactctttttttttttttgagacggagtcatgcccttgtcacccaggctggagtgcagtggcgcaatctcggctcactgcaacctccgcctcccaggttcaagcgattctctgcctcagcgtcccaagtagctgggattacaggtgcctgccaccatgccgggctaatttttttattattatttttagtagagacagggtttcatcatcttggccaggcttgtcttgaactcctgacctcgtgatccacccgcctcagcctcccaaagtgctgggattacaggtgtgagccaccacacccggcctcgtattactactcttataatggtcctttgtcctggtttgaggattaattcaccaatgtcccttaccctctgtgtcccttccagggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccaggggtgagatgagactctcgagtgggatttgggaggatacccctctagaggggacaccaaaacctgaccagtgcccaccccatctccagaacttctccagcctgagctgtgactactttgccgtgaaccagagccgcctgctggtgtgtgacctgggcaaccccatgaaggcaggagccagtgtaagtttgggatgaaagaggatgggacagagggagagcagacctgagggcggtaaccagccagccgagagcacagctgtgaggtgcggagggagggtgaaatacacagtctaactgccctcttttcctctttttctgtccccagctgtggggtggccttcggtttacagtccctcatctccgggacactaagaaaaccatccagtttgacttccagatcctcaggtagggagtgagtgtgtctaggctggggctgagctggggacggaagggagggctgggcgccattctcactggctgcactccagcacctcagtcttgcctccatcccacagcaagaatctcaacaactcgcaaagcgacgtggtttcctttcggctctccgtggaggctcaggcccaggtcaccctgaacgggtcagtgccaggcaaaatggggtctttctgagaggggacacagacttctagggaaggatgcatatggggttccttccaccctcctctaaaccaccctcctccttagtgtctccaagcctgaggcagtgctattcccagtaagcgactggcatccccgagaccagcctcagaaggaggaggacctgggacctgctgtccaccatgtctatgaggtaaggggggaaggggcagggccagaatgaatgatgggaaaggaggagctaatatgagtgacagatggctggaacccatgtgagggactgagagaaagagaggagggaggagtaagtgatatgcaaaggcatgaggcagagtcctgtgagaaacagccagaggagagacaggccaattgagtggcttggaaagaaagatggagccccctccaaaagtgttggctagagaggatttcacctctgcccattgcttccctgcttcatctctgagataggagcctgacagcagggtatagtggagccatggtgatccagggtctcaatggggcagaagcattcccttccttctcatgatgattgtgctcttccctcctcagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggaggtgagatcctgaacactggcatggggaagaggagcagattcagaggaccaaggctgaggggttggggaaggttgctgggggcctgcaagaggcaatgaggatgtgcctatagctagggttgagggtcacaaggcccaaagttacctcaaaatcctctggaggaaaaaggactttcatccactgtgtttctttctgcctgaactatcccttctttgtttcccggcatacccctagggcccagttatgtgccacctcctctaggaagccttcttcaaaccttttcctctgggcccgaatgcctgttttatagttcatttactcattaacatctaattaaataagtgactgtactgaacactgttaggcccaggaaatattgcaccaaacagaactgacaaggtctccacgttcatggaacttacattctagtgaagggtgatagacatagaaaagaaaaagagaaggagaaaaattaacagggattgaaaggtgatgaagtgaagagttaataagctgtagggacactatttaaattggatcatagaaaaacctcttgaagacgtcacagctgaactgaggcctgaaagataaggttgaacctgtctataagactcagggatgagcattccaaaccaagggaacatccagtgcaaaaacaggaacacagacctaattatttacttaagcatctcctccagtgtgatctccaagaaccaagttttcctcatttccatattttaaccctgagctcagtgccttgcgcataggaggtggacagttggatgaatcaataaagagatagatgaaagaataggttgaagctgctctggaacccaggtgcaagctgacttagaagctgtaatgagatgggaaaggggcccaacactttcttttatagttggatcccgagggttccctgcaccaccagcaaaaacgggaagctccaagccgcagctctgcttcctcgggacctcagatcctggtaagtcaggcagggaatgaggtgtggaccaaagtgttgagtactctggggttctcagggccatcacaagggcagaacaccaggttcaagcttctttcttcctagaaatgcccggaggctgagtgtttcaggctgcgctgtgagctcgggcccctgcaccaacaagagagccaaagtctgcagttgcatttccgagtctgggccaagactttcttgcaggtgagggagccttacctcagccctgacccctgacctttgggcctgcttagactgacccacccctttctccactgcagtagccacctctcctttggtgaatgggacccagcactccagctccccttccttgcccttgtctagaccaggctgtatgtccttggcgccatctagtggccacagtgggagcagcagcttccctttcctggcccattcagaggagggagggctggagggagaccagtgtgcaaagaatgatagaaaaacagtaagatggaagatgaatccatagtggagaggtaaacacatgtaggaatagtaaagagcagtcacttcttgagcacacactgcaggctaggcactgtcctggtgtcaaagcacattaataattttaaaaaaatttttattgaacacgtagtcatctaattatatattatcaagttacaattattcagttacacatttattatctcatataaggaacatcaagagaagctcacgggccaggcacagtggctcacaccagtaatcccagcactttgggaggccaaggttggcggatcccttgagcccagaagtttgagaccagcctgggcaacatggcaaaactccacttctacaaaaacaaaacaaaacaaaaattagctgggcatgatggcacatgcctgtagtctcagctacttgggaggctgaggcaggaggattgcttgagcccaggaggtggaggttgcagtgacctaagcccacaccactgcactccagcctgggggacagagtgagacctagtctcaaaaaaaaaaaaaaaaaaaaaagagagagagagagagagagactcaggaagaatgagcccaaaatagggaaagatcacaaccccagccagacgatggggaaccctatgtcctctggatcccaagagaggatgtgctaaccaactttcccctacccacagcgggagcaccagccatttagcctgcagtgtgaggctgtgtacaaagccctgaagatgccctaccgaatcctgcctcggcagctgccccaaaaagagcgtcaggtgagtctagggccagaggactggatgagggaatacagggctcagagtgctggaacagggctgggacttgggtgagggctggccttggtattgttaacaactgttgagaatgtactatgtgccaagcactgtgcagatgccagagacagagtggtaagcaagatcaacatggtatctttgctcctggtgttcacagtctcgtggaacaacacagtgttccaagtgtggtgatatttatgaaaacacataataggaacacctgaacccagtctaactgggtcagggaaggcttcctggaagaagtgatgttcaagctgagacctgaagaataaataggaactaaccaggctagccattcaggaaagggatatcctggggagaggtgaataacagatatgaggctgagcgcagtggctcacacctgtaatcccagcactttggaaggccaaggcaagtggattgcttgagctcagaagttcaagatcaacctgggcaacatagtgagatcctgtctctacaaaaaatacaaaaattagccagatgtggtggcgcatatctgtggtcccagctactcgggaggctgaggcaggaggatcgcttgagaccaggatgcagaggttgtagtaagctgagatcacaccactgcactccagcctgagtgacagagtgagactctgtcaaaaaaaaaaaaaaatggatatgatatgaaagcccgaaagtaagagacaatattgtacattttaggaacttcaatttttaagttcagaatgctgttagttcaaaataagaggtggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgggctctgcagatccaatgacaagtgggggccaagtatagggtagaaagaacttctgagctttcattgacttcacccaacttgctccccaggtggccacagctgtgcaatggaccaaggcagaaggcagctatggcgtcccactgtggatcatcatcctagccatcctgtttggcctcctgctcctaggtctactcatctacatcctctacaaggtcagccacatcctgcttgtgacttggccaccctctcatcaggctctgcccttgacctggcacagtcccaagtatctacctctagaccagttcaccagccatgtgcccccacctctgtcctggctacatgcatcccatcctaacccttcctataagatcccccccttcattctatagcccctagcttagaaagggtcctcttgactcaagatgataagtttgcctatacttgcaaaatcattggaacccaaagatgacaaatacgtggcatttgtgctgtcaatttctccaaaaatccatggcagccatcactaacctagaaatggctactgatcatctcctagaagtggcttcagaatctctctcaagaggcagccatggccaggtgtggtggctcacacctgtaatcccaacattttgggaggccagggtgggaagacagcttgagcccaggaattcaagaccagcctgggtaacacactaggaccttgtctctacaaaaaaaacacaaagattagccaggtttggtggtgcgtgcctatagtcccagctactctggaggctgaggtgggaggatcgcttgagcccaggagtttgaggctacagtgagccatgatcatgccactgcactccaggctggtcaacagagtgagaccctgtctcaaaaacaaacaaacaaacagaagcagccactactaagcaatcagacttggcatttgagttcaaacctatctgccatttctggcttaactggggaattttaaaggcactggtaaaagataccccccatacaaaatcacccccaagtttggtcctcctgggtccattgcacaacttagaggggtagtcctagcctgaattcagaggccacttttgcaggatgtagaggttggaggcactagagtcctccttattacttcttggaataagagctgtggagaaatggcagccatagtacctaaactctccctcttttcccctttatcagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactag

SEQ ID NO: 35859 - DNA, 59482 bp, Homo sapiens
gggagtacgacatggcgcgcgagctgcgggcgctgctgctgtggggccgccgcctgcggcctttgctgcgggcgccggcgctggcggccgtgccgggaggtgagggcgtcctggctggacgggcagcgggcgggccgggccacggagacggcagggacgtccctgtgctccggggagcgaggcgccggcacctgcttcacaggcgtgggaggtccggcgaggccaagcgcggcagacgcgtttactttcgctccgctcctcgccagctccagcttggctgccttttcctcggctggactcccctcgccacccgcccatgggagccctgaaggaggctgggtcttggggggtcgcggggtcgggcggagcggctgcggggtcgtccctcctggagcttcggtccagtcaggtagcgcacgtgcaggtggagccgctgcggagcgcggagtctttgcgggtgcatgttgcggggaatggactcactcggggtgatcgtgctagttccatggatcgtgctttacccctccccgcctcccagtagcgcactgagggttcatttgttaattcgttcattggacgcacatgtgagcgcccgctcagtgcccggcgccgtgcaggttctggggacgccacagtgaacaaaacctatagcagtcatccgggtccccagagcaggtggactcgatgtcgttgacgcagctgtgtcctcggggcctggaattgatggatgcgccaataaatgtttgtaaaacagagagaacgaccctaacctctgctttcccagtccccactcggaggtaacaacagtgaaagtttcggcattgcttcggggctgtacacagtgttatacgtgtaaatataaatgtctgcgtataagtattttttattctaaaaagcctaaaccatgtatgcattgtgctacgttgtacttcagaaaattttaacgctcccagcattctttccacatcttttcatgtcagtgtatacaggtccatgtgccttccagtgaccacacagtattctgtatgatggacgtgtcatttgtttaaacattgtcctattagtggacgcaataaaggttatttcaggttttactttttattacaatgctgcatagaatgggtgagtacttaaatatttgttcacgtgcggtatttctttagccttacataattagaattttagaattgatatttcagagcctatgcatttttgaaatgttagcagatactgccaaattgtccaaaaaggccttatcaatttatatcccctttagcaggcatcaagactgcctattccaaaggtattttcttcaacgctgaatcttatgtcttttcaaaaccagtggtctataaaagataccttgtggccgggcgcggtggctcacgcctgtaatcctagcactttgggagcctgaggtgggcagatcaggagttcaagaccagcctggccaacatggtgaaaccctgtctctactaaaaatacaaaaattagctgggtgtggtggcgcgcgcctgtaatcccagcttcttgggaggctgaggcaggagaatcgcttgaacccaggaggcagagattgcagtgagctgagattgcaccactgcactccagcctgggcgacagagtgagacttcatctcaacaacaaaaataataataattttccctcagaaagtgatgctgttgctctcttctagcaccagtgtctgatcaattatttatttatttttttgtctttatgaggtggggtttcactatgttggccaggctggtctccagtgcctgacctcaagtgatctgcctgccttgccctccaaaatgctgggattgcaggcgtgtgtcaccgtgcctggccaactgttctgttaatttggttctcgtttcttttgtagctgactcgggttttttcccccttggaggttaagattttttctctttgtcgtttgtggtctcgcgtccacaggtgtttgtgattcatgctttgtatcatgcactgtcccttccatttggaaaatatgtcagttttcagcccagggacattttaattctgtttctttatctctttttctttttctttttttttgagatggagtcttgctctgtcacccaggctggagtgcagtggcgcgatcttggctcactgcaagctccgcctcccgggttcaggccattctcctgcctcagcctcccgagtagctgggactttaggcgcccaccaccatgcctggctaattttttgtatttttagtagagacggggtttcaccctgttagccaggatggtctcgatctcctgacctcgtgatccgcccacttcggcctcccaaagtgctgggattacaagcgtgagccgctgtgcccagccctttatctctttttcttaaaaattgtctctctcctctcgtcctccatcttctggtgcggtggttcaagcattcctctgcctgagtctaagaaatggaacatgttcttggcagccttctgcgtggcaggtgcccttgtcattgtcacctgtgtggatgaatgggaaggtaaattgtttggattgattgaacgatgagagaatttagctaagaaaatacatgtcttgtgcaacaggggagaaagaatagtttaggcagatccacctatgtagaaaatccagacctcttgaaatttttttcttttcttgggaaagtatttccaggttgtagcatgtgcctggcttcaggtgtgcgtgtcttatgtctgtggaatcctctcgcccatgctacgctgcctcagtcacccatgagctcagccctcttaccctttcagacctcactgacccctgacactgccagccctgtcacttgccctcagaatatcttatttgattttttttgagccggagtcttgctctgttgcccaggctggagtgcagtggtgcaacctcagctcaccacaccctccgcctcctgggttcgagtgattctcctgacttcgcctcccacgtagctgggactacaggcgcatgccaccacacccagctaggttttgtatttttaatagagatggggtttcactatgctggccagggtggtctcgaactcctgacctcatgatccactagccttggcctcccaaaatgctgggattacaggcgtgagccactgcgcctggcctaccctcagaatatttctgtgaggggtgggctaggatatccgcttgtggactttatatttgtcatttttgcccataacagtttattcagcaaatacatttccaatgcccccgagtcgtcaaagaaaatgtgaccctgctgtctggagtcataggtggctgctgagcagtgtaccagggccatcttggtggcctggacagcacattagagaaacaagagctgcttgccccagggtaagtttcacagatgaggagcgatttgggccgagtgtccaaggctgttttcactggaggggagggaggaacgttccatgtctggaaagctgcaggtgcaagggtaaggagatagctctgaataattggtttgatgaaagacttgcgggagtgtgcaggagtgatggtgaatgaggctagcagttgtgtcttttctgtcagatataagcttgtgcgtaggagcctcatcctgcattcctcaggacagtcacagagccagccctgggcctggtgtgtggggagcccagccacgtggcccaccatgagagcttttcgtcagagctccaactgtcagaagtgtcagatgtgccagtagaaggatgaggccgcctcctaaaggagagggaagacctggaaagatcaacagcagacgcagtctcccaaagcaaacgtgattctgtggtcaggcaggtacggtgacgggttggtcattttgcatgacgaggtgactgccacaatcaccaagggtgccgagtccagtctcctggtcatgccagatgctcttgttttcgtgaaattgccagaacatgactgaggcaaccacgataggactggttggtgcaggcgttaagatcttgggcctttttgttctctgtaagctggagcctttgctggaacttcctgtcttggaaatcagagttgtgagagtaggtcccctgccagcaccaggaaggtcgggagagctggtttcctcactttgctcagggctcaagtactagctagtttgtttcatcttccaaaaagagcctcacctggaccccgctcctgtaggtggtgcctgcctgctgcgccctccccttcagtacttcgttttgttgacgggttttgcctcctccctctgctctccctttgtttggagcctgtgctgtttgatttccgtgtcttgtgtgctgcacccttcaggagaattcaggtgaatttctggtgctctccggctgttcttttcagagtggaggggagtagtacttgctggtcagttgcgactctgtctgtgaaacagctctttgtgttgctgagatgacgctagaggtgtagcgtccatgacatgtttgtcgtctgattaagctgtggtgctggcacttagacggcagaggaaggtgtggcccagctgtccaaggccaccaggaggaccttcagcttagttaggaccaagggaactgagttatctgagtgcctgaaaaagaacacatcaggccgggcgcggtggctctcgtctgtaatcccagcactttgggaggccgaggtgggtggatcacttgagttcaggaatttgagaccaacctggccaacatggcgaaaccccgtctctactaaaaatacaaagaaattagccagggtggtggcaggcgcctgtaatcccagatacttgggaggctgaggcacgagaattgcttgaacctgggaggtggaggttggaggttgcagtgagccaagattgtgccactgcactccctcctgggcgacagtgcaagactctgtcttggaaacaaacacatcaatccgaatgtaagagattagcaaagcgtttattggttactgggtgagtagttggcctaagctaagacaaaagaggaatctccaagtattttgctaccccttggcaggaagagagggaatgcagcttgcggggtggggatgggggtgtcaggttgataagaaaactgtgggaaaataaacatttactcctgccccccatgtcagtaaataccatgtgacaaaggtgagttccatgaaagaggctgttactgaggcctgtgatacttgcttgtctcaaaatgctgacatatcttttttttttttttttttttttttttttttttttgagacagattctttctgtcgccaggctgaagtgcagtggcatgacctcagctcactgcaacttccgcctcctgaattcaggcagttctcctgcctcagcctcctgagtagctgggactacaggtgcatgccaccatggccagccaatttttgtatttttagtagagacgaggtttcaccgtgttgggcaagatggtctcaatcttttgaccttttgatctgcctgctttggcctcccaaagtgctgggattacagacatgagctaccacgtcgggcctgacaaagaatcttgatagcgattgaaaatgtatccattcatactcaaatgaagtaaaaagtgcttttgggttcaaagccagagaatgttcatggatggcgtttttggtgcctcaagtgtagccagctagaacttttcttaccaccgtcctgcttagtcctactgaagacctgccttctactaggaagctgctcttagtccacaaagtggcttccctgtagttccacagcatttaacaaaatagatttcagggagtttatttgtggtgtggctggttatttctgctaaaaccactaggaattaccataaaagctgtagcttggagaaacagtatctacttgcgggagtattactgccacctgtgttttttttgtttttgttttggtttttgttttttttttgtttttttcaagatggagtcttgctctgtttcccaggctggagtgcagtggcacgaactcggctcactgcaatctccacctcccgggttcaagcagttctcctgcctcagcctcccaagtagctggggctacaggcatgcactaccgtgcccggctaatttttgtatttttagttgaggtagagtttcaccatgttggccaggctggtcttgaacttctgaccttgtgatctgcctgcctcggcctcccaaagtgctgggattacaggtgtgcgccaccgttcccagccctgccattggctttttaaccaggtgaattcctgtagattgggtagattgaaaggacatgtagctgaatcattggttttaaaaggaatggctcagttacttcatagccatataattaagaaatgtggctagaaggtaaaaaattggccaggcctggtagctcatgcttgtaatcccagcactttgggggctgcggcgggaggatcctgtgagtttaggagtttgagaccagcctgggcaacctagagagacccccatctctaccaaaaaacccttttttttttttttccaattagctgggtgtgcctgtggtcccagctacccaagaggctgaagtgggaggctcccttaagccttgagaagtcgaggctgcagtgagctgtgatcacgccactgcactacagtctgggtgacagagtgacagtgtctcaaaaaaaaaaatatatatatatatatatatatacacacacacatataaaagaaattaattttgagatagctaaattaaatgccatattaagagcaggaggctattcagcaatgctgctgagaagaagacagaaggacgtgggtccttctaatgtaactatgtgtgtcgggttagtgatatgcacctcgaaggagaaattaagacagcacattgccatgttagttcacacttgccagtatttcagcatttgtcaggcaatggaatgttcaagcgaattttccacgaggctgactttaaaacatttcattttaaccattatgatgagaagtctttctagaacactccatcatttgatggcccatgactgaacctctcttggatgttttcagggtcattattacgggtgttaatgtttggtcttctgttttaatatgtaggctcccgtagggccattgaaatgtgaagaatccttcgtctatgaagtgtccccacatcaaaactgcattgtgagtgtttatatttttggcctctcttactgtggccttaacttgcaggtctgtctggagccctgttctctcctttcctagtttgcagatgtggctgggaaacttgttagcatcaaattgttagaatgagatggatttcatatggggccagtagtcttccatgagcaaagctcagggtgagggcttcaggcccatattttgactattccgaggtgccctttcgctttttgttctttttctttatgttcaaggagttatgtttcctgatgaatgaagtatcagtatatcatagtagagaacgattagaccaggttctggaacacaggaaacctcaagaaacagtgagtgttgagaatgccagagctaagaactcagacatttgtgagggaatacaggtctttctgttcagaatgttcatgtacttaagaatcttctcgccaggcgcggtggctcacgcctgtaatcccagcactttggcaggctgaggcgggtggatcacctgaggttaggagtttgagaccagcctgaccaacatggagaaaccctgtctctacgaaaaatacaaaactagccgggcgtggtggcgcatgcctgtaatcccagctacttaggaggctgaggcaggagaatcgcttgaatctgggaggtggaggttgtggtgtgccgagatggcgccactgcactccagcctggcaacaagagcgaaaactccgtctcacacacacacacaaaaaaaagggaaacaaaggtaaactgggaaggaaccgtgtgtaatcttccgtaccttgcattttccacttatattctggggtttgtttcctgtcgccacagagctctggtattccatagcgaggatgttttgtaatttatgtaaccctctcatggcggacatttaggttgttgctgagtttccccaagataacagacggcattgccaacagtttctcacaccttcaccagtgctagaatgacagtatttaaaacatctgtcaatctggtagtgaaaatgctatctcgttttaaagtgcatttccttagttatgagtgtggtaaaacatcttttactaggacgtaaagccattgatgtttcttgtttttgtgaatggccatttttctcttgaaccaatggcctttttcttttttttttttttttttttgagatggagttttgcacttggtgcccaggctggagtgcagtggcgtgatcttggctcaccgtaacctctgcgctagcccttttaaataacttttaaaaattgagacagtgtcgggccaggcacggtggctcacgcctgtaatcccagcactgtgggaggccgaggcgggcggatcatgaggtcaggagatcgagaccatcctggctaacacggtgaaaccccatctctactaaaaatacaaaaaattatctgggcatggtggcgggcgcctgtagtcccagctacttgggaagctgaggcaggagaatgccgtgaacccaggaagcggagcttgcagtgagccgcgatcgcaccactgcactccagcctcggcaacagagcaaaactccatctcaaaaaaaaaaaaaaaattgagacagagtctgactctgttgcccaggctggagtgcagtggcgccatctcaccttactgtaacctccgcctcccgaggttaagcagtcctctcgcctcagcctcacaagtagccgggattacaggcacgcgccaccatgcccggctcatttatttttatttatttatttatttattttgagatggagtctcgctccgtcgcccaggctggagtgcagtggtacaatcttggctcactgcaacctccgtctcccaggttgaagcatttctcctgcctcagcctccctagtagctgggactacaggcacccgtcaccacgcccggctaatttttgtatttttagtagagatggaatttcaccatgttgatcaggctggtcttgaactcctgacctcatgatccatccgcctcagcctcccaaagtgttggcattacaggtgtgagccactgctcctggctttctggctaatttttgtttttttttgtatttttagtagagacagggttttgccatgttggccaggctagtctcaaactcttgacctcgggatctgcccgcccccacctcccaaagtgctgtgattacaggcgtgagccacggcactaaattttattttagaggcagggtcttgctttgtcatccgggctggagtgcagttgtgcgatcctggctcgctgcaggcctgacctcctggactcaagtgatactcctgcctcatcctcccaagtggctgtgacctcttcctcccaaggagcatgtgccaccatgcctggctaattaaaaaacattttttttagagatggggtcccactatattgccccggcttgtcttgaactcctggtctcaagtgatcctcctacttctgcctgccaaagtactgggattacacgcaggagccgtcgtgcctggcccccagtttttttcttaatgtgtttgtcttttttttttttttttttgagttagagtctcgctctgtctgttgcccaggctggagtgcagtggcacgatcttggctcactgcagccttcgcttcccgagtgcaagcaagtctcctgcctcagcctctggagtagctgggattacagatgcccgctgcgactcccagctaatttttgtatttttggtagagacggggtttcaccatgttggccaggctggtctcgaactcctgacctcaggcgatccacccacctcagcctcccaaagtgctgggattacaggcatgagccacctcacccgggtgtttgtcttttgacttaaatttttatgtggtccttatatttatggccttttgggttatatattttgtttagaaacatttcctcttaaggccgggcgcggtggctcacgcttgtaatcctagcactttgggaggctgaggcaggtggatcacgagttcaggagtttgagaccatcctggccaacatggtgaaaccccgtctctactaaaaatacaaaacattagccgggtgtggtggtgggcgcctgtagtcccagctacttgggaggctgaggcaggagaatggtgtgaacccgggaggcggagcttgcagtgagccgagatcccgccactgcactccagcctgggcgacagagcgagactccgcctcaaaaaaaaaaaaaaaaaaagatttcctcttaaatcattttttttaaaaactcaagatgcctggcagtttaggaactgcaaagcaaaactacagtgagttagcacttcctactcactagggtggctataattaaaaattaaagaaacaacaacaaaaaaacaggtgatacaaaatggataactaggatgtggaaaaatcagaaccctcccacactgctggtgagaatgtaaaacggtgcgacctctgcaggaaaacattcttgcagctcctcacacagtcaaaccgaattaccatatgaccccacagttctaccctgaggcacataccttgtagacatgaaaacatgtccacagaacagcctacacatgaatgttcatagcagcattattcataataacccgaaaatgaaaacaatctgaaggtccatcagaaggtggaaacgaggctgggtgcggttggtcatgcctgtaattgcagcacttcaggaggccaaggcaggaggattgcttgaggccaagagttgaatgccagcctggacaacatagtgagactccatctcgaaaaaaaatttttaaaaattgctgggtgtggtggcacatgcctgtggtcccagccatttgggaggctgaggtgggagaattgctcgagcccaggagtttgaggctacattgagctgtgattgtgccactgcacttcagcctggtcaaagagcaagaacctatctcaaaaaaaaaaaaaaaaaaaaaagagtgcaaataggccaggagtggtggtgcgcccttctaatcccacctgcttgggaggctgaggtgggaggatcgcttaagcctgccagttggaggctaccatgcaccatgacagtgcctgtaaacagccactgcactccaggcaacatagtgagacccccaccccaccccaaaacaaaagttacagtaaaaagttggaagctgggcctggtgcagtggctcatgtctacaatctcagcacttcgggaggctaacgtgggtggattacttgaggtcaggagtttgagactagcctggccaacatggcaaaacccgtctctactaaaaatacaaaaattaactgggcgtggtggcgggtgcctcagcaggagaatcacttgaccctgggaattggaggttgcagtgagcggagattacaccactgcagagtgagactccgtctcaaaaaaaaaaaaagaaaaaaagggccgggactggtggctcacgcctgtaatcccagcactttgggaggccgaggtgggccgatcacctgaggtcaggagtttgagaccagcctgaccaacatggagaaaccccgtctctactaaaaaaaaatatatatatatataaaattagccgggtgtggtggcacatgcctgtaatctcagctactcgggaggctgaggcaggagaatcacttgaacccgggaggcagaggttgcagtgagccaagatcatgtcattgcactccagcctggcaacgagagtgaaactctgtctcacaaaaaatttggaagcaacccagttgcccatcatttgatgaatggaaaaaaataatctatacagcggagtgctcttcagttataaaaaggaatgaggtgctgatacatgctatatgtggatgaaccccaaagactttatgctaagtcaaagaagccagacaaaaaaccatatattgtatgatttcatttctgtgaagtgcccagaaaaggcaaatccatagagacagacatagatgagtagttgccaagagctggtgggagagggaaaagagagtgaacatgagtggctgtagggcttcttttggggtgataaaaatgttctgtagttgtccgggcatggtggctcatgcctgtaatcccagcactttgggaggccgatgcgggcggatcacgaggtcaggagatcgagaccatcctggctaacatggtgaaaccctgtgtctactaaaaaaaaaatacaaaaaattagccgggtgtggtggcgggcgcctgtagtcccagctactcgggacgctgaggcaggagaatggcatgaacccaggacgcagagcttacagtgagcccagatggctccactgcactccagcctgggcgacagagcgagactccgtctcaaaaaaaaaaatgttctgtggttagtggtcgtggctgtacaactttgtgaatatactaaaaccactgaattgtgcacttgggtgaattatatggcagatgtgttacatctcaataaagttactaaatctttcatgttttctttcagtacttttagcttttatttttacttctatggtccatctggaattcattttgacttaataagtgacagcggaaattaaaaaaaaaaaaataagaggttggtcttgctatgttgcccaggctggtctagaactcctggcctcaagtgttcctcccaacttggccttccaaagcactggggttacaaacatgagcccctgtgccctgctggaaattaatttaacctttttttgtgtgtgtttactttttgagagttgggggggtctccctatgttacctaggctggcctcgagctcctgagctcgagggagcctcctcctgcctggatctccctcccaaagtgctgggattacaggtgtgagcagccatgcctggtctggaaatttattttaatattgtagctttatattaatgttctttaatatttgatgaatttcctcagttttttcaaaatttctttggctatttatgtacactaacttttccacatgaattttagaatgagaatagtttaaaaatgtgtttgaaattttgtaaatgtgtttatgtttctcgtaagtttttaagtgttttttataatgcaacgttttgtttgttttgagacagagtcgtgctgtcgcctaggctcgagtgcagagatgcaatttcagctcactgaacctctgcctcccaggttcaagcgattctagtgcgttggtctcgcgagtagctaagattacaggtgtgcatccccatgcccagctaatttttgtatttttagtagagacgggttttcaccattttggccaggctgttctcaaacccctgacctcagctgatctgcctaccttggcttctcaaagtgctgggattacaggcgtgaggcacctcacctggcctgtaatgtaacttttgtaaatagttttgttttttgattttttttttttgagacggggtctcgctctgtcgcccaggctggagtgcagtggcgcgatctcggctcactgcacgctccgcctcccgcgttcactccattctcctgcctcagcctcccgagtagctgggaccacaggcacccgccaccacgcccggctaattttttgtattttcaatagagactggctttcaccgtgttagccaggatgatcttgatctcctgacctcgtgatctgcccgcctcggcctcccaaagtgctgggattacaggcgtaagccaccgcgcccagcctaacttttgtaaatagttttataagtagggtatttattttgtagattattgatatatgtagtccaatatgcaaacgatacagaggtatatctgatgaaaaactcgtctcccactgacatgcctcagacaacacccctcctggtggcaagtccattagccagtttttgggtgtccttgcagagatctgcgtggcatatgagaatagctatgcatgcatgtatcacataacatgtatatgcatttgaacaccatggtagtgtgtgcaaaccgctgttctacctctagtgttttttctttgtgttagaggtaattcagcatcagcacacattacacagcattgtcccatttctctataatcccatgctttccaagtgttaccttacgtctgtagtttacttgttagtcctccgcttgtgagtatgtagcatatgtaacagtcttaagtgggttatttaatgacagtctttggccctagtagtgtttcagagttttcttaaaagatcttgccaaaaaagaaaaaaaaggaaagattttgctttcttggtaaatgcattcttaattgtttagtttttgttcctggggtctcttatgtcatattttctaactagttttctgtatataggacgtccgggtgttgatttttgtattctaccatcttactgaatgctttttttttttttttttttttttcaagacggagtttcactcttgttctccaggctggagtgcaatggcagcatcttggcttaccacaacctccacctcctgggttcaagcgattctcctacctcggcctcccaagtagctgggattacaggcatccacgacaacacctggctaattttgtatttttagtagagatggagtttctccatgttggtcaggctggtctcaaactcccaacctcaggtgatccgcctaccacagcctcccaaagtgccaggattacaggtgtgagccaccgcacccagctttttaaatttctcttaaagacagggtctcactttgtcacccaggctagagtgcagtggtgtgatctcggctcactgcagcctttaccctctggtctcaagtgatccttccgcctcaagtaccccaagtagctggaactacaggtgcgtgtcaccatgtccacctaagtttttgtatttttggtagggacggggtttcaccagtttgcccatgctggtctcaaactcctgggctcaagcgatctgcctgcctcagcctcctagagtgctgggattacaggtgtgagccactgccctaggccttattctttaaaatgatctgcctcttgaaaaatgaaagtcttttctcaaaaaacttcttcccaggtctgtgaagcagcacagtggccccttctggctctcaccttgtacctcgtccttgtttgcctcgagcataggaccttgtctgtgtttgtgcctcaggccccctccctctgtgtttgctgggtccacttagtctagtcattgggccttggctcctaagaggcccctagactgaattcctcatccgatgtgtccataccagctttcaagtgacctcaacatcgacagcagggaaaacattagcacttttgtgacagcctcatattttcccccgcccgagatggagtctcactgtgtcgcccaggctgggattacaggtgcacgccaccacacccagctaatttttgtatttttagtagagacagggttcaccatgttggccacgctggtctcgaactcctgactttgtgatccacctgccttggcctcccaaagtgctgggataacaggtgtgagccaccgtgccgggcagcctcatatttttaataatttaatatctgttttgaataaataaatatggtttgattaaccaaaaccatgtgaacaggtaaagcttgagaagtcttgctgctgttcagagcacctgctgtcttcataaccactattagttgcctgtgggtcctgccactacttacttgtatgactgtagtaagtgcagatgtacatattccctcagggacgcacccttctctgtgttctgttactcactacatagctcgtggagagcttgctgtgttcatatatagtttggtgctccttcgctttctgtagccactgtgaaatgccgttcatatcttttgccccaggtttttcttctggactgtctggctattttttttttttttttttgggacagggtcttactctgtcacccagactggagtgcaggggcgcgatctcagctcactgcaacctctgcctcgggttcaagcgattctcctgtttcagcctcccaaagtgctgggattacaggcgtgagctactgtgcccggcttctgttttattttttggtttgattctgtcagttattgagagaggagtgttaagatctccagctgtgattgtggaattgttttgtctttaattctttccgttttaacttcatatatgttgaagctctgttattaggcaaatacacacttgtgattacattttcctgatgaattgtttgttgtagtattctgaaatatccttcttttttcctaataatattttttattttgaaatgtattttacttgatattaatagagccactccagctttcttaaacacactttttggatggtatgtatttttccattcatttgtcttaagtgtatctttttctttatgtttaaagtgtcttgtagatagcatgtaattaggtcttcctttaccaattctgacaatccttgccttataattagagttcagtctgttaatgtaagagtaaatatcgatgtggctggatttattgctaccattttattatttgccttttatttgtccttttggattttttccctgtttttcctttccttatcaatgaaatgtatttgagatttccattgtggtttatctaatgctttttaaagctattcttctttgaattattattttagtggttactctggtgtttgaaatatgcacccttggccaggtgcggtggctcacttctgtaatcccaccactttgggaggctgaggcaggaggatcccttgagccccagagtttgagaccagcctgggcaacatggagaaaccccatctctactaaaaatataaaaattagcctggcgtggtgatgtgcatctgtagtcccagctactcgggcggctgaggcccgagaatggcttgaactgggaggcggagtttgcagtgagccgagattgtgccagtgcactccagcctgggcaacagagtgagactgcatctcaaacaaacaaacaaaaaagtctgggcgtggtggctcacacctgtaatcctagcactttgggaggccgatgtgggcggatcacctgaggtcaggagttagagagcagcctgaccaacatggagaaaccccgtctctacaaaaaatgcaaaattagccaggcgtggtggcacatgcctgtaatctcagctactcgggaggctgaggcaggagaatcgcttgaacccgggaggaggaggatggggtgagctgagatcgcgccattgcactccagcctgggcaacaagagggaaactccatctcaaaaaaaaaagtttgtaaagagtagcttttgtgatagatactttggcataccaagaaatatggatgttcctgtcttcaaagagtgttactgagaaatacaagctttttcctgccctaatttggtgagataaattatacattaaccaaaaaattaacagtgggaaatgtcatatgctggcatatagcagcagtttcaaatgagcagcacaggctgggcgtggtggctcagacctgtaatcccagcagctttgggaggctaaggtaggaagattgcttgagaccaggagcttaagaccagcctggtcaacatggaaacaccctatctctaggaaaaaaaaaaaaaaaagaatttagtcctgtgtgatggtgcttacctgcagtcccagctgttcaggagagtaaagcaggaaggtcccttgagcccaggagttcaagactgcagtgagccatgactgtaccactgcactccagcctgggtgacagagcaatctcttttctaagaaagaaagaaatagtaaatacatgaataaatcttttttttttttttttttttttgagacggagtttcactcttgtcacccaggctgctggagtgcaatggcacaatctcggctcaccgcaacctctgcctcgtgggttcaagtgattctcctgcctcagcctcccgagtagcggggattacaggcacccagtgctaattttgtatttttagtagagatggggtttcaccctgttggtcacgctggtcttgaactcctgacctcaggtgatccacccgcctcggcctcccaaagtgctgggattatggtgtgagccactgcgcctggccagtataaaatttttttaaatgggcagcataaaaagttaagtgcagtgaactcataggaagagattattgtgaactgctggggccagggaggcctgaatgggagagagggcctgcagccaggccctgcagcaactcggatgggaaggagtcccagctactgagactgcagctgcagagtggaggagctgcatgggcactggcagtagtgggtagggatgtggggggtggaaggggaggggtgtgtggtgtcacattcaaactatcagtgcttcccattttgtgcgaccccaaaccaccagatagtttaacagtaagatcttgtagcctgacattgaggtttgtggtttttcctttagggtgtaggagaaacacaaagacggaaattgtacagctagcgtgtttggtatctggttcaggcagatttattcctctaatggtttattttttttttaatttttaattttttttttgagacagggcctggctgcatctcccaccctgaaatgcagtggcgtgatcttggctcactgcaacctctgccttgcaggctcaagtgatcctcccaagtagctgagactacaggcatgcaccaccacacctggctgtttttttgtagagatggggttttgccatgttacccaggctaatttcaaactcctgagctgaagcgaccccccggccttggcctcccaaagtgctgggattacaggcatgagccactgcacctgagttagtgattaaaagttgttgtagaagccgggcgcggtggctcacgcctgtaatcccagcactttgggaggctgaggcgggcagatcacgaggtcaggagatcaagaccatcctggctaacacggtgaaaccccatctctactaaaaatacaaaaaattagccgggcatggtggcgggcgcctgtagtcttgggaggctgaggcaggagaatggcatgaatccgggaggcggagcttgcagtgagccgagatggcgccctgcactgcagcctgggcaacagagtgagactctaaaaaaaaaaaaaaaagttgttgtggaaagtttacataacctgaaatcaaatctgcttttaagaatgctgtcaattcaattaatgtaatcttggcgttatgatactaagtcttgcaattctggctggaaatatagatttcttatttttttctttttcccaattgtgaggacttctatatactcctcccataatgaatattatattaaatcctttcaaaaatataggctgggtgtagtggtttgtgcctgtaatcccagcactttgggagactgaggcagacggatcacgaggtcaggagttcgagaccatcctggccaacatggtgaaaccctgtctctacttaaaaaagaaaaacaaaaaaacaaaaaaacacaaaagttagccgggcatggtggtgcacacctgcaatcccagctacttgggaggctgaggcaggagaattgcttgaacctgggaggcagaggttgcagtgagccgagatcacgccatttcactccagctctgggcaacagagcaagaccttctcgaggaaaaaaaaaaaaaattctgcatattaattggggaaaaaccaaaaagactagaaaaatgaaacatggggaaatcatgtttaatcttagagtgaggaaggcttttacaaccaaaagactaatttccttttttttttttttttgagacagagtcttgctctgttgcccagggtggagtgcagtggcgccatctcagctcgctgcaaactccgtctcccgggttcatgccattctcctgcctcagcctcccaagtagctgggactacaggcgcccaccactacgcctggctaattttttgtatttttagtagagacggggtttcaccgtgttagccaggatggtctcaatctcctgacctcgtgatcctcccgcctcggcctcccaaagtgctgggattacaggtgtgagccaccgctcctggcgactaatttccttaatatataaaaagctcttacaaatcaataagaagaagatttaaaatgtagtagaaaaattatcagaggataccaacagtcccttaacaaaaaaggaaataggaaatatttaaaaatacgggacagtgctcagttttgcttataataagagaaatgtaagtgaaaactgcagtgaaaattttatctgaccaataggcaaagatccaagagtttcatctcaacactgacttggcaggaatgtaggatgatatgcactttagtacattgctgtgggaacgtaaactgataggatctctgtggagtgtgacttggcagtatctaccactgcttcaaatacataaccttaggctgggcgtggtgtcttacggctctaatcccagcgcttgggaggcagaggccgggggatcacttgagctcaggagtttgagaccagcctgggcaacatggtgaatccctgtctctacagaaaacacaaaaattagccgggtatggtggcatgagcctgtagtctcagctactcggaaggttgaggtgggaggatcacttgaatccggagggttgaggctgctgtgagccaagatcactctactgcacttcagcctgggcgacagagtgagacccagtcaaaaaaaaaaagaaaaaaaaaattagctaggagtggtaatacacggcctatagtcccagctactcaggaggctgaggtgggaggatcacctgagcccgggaaggtcgaggctgcagtgagctgtgattgtgccattgtgatccagcctgggcaacagagtgagaccctgtctcaaaatagtagtaacttacaccagccagttattgctgtggtgtttcctgatggtgtgctttctgttttctgccattccttgtgtttattcattggaattctgctgtgatgaagagctgctgctcctcctctgtttaagtgtgcaccgatgtttgcttgatttgccgggtcacagcttacaatccattattgtcgttcgttattttgccgcacagattgtcctagattctgccactgggagcccttctggctgggctgtgtgttctcctgacacaccccgtcctttctcgtccttctgcacaccactgggtgtcctaggctcctctgtgtgctccgcagggatctctggttcctgtttttggagagaggtattcacaaaccaagatctggctgccaggtagggtgaccagccgtcctagtttgccaggacaaaggctttccctgggacgtgggactttagagtgctgaaactggaacagcttttggactttgctctctgtagcctaagtggggggtcatcgcgcctgggccctgtcacgcgtcagtggacagagctgggaaatgtgtgtgtgtaaatgttccggtattgatttctgcatccagtctgtacacatggcaaaggttgtgagcctgtactgatgcctgtacctccagtgccgccccgcagggtttattcctgccccttccttatcagtgacttttcttcaactgtgaggaccccaactcagtagccacaatcagcttttccgcttgatcttggcacatgcgtaaatcgggctcagacctgctgactccgcaggggacacatctcctgcccgagcctggtgatggtgtgctgtcctctgaggttagttttacagtaacagtcaaagtgctattttctgaagtctcttaggttagttcttctttcagagtggtgatgtcatcgtcacagctctgcatatttgctgtttgtatttcattttgtgttcatgtgcgccctgttttgttttcacggtttctttttctttttctttttcttttctttttttttttttttcgagacagagtctcactctgtcgccaagtctggagtacagtggtgcgacctcggctcactgcaacctccacctcctgtgttcgagcagtccttccacctcggcctcccgagtagctgataactagaagtgcgccaccacgtctggctaagtaatggtttgttttttgagtatgagaaacctgaccatggttctaagagagacatacgaaaagatgtatgtggaagtgtcatgttccctcagctctgccagccctctccccttcccgctttctttgcattctctgtacatatgctggttgggggttgaattgtgtctccccacgaaagatgttgaagtcccagctctcagtacctgtgaatgtgaccatatttggaaatagggtctttgcaggtgatcaagttaagatgagttcacttgggtgggccctaatccagtatgactgtgtccttataaaatggggacatttgaacagacagacatgtgtagagggagaagggcagacgtcctgaagggaagacacagggagaagatgaccacccacaagccaagcaacgccagaggctgcagaggctggaagaggcgcaaacagaccctccctcccagcctcaggaggaaccagccctagtggcaccttgatcttggacttcttgcttccaggactgtgagagaataagtgtctgttactgtaagctaccgggtttgtgccacggggagtttaatacacacctcctgtaggtaaccaagctgtggggtttgaaggccgggtacagtggctcatacctgtcatcctagtgctttaagaggccaaagtgggaggattacttgagtccaggagttcaagaccaggctgggcaacaaagagaaaccttgtctctatttttattcttttttaaaaagaggccaggtatggtggctcacgtctgtaatcccagcactttgggaggccaaggtgggcagatcacttgaggtcaggagttggagaccagcctggccaacatggtgaaaccatgtctcttttaaaaataaaagccaggcatggtggtgcgtgcctgtaatcccagctactagggaggctgaggcaggagaatcgcctgaacccaggaggcagaggttgcagtgagctgagatcatgcccctgcactccagcctggatgacagagcgagactctgtctcaaaaaaaaaaagagaaagatacgttcgcgtcctcatccctggtacttgtgagtgtgagcttatttgggtcatttcagatgtatcaggttgtgatgaggtcacactgcatgggggtggggcctaactccagtattcctggtatccgtataagaagagggaaatctggacacagccaggactcacatagagaagagcttgccatgtgacaagagacagagcctggagggtctgcaaagcatgaaacaccaaggatgccggctactgccagaagctggggagaggtgcgggatggactctccctcggcacctccagtgggaagcaccgctgcccagaacctgggacctttttttttttttttttgagacagagtctcgctgtctcacccagcctgaagtgcagaagtgcggtagtgtgatcttggctcactacagcctcaacatcctgggctcaagtgatcttcccacctcagcctcacaagtagctgggactacaggtgcacaccactacacctggctagtttttgtgttttttgcagagatggagtctcactttcttgcccaggctggtcttaaacccctgggctcaagcgattctcctgccttggcctcccaaagtgctgggattacaggtgtgaggttgtgtgcctggctcagaactgtggacctttttgaaactgcctagtttgtggtgctgtgtttcagtagtcctaggaaacaaaatacacagtcacatcagtttctggtttatcctttttgtgtttcttttacacaaatggtgagaaacactgatatgctctgtgggcaggtgttggcacttggacacttccctcctgtgcccccagggctggctgtgctttggaaggaggcacagagacttcagcaccctggtttgatgtagactgttcgcgaactcctctaatgccaaataccatttaattccagaagaaatgtcccgggattttttttttttttttaactgtacgaataaagtgaacaatgcaattacatgggcccaaataactggatgtttacatggtttggaatttgaatactttctgaattgtggtagatgtttttaaggtatctgcatagagataaagacaggctagggttggccgggcatggtggctcacgcctgtaatcccagcactttgggaggcctaggtgggtggatcacctgaggtcaatagttcgagagcagcctgaccaataaggtgaaacctcgtctctactaaaaatacaaaaattaggcatggtggctggtgcctgtagtcccagctactttggaggctgagacaggagaatcgcttgaacccagaagatggaggttgcagtgagccgagatcactgcactccagcctgggcgacagagcgagactccatctcaaaaaaaaacaaaaacaaaaggccaggtttgtgctgtttgtaagtccaggaataagcctaaagaataggcaagttttggctgggcacggtggctcatgcctgtaatcctagcactttgggaggctgaggtgggcagatcgcctgaggtcaagagttcgagaccagcctggccaacatggtgaaaccctgtctctactaaaactacaaaaattagctgggtgtggtggcaggcgcctgtaaacccagctactcgggaggctgaggcaggagaatcgcttgaacccgggaggtggaggttgcaatgagccgagattgcaccattgcactgcagcctgggcaacaagagtgagacttcatctcaaaaaaaaaaaaaaaaaaaaggcaagtttttgtaccttttaggagtatgaaagttgatatgttaatttttttttttttttgagacagaatgttgctctgtcacccagcctgtagtgcagcggcacgatctcggctcactgcaacctccacttcccaagttcaagccattcccctgcctcagtctcccgagtagctgggattacaggtgcctgccaccatgcccggctaacttttgtatttttagtacagatggggtttctccatgttggccaggctggtctcgaactcctgacctcatgtgatccgcctacctcagcctcccaaagtgctgggtttacgggcgtgagccaccgcacccctggctgatatgctgatttttaaaaccttgattcctggatattctgttgtctttcctttctacttgttacaaatttgtgaagaacaggagaggctcccagttagatgcggttcatttaggcttagactttgacacggcgtggctggctggccacatatccttgacaccatcacgtattgcaaatctactgaccaaggcagggtcctggtatgtggtccctggggtcagtgggtgttggtgttgggtcggtccagtcctgtgttggagtgaaagtgtctggtttctgggcctgcgtcggtgaactgcgtgcggctggggacacattggctgctttcctccctcgctgggctctgccggcaactttctcagcccactggactgagcaggaagttacagaagacaagtctccttcttagttagaaggtagaacccatcgtcagctgtttttcagtttttaaagtacacaaattttttttaaaaaatctgttttggatgaaaaagcaatgggaaagaatcaacttttagaagatgagacagtttcagaatattaacatttaaatatttggatcccttttgggaggattttttttttgcttgactgtcaagagcaaagaagtgtggcccatcgggggcttctgcaggggctgcgagggtcgagacaggtttcagtttggtaggttgatgcgaggtgtcacccgtgaggcgaatgtgggaagtgctgtcagcaggcatctgccagctgggcatggtggctcacgcctgtcatcccagctctttgtaaggccaaggcgggaagatggtttcagcccaggagttcgagaccagtcttggcaacatagcaaaaccccatttctacaaaaaattttttaaaaaattatgggggcatggtggtctgtgcctgtggtcccagctactcgtgaggcggaggcaggagcattgcctgagtccaggaggttggggctgcagtgagctgtgatcgcagtgacagagcgagaccccctctgaaaagaaggcagcagcccaccccctccagtttcgcttctgcggttctgagaagacacagtatcttacactgatgacatctgtgagggctccttgccaaaaccacaccctgacactgtggcatttggtcctgtggatttctctttcagcaacagcccgacttagagatgtccacgctagcttctgctagacacccttgatgggacgaattaccatattgtttctcgtgtcttcctaattctcattctttctgcatatttgtcttttcaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggtagccttggctcgtgctttggtctgggagggctttttggttcactgctgtgcgtaaaggggcattttcagggtggaggcagtgattggtagagccaccgccttaggtgtgaaatcagaaggtcttggctgtagggagtgctgcgccctccatttctgtcccagcgagggacttctgccagtgtcgggtgtgtcttgccccctctggtggccacccgtgagtttgccgtccggcacctcccctgagtggtgattcatggcacatctgctaataatcatggaagcgggaggggaaactcagcattggcccagtctgcgcaggaccgaattctggagctgtcttttcattccctctgaagtataaaaaagcagtctttggagccagtcctgaagtggctccatttctggcttttaagtgggtcgacaagagtagaatctttgaagttaaaaagagaagtgaggttttcttgttattttgatttctaactaattaatttggaaaccgcttttttgaagaatatagtccaggcacagtggctcacacttgtaatcccagcactttgggaggccgaggcaggaggattgcttgaggccaagtggtcgagaccaacctgggcaagatagaccctttctctacagaaaaaaattaaaaagttagccaggcatggtagcacacaccagtggttccaggtacttgagaggctgaggcaggagaatcggttgagcccaggaagttgaggctgcagtgagcacgatcctgccactgcatagcagcctgggcaacagagccagatcctgcctctaaaaaaaaaagaaagaacatataatctggttcttagaggcagtccagttctcgtaaccatgcacattgggaaaccaggctcagcattccctcgacatagcccgaggcatgtctggcctcagcagtgggaggatttgtcctgccctgagacctcctttctgagagactttttgttttgttttgttttgagacagggtctttctctgtcacccaggccgagtgctgtagtgcaatcatggctcactgaagcctcgacctccctggctcaagtgatcctcccacctcagccccctgagtcactgggaccacaagtgtgtgccaccaccgtcagctactttgtgtattttttgtagagatggcgggatccctctgtgttgcccaggctggtcttgagctcctgggcttaagtgattctcctgccttggcctcccaaagtgctgggattacaggcatgagccatggtgcccagccagactttgtttctgtctgcttctttctttttgttcatgatcttaaatgtgtgggaggccgaggcgggccaatcatgaggtcaggagatcgaggctatcctggctaacatggtaaaaccccgtctctactaaaactacaaaaaattagccgggcgtggtggcaggcacctgtagtcccagctactcgggaggctgaggcaagagaatggcgtgaacccgggaggcagagcttgcagtgagccgagatcgtgccactgtactccagcctgggtgacagagcgagactccgtctcaaaaaaaaaaaaaaaaaaaagtttaaaactcataaacttaagctttctttggaatgtgacgtagcgtattcttgcacaaaaatagaagttaaactttgttggttgtgtctgtgtttcattactaggttccacttccaaacatgagttccaggccgagacaaagaagcttttggacattgttgcccggtccctgtactcagaaaaagaggtgcgttccctgctaaccatgcccgatgctagcaaagtttcttttcacaaagctggtttttatgccattctggagaattgccagataatatattagctgtgagaaagcattaaactttggacaggtcctcatcttaagctaccagtgagaggagttttaccagaatctgttttggtttcctggataagtgtatccagatggttctttgggctggatcaactctgggaattaattgaattttgccaataattttaaaagttcccgaaatacaggcctggtgtggtggctcatgcctgggaactcagtgctttgggaggtcgaggcaggaggatcacttgagcccaggagtttgagaccagcctggtcaacacagcaagactccgtctctacaaaaaatttaaaaaattagccagctatgggggcactgacctgtggtcccagctactcaggaggctggggtgggaggatgacttgagcctggcagactttggggctgcagtgagccatgattgtgttactacactgacctgcacaacagagtaagaccctctctccaaaaaaaaagtcccccaaatcctagcgtgcagctctgctgaattccgtctctgtggagctttggatacgctctgaggcccctttgcctggtgggactacctgcaggtcttggcggctttggctgccggaggaagaaggttccccagtcctgtgtgtatggagcagggaggagttactgaggaaattaaaacgcatttggggccaggtgcggtgacccacacctgtaatcccggcactttaggaggccaaggtaggaggattgtgtgagtccaggagtctgagaccagcctaggcaacgtgaagagaccccatctctattaaaaaaaaccccgcaaaactcatttggggtgacaggacaaggaaaaagaaagatgaaggccaccatcgttgacatgctgattattgctggaaggcaaaggagagtcctgaagaaagtttgtaaagcagcagatttcaaagctcagagggccttctaggagctgtttccgggtttcgtactgatgagtgctgcattcctgactcccagtgacctccagcttccgcccagatcagccaccgcttcctcttcacctatgtgctcttgcggacttaatttttctatttttaattgtgtgggtttttgttttttttttttttggttttttaattttttggaacagggtctgggtctgacgcccaggctggagtgcagtggtatgatctcggctcgctgcaacctccgcctcctgagctcaagccatccttcctcctcagcctctggctgatatttgtatttttttgtagagacggagttttgccgtgttgcccaggctggtcttgaactcctgggctgaggtgatctgcctgtttcagcctcccaaagtgctgagatcacaggtgtgagccaccacacccggcctctctcactgattttaaatggaaggtctgtttgaggtcagtgtgcttttcagctcctgagggacagctgggccctgaggcctgtttttctccgggtgtggtagacctggtgtttggtggtccccactagatgagatgaagctagggaacctgtttttgtggagtaggagtgtattagtccattttcacgttgctgataaagacatacctgagactgggcaatttaccaaagaaggagctttaattggacttacacctccatgtggctggggaagtctcacagtcatggtggaaggcaaggaggaacaagtcccgtcttacatggatgacagcaggcaaagagagaatgagcaagacacaaaagcagaaaccccaaaaaactgtcagatctcatgagacttactcactaccacgagaacagtactggggaaacggcccccatgattcacttatctcccaccaggtccttcccacaacacgtgggaattatgggagtacaattcaaggtgagattttcgtggggacacagccaaaccatatcaaggagaaatggatgtttgagtgatatgccgtcatccctgtgcaggagttgggaaagaaattgttcctcgcaggcctcttttgtttgtttttttgagacagagtctctctctgtcggggctggagtgcagtggtgccatctcggctcactgcaacctccgccttgtgggttgaagcgattctcctgcctcagcctcctgagtagctgggattacaggtgtgttccatcacgcccagctaattttaatatttttagtagagactgggttttgccatgttggccatgctggtcttgagctcctgacctcaagtgatccacctgcttcagcctcccaaagtgcctggattacaagcatgagcccccaaccccagccagagggctcttcttaaagttataattaacagatggacacgtaacttcaggcttgattaaaaatcctgaaaagggccaggcaccgtggctcacgtctgtaatcccaacactttgggaggcggaggcacaacgatcacttgagcctgggagatcaagaccagcctgggcaacatagcgagaccctgtgtctataaaaattttaaaacaattagctgggtgtggtgcatgcctgtgggcccagctacttaggaggctgaggtgggaggattgcttgggtccaggaggttaaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgcgtgaatgaatggacttgtgaagggatggctgttttaattaaaggaggggcttttgtgaggtgtcagctttacgcactccctcttgggtttagagaatccagactgagccccgtggtacgtgccagctgtttgtcatagcccttggtcataaggattgggtggggagtgggtttcttctctccctgcctttgctgagctggcctggctgtggaatgggccctgtgggcagggctgcagcgccctgtgctttcctcctgttttcagcacagaggttccttgcagatgattgaaaatggatgtgctggggcaaggggtcatggggacatgattcttggtctttagcagaggggccagtcctcatgtgccagtacttcctggtactaagaccatttatgttacaataatgatttttggttttgtcttttgtcttcttttttcttaaagaacagttctagatttacagaaaatttgagcaggtaatttagagctccattatatcctttgggacccagtttttctattctcaatagccgatgggagcgtcatggtccatttgtttcatcttttttccttttttttggagacagagtgtggctgtgtcgcccaggctggagtgcagtagtgtgatctcagctcactgcagcctccgcctcccaggtccaagcaactctcgtgcctcagcttcctgagtagctgggattacggatgtgtgccatgatgcccaactaatttttgtatttttagtagagatggggtttcaccacgttggccaggctgggcttgaactcctgccctcaagtgatctgcccgccttggcctcccaagtgttagattacaggcatgagccaccatacccagcccatttattacaattaattaactaatattgatagattattcttacctaaagttttagaaaaggaagctttcttgtggggtctcagaggtattatgccattccatctcatctactgatatctcagctacattgctttttgttatttttaggggattttctagggaataaaatatgcagccttaatttatcactgtctagcttgaattgatatttaacacttcattgtaagaatcttacaacagtatcattccggtggcaaaatcatctttttcttttgatgtcaaatattttatgtatatacctgttgtaaaccctcacaaattcctttttatttttgtttgagacagagtctcattttattgcctaggctggagtgcagtggtatgatctcacctcactgcagtgaggcctctgccccccggatttaagtgattctcctgcctcagccccccaagtagctgggtttacaggcacatgccaccacacccggctaatttttgtatttttagtagagatggggtttcaccatgttggtcaggctggtctcaaactcctgacctcaagtgatctgactgccttggcctcccaaagtgctgggattacaggcgggagccaccgcgcctagtctcaccatttccttttaaaatcacattgtgcgggtcgcctggcaacagatgatttctgtctacatctgaaaaatctatagtttttttttttttttagtaaatattttagaacagatttcaattttcagaaaaattttaaagatagtacagcgttgccatctactccaacacccagcttcccttatgattgaaaccttatggccgggtgcagtggctcacgcttgtaatcccagcactttgagaggccaaggtgggcggatcacctgaggtcaggagttcaagaccagcctggccagcacggtgaaaccccatctctaataaaaatacaaaaattagccagatgtggtggtgtgcacctgtaatcccagctgctcaggaggctgaggcaggagaattgcttgaacccgggaggcggaggttgtggtgagctgagatcgcgccattgcactctagcttgggcaacaagagtgaaactcgtctcaaaaaaaaaaaaaaagaaatgttagtatattacattggttacagttaatcaaccggtatggatatattattcttaacacaagtctattcaggtttccttagtttttacctcatgtcctttttctctcccagcatcccacatgacatttagttgtcctggccccttagctcctcttggctgtgacagtttctcagactttccttgtttttgatgaccgggaagatttttttttttgaaatggggttttgctcttgttgcccacgctggagtgcagtggtgtgatttcagctcactgcaacctccgcctcccgggttcaagcaattctcttgccttcagtctctcgagtagctgggattacaggtatgtgccaccatgcctggctaattttgtatttttaatagagacagagtttctccatgtcggtcaggctgatcttaaactcccggcctcgtgtgatctgcctgcctcggcctcccaaagtgctgggattataggcatgagctaccgcacccagcctgacctggaaggtttttatgtttgtttagagtcaggatcttcttccgtctccaggttggggtgcattggtgctatcagggttcgctgcagccttgacctcctgggctcaagtgatctaccacatcagccccctgtagctagggccacaggcacatgccaccatgcctggctaactttaaaaaaattattttttttgccaggcatggtggctcacgcctgtaatcctagcactttgggaggccgtggcgggcagattgtctgagctcaggagttcaagaccagcctgggcaacgtggtgaaaccctgtctctgctgaaaatacaaaagaaattagctgggtgtggcagcgtgtgccggtagtcccagctactcgggaggctgaggcaggagaattgcttgaactcgggaggcggaaggtgcagtgagcggagatcacaccactgcactccagcactctagcctgcgtgacagagcgagaaatttttttttttttttttttgtagaggcagggtcttgctttgtggcccaggctggtgtcaaactcctgggctcaagcaattttcccaccttgaccttccaaagtgctgggattacagatgtgagctgttgtgtccagccctatgttttcttctagaggttttatagctttagctcttatatttagatctatgatccatttcaagttaatttttgtgtatggtgtgaggtagggcttgaggtttatgttttgtttatgggtgtacagttgtttcagtactatctgttaatagacctatcatcccccattgaattaccttggaatctttgtcaaaaatcaagtaatacactctctgtgcatctctgttcctgtgctctgtttggttctttcatccatgtgtcgatccttaaatgcccacatcgcactgtcttaattattgtagctttataggaagtcttaaaattaggtattttaaattctccaacttcgttcttcaaaatattttgaaaattttctaagttctttgtatttccatatacattttagaatcggcttgtcattttctacaaaacctgtgaggatttagactgggattgcagtgcagatcagtttgggaaaaaataaaaataaattgaaaataggagctattagttgcattttttcctttaccttggtctaacattaacctttcccttaaggactctatttaagtttctgatgtattaaacacttaaatgaaacttatatttaatgactgatatcaactagatactaattttaagtagttttttattcataattattacatgatctacaataaatgaatcaggctggattttggactattcaaaccggcacctcagaaataattgcccagaagcctcttggtgccatgtttcttgttggctgctggggcccgtgaaacatgcacacatgtgtgcactgcagtaactggtggtgatgtggttttggcacccattctgcctgtgctgcctacaatgggaaggctgacagctggccagtctccctggcctgctgcttgctgtggattatttgctgagtggcactgaccacccttgctttgccaatggagacagcactggcgcctggtgctagtgggctcccatggctcctgcaggctgtcctggagaggaagtctttagaaaggaacttcctagaaggaagttcagaaaactgtttctgagggcctttgtcccaattcatagatgtggaggcttggagtgagctcttttatttaaggtggtctgcacatcatagcagagcaagctggggctgtggctacattatgggcatgttgagcgaggatctgcagatgggagtctgactgggctttgaggaaggaggagcccatggtcagtaaggccttgtgtgttcaccagcgcgttggtctgtattgtgattcaggctgctatagccgaataccttagactgggcaatttataaacaacagaaccctattgcttacagttctagaggctgggaggtccaagagcaaggggccagcagattgggcatctggcgagggccctttgactcaggcagtgcctcttgcatcttcatacagaaggtggaaggggcaggcaagctccctcaagcctgttttctaagggccctactcccattcatgagagtggagccgtcgtgacttgatcacctccccaaggcccccctcccagtgccatccccttgggacttaggtcttaatatatggatttgggtgacactggcactcagagcagagcagctgcaacaggataggccagatagaggctccaacgcaagggctctgccttcccgcaggagaggcgtctgtgcccgctgttcccatggtggtagggtgggagtaggtgccgcgtgcagagctgcgttcccaacacctgcttcctggtgtcctcagtcagatcattctgctggattgagagagccaccagaggggatcactgttccccagaaccacagccagggagaaggcgtgggggccacatcttgatggtgggagagctgtgcttttcctaattgctggtgtaatattttcttttcggaatggtttttaacaaacaaagcaactttctgctgtcccttcctgttttctctggtgaggccaagctgctatgactagaattagtcttttcgttttttctttttttttttttgagatggagtctcactctgtcacccaggctggagtgcagtggcgcaatctcagttcactgcagtctctgcctcctgggttcactgggctcaagcaattttcctgcctcagcctccgagtagctggaaccacaggtgctcgccatcatgcctggctaatttcttttttagtagagatggggttttaccatgttggccaggctggtcttgaactcctggcctcaagtgatccgcctgccttggcctcccatagtgctgggattacaggcatgaaccatcactcccggcccctagaattagtcttttctgatgagcatctggtgctacctggctgggccctgtctggccaatgtcattgacaccacttgagtccctgggactgctggtgcactcacccggctccccaggtgctgggggcttggcacttagtgcgtctctctcctcaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtagagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcaggtggatcacgaggtcaggagatggagaccatcctggctaacacggtgaaaccccgtctctactaaaaatacaaaaattagctgggcgtggtggtggtacctgtcatcccagctactcgggaggctgaggcgggagaatcacttgaacccgggaggcagaggttgcagtgagctgagatcacgccaccgcgctccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatgggtgagtgacgaatgtcgcctgacaggcagctcaaagctgagctggagcccttagcatggagtttggaaagggatggactcagaaaacgtacacaggcattttctgggctttttatatgaaatctgactctcccattttggggagttagtgacttttgtggctccaggtggcctatggcacctgtctggtcccatgtggttggtcaccaccactgcgctcgggaaggcaggtccggcccgcgctgagctcctttctcagtggctgagctgcaggactggcctgtcgcctggtggacactatgcagcctcctgtgaccgaccttctgcaagagctcattctgcttcctcccagccctggcatttcctggctttgtctccccagcccacttctgcctctatagggtgaggagcctgctgggggctttttttttttttttttcctttgggacggagttttactcttgttgcctaggctggagtgcaatggcacaatcttggctcactgccacctccgcctcccaggttcaagcaattggcctgcctcagcctcctgagtagctgggactacaggcgcatgccaccacgcccagctaattttgtatttttagtagagacagggtttctccatgttggtcagactggtctcgaaccccgacctcaggtgatctgcccgtcttggcctcccaaagtgctgggattatagacgtgagccaccacgcctggctccgagggctttttagcaggtgagccgcttccagccagccgaggcgtcctccctccgtgatgccatttctgctccacagtgtgtgcactgtgctcagcttgactccccactctcccaaaactaacattcctgtttaattccatgggagcggggctcagagtaaacttaggccaaggcatcaacatggccctgccgggggattcccccctcctgtgcttcggagatggttttctgctcttcttagggggcgcctgtccccctggcctttgtttttgcccctgggcatctggcacccgatttggagctgggccagtcccccacagtgccccaggcctgcttttggggtaagcccagaagcttcttcgaagcccagggtcggtggaggacccccgcccccccgccccccgcccgagggaaccaggagaactctgccgcctgcgacaggctcatcgttcctgatgggcatgtgatggcctgagtggtgcgctggggtcagaaatggggcatttgaggtgtgttgtgtgttgtttgggctctgcctatgaaaccctcgggaaccgctggagtcccatgcagggtatgtcccagtgtcacatccacctggcttttcctttctttgcctgccttagttctggagtgtttgaaatcgccgaagcttcgggagttagaaccgggacaaaaatcatcatccacctgaaatccgactgcaaggagttttccagcgaggcccgggtgcgaggtgagcgggagcccgggcccaggctcactctgggatccatgtgtggcctggaggccaccaggtcagcaggcattttccctggttctacctgcacgtagggtgcacaggcagagccgtgaagggccgagccgctgcgggactgggaggggggctgcccgccagggctgcgtagcatcgagctcctgctgggactgggaggaagctggcctggctgaggcggacctcctcctccttcctctgcgtggcccttggcctttagtgcacctgggggtttggcgcagtcctgtcccaggatgtgggcgtggccttccctctttgtgtcctgctggacactcagggaggccctgagtacccccaggagtcagcccagaaagccatgttccagccacaagctgacattgcagtctcgcagcagccggggcctccacagctctggttctcacgtgggctccgctgctgcccccgtgagactggggggaggacaggtgtccccactgtgccctgtttctgtacctgtgaagtgtacacagcatggaggacccttcccagcaggctggcgctcatcctggagctgctgcaaagcttgcgtttccacaagcattgtagatgcagtgtggtttttcttttgtcccttccagatgtggtaacgaagtacagcaacttcgtcagcttccccttgtacttgaatggaaggcggatgaacaccttgcaggtgagccctgagttcctctagggactggtcaaacatggagacaaatctgtacgtttcagggcagcggagaagagatgagcccaggggatgcggcccagagtcacagggcgagctgctctgtggagatgagacctgggtgtggggatgagacaggggcccagctctaccacagccctgcccctgtgcaccgggcagccggggtcaggggtcagggttcactgaggcgtaacgcccatcccagctggctcaccacatcagtgtgcagccatggtgttcagtgcagccacagagctgtgcagccaccccgcatcaattccagaacatcccatcaccccaaaaagcagccctttccccactgcccctcccccagtcccagcagccacggtctcctttctgtccattgtgctgcctgttccagacgtttctcctggatggagtcacacggcatgctgtcctcagtgactgacttccccctcgcggctcagctgcggtgcagcgtgggtcgtcatcgctctcacggcccacactgtattcgtcagctcgcccctgctgggcagcgtcatcctctcccacaggccccctcaggtcccggctggtcctcctgacatgttgtcctgaggagctcctgccccagagccttgtgtgtctcccctgcactacccggcatagcccagcggtggggctggagaggggtctacgcctgagaccaccgcccgtctgtcccaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatggtgaggcactgtggcagtcccacggccctcagggtgactctgttgtcccctgtggcatcagctctgcagatgtcacatgattaacatggcagtgtgagggcatgaaaaacataggtagtgctgggtgtggtggctcacgcctgttatcccagcactttgggaggctgaggagggtggatcacctgagcccaggagttgcagaccaggctggccaacatagtgagaccccatctctgaaaaaaaagaaaaaaagaacagatgcctctgggtgggtaaccacagaggtttcctctgtctcaggggtcacacatggcgagggaaggattgatgggcatctcagtgcaggctggggtggaggcttgtggactggggtgtgcctggggagggccctcagagcctacatcatctgctgtggatcagtggatgctgtcctgccaggcgctctgggaagggcctgtggtcttgcctctccgttggcctctctgtgtgcttcctccacaccctccacctcccctggtttcctttaccacattgaagttcccgcaaatcctgccgtaaggagacctattcggggctgagagccagcccgtcctgcccccaggctcttctgtccttggctgcctggaaactctcctaatgtcctgcacagctggcatccatcttggaaagagccagccaggtgtggcctccaggggcttgttagagtctcaggccccacccagggctcctgcgtgggagcccacattttaataagatctccccgcattttaaccggatcccccccattttaaccaggtcgccccacattttaaccaggtctcccaacatttgaactagatacccgccgcattttaaccagatcccgtgatgaggtgtgggtcccggttcgggaagtaccagtgtggagcaggtgttggcaggcacgttccacgagggccagacaggagctggtcccagcgtttcgggcccggtgtctttcgtagccactaaccctgccgggtgaggaagcagcactgccctgctgccctctgagcacacagggccgggtcccatgagctgcgtagacactgaaatttgagtttcatcttcacgtctcatgagatcatcctttttgaaatctttcctcaactgtttgaaagtgtaaaaaccactcttaggctacacagaggtaggcagtgagctggatctggtcggagggctctttgctgatccctgacctgtagcaaggtttggctgtgttcagtgtgttcaggggtacgtgcaaggttcactctcttgtgtcctccttagggggtgggctggggagggcggcagctgccagagaaggccttcagcccctgcagagccacagtgtggggcatcgtggggcccctgcactgggcttcaactcagagcagacgctgggggagggcgaggcgggagtgggctctggattcatcgtgtccgcccccacctcccagccagggcctgcctggggagggtcagtgctgcatgatggcgtgttctcctcacccccagaaaccgtccatgtttgatgtgagccgggagctgggctccagcgttgcactgtacagccgcaaagtcctcatccagaccaaggccacggacatcctgcccaagtggctgcgcttcatccgaggtacgctgctcagagtccgtgagcagtgcccccgtggcccagtgtcgcccgctgcatctgtgagggaccgtgctgattccattctcagcagccctctgcagcgagagcaccgccgtcggcctgcgctgcctgtgtgtcagtcgcgtttacagaccccgggagctgccccacctccctacgcacatgactgatctggggggagcactggggtgttcagattgaggtctttccatatgtagggatactgagtttcagattgatatgtgagttgtgttacgtttgagtgagattatagtttaagaaagacttcagtatttaagccttggtacacagaggtgcgaaccatccctgatagagttttgtttgtttgttttttgagacgagtcttgctctgtcacccaggctggagtgcggtggtgcaatcgtggctcactgcaacctccttaagtgattctcctgccttagcctcccgagtagctgggattacaggcgcccgccaccacacccggctaatttttgtatttttagtagagatggggtttcaccataattgccgggctggtctcgaactcctgacctcatgatccgcccacctcggcctcccaaagcgctgggattacaggcgtcagacactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctggggacaaggcccctacctgctcctttgcccccagagggccctagccgtggcccatggagctgagagcagaggtggtcggggaagcccggcctgcacatgggggccctcaggagccttccaggtgctggcctggcctctgaagcttgtggtccagaagaaggtgggggtggctggtcatggctgaggctggagtctggatagggggaggggccgcagagccagacctgcccacctgtgccccagggttgtgactgcagccctgcagcaggccagccctgtgtggaggggactccagtgtgctggctccaggttctccatcagtagctatcacttccccactctggccccaggctcaccaaatagtctttattcaaaacctcgcttactggctttttttcccctaatgcaagtagtatttccttactagagcacattcaagtgacctgtgctctcacctagagatgactgctgttgatggtttagggtggggtagattggcagccacatagggcaggtttcagagggagcctgtggggtgaggattcagctggaatttggagccctggaggtctctcaagagcccaccacgtgcagcatgccatggaacgggccttgttggagcccccaacgtgcctgcagtgtttctctgcccaccggtttctctccagtgttgaaatggaagcagatcctcggaaaaaggatgagtctgggtaattggtgtgtgttggggctgcgctgtgggcatggcgagaggcccacaccgagaggcactggtcctcagagattctgtcctgtgccgcgggcaggagcaggtctggggagatggtgggcagtgtggtttcctgcctggtgggtccatgcccagccctgcgaggtcacatggcctgccggtgatatcctcctgcctcaccttcagaggcagaaagccatggagatttttttcttttttcaaccaagcaagccgcagtgatgttttattggttgactgatagggtctttcttgttgtccaggttggaatgcagtggtgtgatcacagctcactgcagcctcaacctcttgggctcaagcaatccttccacctcagcctcccaagtagctgggactacaagtgtgagctaccatgcctggctaatttttttgtatttttttgtagagttgggatctcactatgttgcccaggctgatcttgaactcctgggctcaagcgatcctttggcctcagcctcccaaagtgctgggattccaggcatgagccactgcacctggccacttagatttttttttttttttttttttttttttttgagacggagtcttgctctgtcgcccaggctggagtgcagtggcgcagtctcggctcactgcaaccttcgcctcctaggttcacgccattctcctgtctcagcctcccgtctcagctgggactacaggtgcctgccaccatgcccggctgattttttatatctttagtagagacagggtttcaccgtgttagccaggatggtctcgatctcctgacttcgtgatccgcctgccttggcctcccaaagtgctgggattacgggtttgagccactgcgcccggcctgtttttgtttttcatgcaattgaattcatattgcttatactgtttccttttttctacctagtttatttgcaccacttcccatgttgttttttggaagcacttttaattgctacatcatgggacatcacagggatgtaccatagtttactgatcccgtccctcggggctgcacagctgggctgtctcagtgtttctgcagttatgacactgcagtgcatgtttatctttgttctgaaatcttttttttttttttttttttttttttttgagacggagtcttggtctgttgcccaggctggagtgcagtggcacgatctcggctcactgcaagctccgcctcccgggttcatgccattctcctgtctcagcctcccgagtagctgggatacaggcacccaccaccacgcccagctaattttttgtatatttagtagagacagggtttcactgtgttagccgggatggtcttgatctcctgaccttgtgatctgcctgcctcggcctcccaaagttctgggattacaggtgtgagccaccgcgcctggcctgttctgaaatctttacctgcagctgtatttccttaggatagaatactaggggtggggttacttggtcggaagatataactatataaaaggtattttccttgctgactaaagagatgttatataatcaatgaaaagggggcctcagtgcttgtttccccacacagccgtgctggcttctgacagcaggaccccgacttgctgccgacatgaccacagggcagcagttgtgctgacctcaacaggatgcatccccgccccacagcagcgactgttctgtggtcgttagagtcgtgctctttggtgtactgaccctgtgcacttcgagtgcgcctgtgggttactggtgatctgcccaatgtttcagttcacttcagtgaagagagggcttggggctgactcccggattattattgctggtgctggagttgtccccaccttgtccatccccatcaccctgcccaggagtggccacaggaggggaggttccaggtacaatgtccctgggctggataaggcaaaggacacccactgaactgaggacacgtctggcctcatctgggaagctcacggatgaagtggaggcaggggccaggccctgtggagagggagctcctggcgtccctgcgggccgaggcggctgcgttcctctccccatcctgaatgtgtttcctgagtatttcttctccactgagaactgtgctgagcctgcataaacacgtgtttcatcctgtgaggggagccgtgagtcctcactcatagttgtggaaactgagtcacagaggggtggtcctgctcagtaagggagctgcattcctggctgtggcaggcatgctggcccactggtagtgcccgaagctgcagagcaggggtcctcatcccagcttgtggttgtcaaaggttgcgttgtcagtctgagaactcatctcgatcagaaaagagtcagccgaaattagagcttttgaaagaatcacaggcttaaaagttggaagcatggtaccaagaacatgtttttcctcgaatcctgtgagaggaagttgccttctcgatgcctttggggtgcatttccaacaaacaaggatgtccttccctttgtaattaacagatgttataggtattttgaagctatgtaaatgtcacattcttcatgaaactctcaatacattcatttatttacttaaaatatttatgtgttggccgggcgcggtggctcacgcctgtaatcccagcactttgggaggccgaggcaggcagatcacctgaggtcaggagttcgagaccagcctagccaacatggtaaaaccccgtctctacttaaaaaatagaaaaattaggctgggcgcaatggctcactcctgtaatcccagcactttgggaggccgaggcgggtggatcacgaggtcaggagttaccagcctgccaagatggtgaaaccccatctctactaaaaacacaaaattttagccagtcgtggtggcaggcaggtgtaatcccagccactcgggaggctgaggcagagaattgcttgaacctgggaggtggagattgcagtgcgccaaaatcacgccactgcactccagcctgggcgacagagcgagactcatctcaaaaaaaaaaaaaaaaaaaaaatcagccgggtatggtggcaggtgcctgtaatcccagctacttgggaggctgaggcaggagaattgcttgaacccgggaggcagaggttgcagtgagccgagatcacgccactgcactccagcctgggggacaagagcaagattcgtcggatggaaaaaaaaaaaaaaattgatgtgttatatttatactatttataatttatttatatgggctgatttcctgttttattcaagagtttataatcttgctatcattaataaaatttttttatttttatttatttatttatttatttatttttgagatggagtcttactctgttgctcaggctggagtgcagtggcgaggtattggctcaccgaaacctctgcctcccggattcaagcgattctcctgcctcagcctttcaagtagctgggactacagtcacccaccaccatgccctggtaattttttgtatttttagtagagacgggggcttaccatgttgaccaggctggtctcaaactcctgacctctggtgatccgcccgcctcagcctcccaaagtggtgcgattacaggcaggagccaccatgccccgttgattattcttagcacggttacccatttgaccaatccccctccatgtaaccaatctaccattgccactgccctcttctgcgggtgtccctgtcacctacttgggctctgactcttcacggtgggctggtcacgcccccagcctggacacccttctctggggttcttgggctctgacacccataccaggctcttcccaaccatggccctgcatagacaccttccctgggctctgcaccgcatcctgggctactgtccccccgctcccaggcacgaaggcatgtcctgtcccattctgccctgtggctgaaggactgagtcactggggatggagtgtgggaggaaaggctctaaatgaactcgagagagtgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggtataggagctgtgttccaggcctttttctgggccaccttgtccctggggctgctgaggaagctggtggaggtgtcccctgatgtggcgacggtgcagctgggtaccctggctgctgctgctgctgccaccagggtcaggaaatggaaggccaggcttctgggcctctggcaccttccaggcacatccttaccctcccaccagtgctgtgctgtgctctgaagggctcagcctcactgctgtgtgaaggtgcagcccagggagtggcaggaagagggcgtgcacacactgtctcccctcagaggatgttgggggctggggagccacagacaggtgggacaagccaaggactccgatcccgtgggtggggaagtgggtggtctcagtgtctgttgagggactattcatcatgtactggatatcagtctccaaatactatgctacaggggccagtcgttcagttaatccaatagtggatggctgaaaaacgaaacatttgttccataaacattttttgtccattttttattgagatacaacttacatagcatcagattcacagaattcaccttttaacacgtaaaattcagtggcatttagtgcattcacagtgtggtgtggctgcctccactgtaaccccagaacatttcatcccaggagcccatcccgtgctggtgtcccttctccccagcagcaggaggagggtgaccacgtgtgtggggtcccaaggaggccgtgttctggttgtttgccgacttcggcagcttctgacacaggcctcttcattctcctttatcttcatttgagttaacagcacacaggtaagagtcagagacatttctaggtctttgtaggtgtgcacgtgtgacatgtcttatcaatgcagacccaccatgtgtgcaggggtggcctgggccctgctggttgggtgtccagctccttgcttttccctctttctgttttccccctgcgtccttccagctgcagctcccatgagctctagaggtcacagctgcgttcagctgatggggaggagggcaaacccctcccctaagggcccttctccaaatcccactgaaacccactgggcaaagccagtctctgccatagccagctgtgaggagggccgggaaccgtggacttcacccgtgtccgtgtgcccaccagagactgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggtcggcatcccctgctctctaggcgtggggctggtttccactccccgcacgcctctcctgccccgcagcgagggcttcctttgggttttcgtcagttgacctgggctcagccacccccgagaagagccttgtgggagcaccctggtgactggaggaaggtgcctcctggtttagatatcaggggtctgtccagtgctcctgccacggtggcttctggagctggcccagcttcttgagaggctgtgtatttttttaaagccctaaccaagttgtatgggcctcaggcaacctgaagcatcctttgaggttttacttttagatgaaaagcatcttgctagcttgtgtctccatcctggtgggagaggaggtgggagctggaagcatgctgcgtggcccccatggaagccggggagttgggatgcaggcctgagctccctgtcgcctgctcttccgcagccgccgagtgcctatcagagaaggagacggaggagctcatggcctggatgagaaatgtgctggggtcgcgtgtcaccaacgtgaaggtgaggctttcccggggatggaccaccacttggccgcagtgtccctaacaggctggccagctggtggctcccagtacctggcccgttgggtgtccttccagcagcagcagaagcccttggtgtcaggtggagaccctgtgggtccctgctcggcacgtgttgctcgggagtgccgctgaggcaggaaggccgtgtctttctcccagccctgctccagagcaggtgtgaactgagaactgaaaaaccagcatcctgagtgggagctgcaatggctgaggacgtgggggttccaaacaagggacatgctaccccagccctcaggagctcacatgctcacttgggtgcttagtcgggggttttgggtgggcttcagagagctaagactccccccaccaacctgtctagctcagagtgagaaatgagcgtcccatgcatggtcacttggaggaaggggcctcatgcagggtgggctggcatggagcagaggacgatggattcgggcagctcctggaggcagcagcggggcaccagggtggtggagcccctcgggcacagtatctttgcgtggggcatcagctcagggcccacaagttagtgggtaatggggagggagcagcgctggtccaggggagtccttgagaccccgcctgctacctcgtggtctgggtgaccttcacccctggtaagatcctgccagccctctcacattgggaacctctatcaccctcaaccccgggctttgctcacaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggtgaggccacgctcctggctcttccagcctgtgggattccccagaatcctgtgtgtggtgttcttttgttgtggaatgtgacacagaagaaaagtgcgtgaggcctgtggacatgtgggtaactataaggagctgtatgcagtttaggctgcacccatgtgaaatggaacctggccagccccttaccatccccaggtgtcacctgggaggttagccacatcccagcctgtgaccatgtcctcgttttgctttatggctttgccacctgtgcgtgtcctggacatgctcagttttgcctgttttgagctttgtacgtggatcttggtgtttgctgaagtctcacgttgctcacttggcatgagggttgcccatgcagaggggctgccacaagttcattttcatagccgaataatgtccgctgcagaaacccacctcggcacagcagactgctccgttctgctctgctgggcctccggtggttcttggtcagaagttgtggagagccaggctgctctgagtattcttgtccacgtgtctggggcttgtgtgggtttctctgtggccccggtggtgggagctgcttccagggtgcaccgagaaccccccagccctgacagtggctgagccgtaagatttccctcgtttcttcctgttgttctttatatgccctttatctgttgtaaatgtcttttcacctgcctttaggtatcttttgagtttctttctttttacagtatcacttctttgcacccatgaatgtgatctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacatgttaccaaaaatagaaaacagcaaaaaggaaatcaaaatccatagacttaccaccccccccacaatgtagcctaagtagtattttaatttttgagacagggtctcactctgtcccccaggttggagtgcagtggggcaatctcagctcactgcaacttctacctcctggcctcaaacaatccacctgccttagcctcccgaagtgctgggattacaagtgtgggctaccacccccagccagtttttgttttgttctttagtacatgtctagtttttttcttttgtcattttacaaccataacttttaaaattatactggaggcgagggagatgcatcttcctagccatggcactcctggggaaaggctgacttggcttatggctgtcagtgcacagcagcgccagtatgcagaatgcctgtgcctctgctggagcagctcagtgaggcggacaccaggtcactttaactagttttggtggcaaactagttttgtgagatagctgcagaagtgctcgtttctgtctgttgccacttcacttttggagacagggtcttgctctgtcacctaggctggagtgtaccagtggcgccatcagagctcactgcagccttggcctcccaaagtggtgggattacaggcgagagccactgtgcccagccagcttcactttcatttgttttaaaatttggtgttctgtccacatagttcagaattcaaaactgcttacaggggaaaatttcctcctacctgtgtccccagtgcagccagcattagggcttttgtatttctgcagagattatgtgcatttgtgggcagctgcgcccgtgggcttccaagggggaacttgctgtgcagtgggtccttgccttgcttttctcccttagggtaactaggtgacctccacattagcatattaagaatgtcctttttttccagctacgtagactagaaatgtgaggatgtgcatttgaagtgtttcctctgttaggttgggtgcggtgcctcacgcctgtaatcccaacattttgggaggcctaggcgggtggatcacttgaggtcaggagttcgagacctcatctctactaaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcctctggagaggttgtacaaatttacagttccccagagccctcggttttatcagacttctaagtgaaaaattataatattcatgttaaggttaaatactacatgatgctttttcctatgcagaaaaaaatattgttctgacgtcaaatatgtcaatcattctttactttttggtttgtggttttgcttggaaaggctttccccttctgagatgatgaaacatttcttccctagaattgtgcttgtcatctttgatccctctggaatttactctggtctaaatggttttctgcatggctcccagtcatcccagtgctgctggatggagtgatctgtctcctccctcttctgtgaaatactgtcctcatcagacactcagtgtccaccctcgttacatggagttgtttgccttccccctttccagacctaaactgttttatttactagagccctataatatgtttcaacatgtgggtcttactcccttctcttttattatttatctaggaaccaaggcatgtcttcacgtactaagctccttttgtccctttagtgtatattaatcttggagtttggctaccttacagcattttctaatactgacactcctgattctcttgggttttctgggtatataatgatattatctataaatgatcattaacataccttatttaaaaaactacagacagtcttactgtgcttctttaaatatcctgataatcccaaaacatgaagggagggtcacagcacgtggtactgagctgctttttctggtgggttctgtgttgcaggcacgcgctcatcaagaagctgaatcagctgcgcgcaagcgagcctggcctggctcagctgctggtggatcaggtgagtgcagcagcttaggatgactgcagggacccaggctaccagccctgccagcctgccttcagggtggaacagcggtttcctctaaaatcctgtctttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccg

SEQ ID NO: 35860 - DNA, 32327 bp, Homo sapiens
gaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggtaaggcgagagagagaaaattgaggtctctagggcaacctccatggaaaaaggctggctgcgcccaggccagcgcgcccccctcgcatgcaccccgtatcaattagttccggggcctcctgagattggggggtagagaagaacgggggcgggaggaggcagaaagagggaagaacaaacggcggcgagatgcaaacttttcttttagtttgcaaccgcgtctttcacgttggcatgcctccgctagcattgcaaagtgcgggctgctccaactggtcctgcaggctgctcgcggatgccagcgcgggatgccagcgcggcgccccagcgccttagcgcgcaattgttctggcagcctcgcgccgcctctcccccaacccccaaccgcctccgcgcggggcgatcgggagaggggccccaaagtggcttctttgcggggaacccagggactggcgattcttcccaaccaagttctgggccgccccgccgattctagcctgccttggcggtggcggggttgggggggtcggggggcggggggaagctggcggagacccaaccagtctggtggctgctggggcagctggaggggaaggcagccctcgtaaggcagcaaacacgtacccgcccctcgtctgatgcaagactgctccgtgctttcgccgcccctctgcctcctgggagccttcggaggaaagggaggcgggcggggagcgctggggtccagatttagcctcctccccacctttggtttatcgctggttgggagtgaccagactcgactagaatccgatcccaaacgctcccagatgatttatagtcttagcaaatttttatctccttttgttgtgatatataattaatctacttcaaatctttatccaccgtgtttgaaaaggcctgctgggcctggtggccttgtccggaatatttattttgtgaactcttcactccagtgcctgcactttcgacctctgtagtcgacccagctgcccagtctctacctcacctgatccagtatattctcccccaccctccaaatcgcacaaccgccttctgcccgcctcagccctgtccaccaccttcagccgtctcctcctccgaggaccccttagaccgcagaggctgctgttgttgctttagttgtgccacaaccacgtggtcctggaaactgcctcgctcactttgtctgcctttgtatctgctggcgtggatcttgtcaccatggcatgacactatatccaagtatccagctctgccctgtactcagaagaatttggtccctgccttcaagaagtttgtaagctggttagggagcatggctaatacgcaggagacagttgagcagatgacacaagagcatagccccgaattagaccatccagctccctaacctttgcgtgttccccttctggaaaagccagagaaaggtccaatcatcatgcacagaattggtgggcaagggcttaggacttgagtaggattggacgggtggcaggctcctcacatctgtcacctcctttcttgtgtgaaattgtatcagtggctctggggaacaaccaggaaaggcagtggggtgtcctgcagaacagcctctgactctcacctccaccagagcaccaggttgggaagagggtggcaatcaagtgctttcacctctctaaaggaaattagaaacctgataccccagtgagggggtggggatagggagggatgagggcagaattgagaggaatgggaggcctcatccataatgaggggttgttccatgaagtcaggaatcagctgggtggatgctgggagtctggtgctgaaacttggagaacattttaaaggcgctgaaaactcttggcaggagaggaggagtgtttgttggctaacttgactgctgggcatttttggactgtttgggagggctcagctttcttgtctgtctttgcaacacatttggttcagaatgccaattaatctccttggtcagcccactgaagggtcctcatttctacactatgcctttttattctgcatgaagaggtgtctggcatagtgtctcctgccctcccccactgaagtctctttaatgctgaaggaagcttcggcagcgttgctagaaccgggcctggccttggttcccactgccttgtattctgggcaggcggtctcctctcactcaccccctggtcaggaagtacaatcattcctccctgccctttcagtggtgcttttcagacttggagcaagtcatagttcagtttaaggggtcatgacgagcattttaaaaaacaaagtaggaaatatcagacagcaatgcagatagatagtaaggttgtaagtattgtttcatgaattttgtttcatttatgttgtgtagttgtatgtgtgtggcatgtgagtatgaaattacaacttaaaaatgtgtttcttggccgggcgcggtggctcacgcctgtaatcccaacactttgggaggggccaaaggaggcagatcatttgaactgaggaggttgagaccagactgggcaacatggcaaaaccctgtctctacaaaaaatacgaacattagctaagcatcttgcacaagcctgtagtctcagctactgggggatggggtggagggctgaggccctggttgctgtcactcttcccaacctggtgctctagtgggaggatcgcttgagcctaggagtttgaggctgcagtaagccatgatctcgccactgcaatccagcctgggcaacagagctagaccctgtcccacccctccaccaacaaagatgtgtttcttacaatgaacctcagtcaaaaaagtttggaaaacgttggcttaaaataataaagcatcttgtttggaactcacatcttaaatatacctaatatgccggaaaatatttaaataatattaccatgtatcagtggcttttaaactttgactgtgacccacaataagaaatttgttttatgtcataacttaaacactcatacatatgtgtacacacagacacacacaaattttatgaaataatacttactctttttacatatgatgcattctggtattttcttctgtttcattaagtagcattgctggtcaggaccactaaactaaacactggtaatggtatttaatttactgaagcacatccataccttcatatcagtacttgaagaaagattaagaagggaataaatctttccatgccaaatttcttttcaaatttctttaaaataggaagttcccagcctttacacaaggatttagtttgcaaaagttaaataaccatcaaattaatcaggatcacacatcttgtgcaaaacagggtagacctgccttccctatagctggggaacatgacctggatagtttcattgtcttgccctatgatttaagtcagaggcatggcaatgctagaattacctcctaggccaagcttgtccccttgggaaaggaagcatgtgtgaacctgaggaatggcaatggattcccattgctgagttagcagtttgtctcgaacagccataaatcaagcagttttctagctgaacagcagctaaggacaggggagcgggaggacttgtaggaagtgtgggaagtgcctgttcccgccacagtgcagacacagaagccacacgcagagggcagtgaacatcagaatttggtgctgtgtagagagagacttgcttcctcacccaaggaatgacaaagagaggggaggatctctggacactggagaagttttaatcgcaaactgcagaggatgtgagcagatgggtgcatttggttagggctgtggtttccataagtagaggacaggagcagacagcttggggcaaagtctttgaagggggtgcgttgtggcgtgaggagggaaggggcttgggtgcaggggctttgagggtccagcaggaggtaggttggattcaggctgtctgtgaatatgtgctgattgaatgagtggatagagtgggtagttgaggttgtaagaggccttggaagctcattaactctgactgatgtgggatgtctggttctaatgtgggaccaaggtctcctgagtgacagtttctgcccttgggagaggtgagacctgatgctcatctgtaggagtctgactggggactcttagtttccctggcaccaaagaaggctggtttgagggaaaagtgaagagactacagcataaatctttacaagggagatccatccagagagtccatgctcatgaaagaaacaatagtgctgtttctgtgcttgttcaggggctacaagaatgggtggactttggggagtctgcatgctctccagctagtgttgcctgtggggagcaggtttgcaaggtttggggagcattttggcagctttggagagaacattgaagaaggatggacccttaaggcccaagggagtgattggtagagcctctggagcaggactgggcctgagatgtgggctctggaacttgatgctagagagacaaggtgataagatgatgactctgggtggtcccttctcctcttgctccatgcctgcttcttgtcagttgaactttgacttttggtcctgagctgaccacttgaaaggaggttgtgtttcctcagtgtgttaccaattttctaaggtgtcagtgctggctgcaaagaaatgaccactaaaaatgtgcttacccacccactgcccagttgccctccaaaaaggtcatgcagtgtacactcctgtttccctccatgctcaccaatgctgaatattattcattttctttctgccaaaatgatgcccaaaaatatcatatttaaaaatctatatttccttgatatctagcgttgaagagtctataaactagtgaaactagtgaccactttgtagttcttctgtgcattgcctatttatatatttatctattttttattgtgctctttatcctttaaaaaagtggatttgtggtgcatgcctataatcccagctactcgggaggctgaagcaggagaatcgcttgaacccgggaggcggaggttgcagtgagccaagatcgcgccattgcactccagcctgggcaataagagtgaaactctgtctcaaaaaaaaaaaaaaaaaaaaaaaaaaaaagttgatttgtaggaattctatcacttttggtgatgaatccttgttctgttacatatggtgaaaggagttttctccacatatcaggaccactacttgcttttgtttatgggatctttttccatgcagaagtttaaaatttgaatgtaactggatttgtcaatattttcttccagagtttctaagatttgtgccttgcttatgaaaggttttcccaatccgagtcataaaaatatcccctgacattttcttttaatgcttatatttttaaaaattctttaattcatctggatttttaaaaatctgaagtgaggtagcaatctattatttttcttcttgaattttcataacattatttcttgtttagttcttcctttccgcatcaatttgagttctgctttttattttctaaattctcacatattctgtttgtctagtgtctatttagttctgttgactgatttgtcaatttctgaacgtttttcctgctttttttcaacttcttttaataagatttttgaaaatccttgagcactcttagaagtagaccttatgcctccttatcacagtcaaaggaagggatttctgatgagcaattttcaggcatgtgaagtgttaaagttatttgggaaagagggtgaaggtgtgaggatgggggactgatgagggtggtttctaccggcctctcatcactgaattcatttattcaatggaagtgtataaaacacttcattgtgaagtatcaactgtgagcttgcctacaggccacaggcaacttgctcttctcgacagaggcatttgtgcctatttctattatcccccagtaggcaggctggctgggaggagcaggtcaccagaagatccagggacctttgttagggagcttctgccatcttggagaagccacaggatttctggcaatgtctctcctggtttaggtgtctaaatgctgtatttggaaggtagttggaactcaacagatttggacttgattccagcttctgccatatcctagctatgtgacttcagcaagttctctaaattctttaagtgtcagtttgcttgtctgtactatagggataattgtaatatctgtcttaggattgttgtgaagcacagtgctggatgtaaagtacttgctcaaaaaatggtagctattgttactagtaaatctctccaagggattttacagtttggtttttgcacctaactggccatggccttggctctggccctatcttcttgacatcttggcaggtctaccaactcttcttcagttacagtctcagagttagccagtggcaatgactttccagttcttggctggtttttgatctgtaagagtgaccttgggcaggttacctctcaaagcctctgtttctttatctggaaactggggatgattataccccttctccttggagttgtgaagagaataatgtaaagcaactggtgtaatgcctagtacccagcaggtgctcaataaatggtttatgtgctggtgaggctggtactatggatatatggtatagagtagataaagttttaatataaaatccctgcattaggcatagaaaatataactaaggagaccaaaactgcaggtctaagagaggacaactagatatgaaacatattatattggtgatcacaacaaaaatggtggggtgtagggagagtgacagttcagggttgttggcaaatgtttcctggaagataactttattgcaccttgaaaagtcagtaaagtgtgtccaggcagggaaatccttttctttggagcctgtgtggtggacttgaatgtggaaaagatgccagtatcctgtttctgcctggcttggctgatatttaactaggctgctatggggggaaatcagaatacctccaggtgctcacctggtgttggcctcagcactggggcagtcagcactgaggtggcttctgtttgattcctctaagccctgggtgcccatgtgacttgtatacacccaggtcataatcagtttagcataatgccagatacgtacatagcgggcatccgataaaatgaaggaagaaaagtacaggggaggggaagggaaagtaggcaggcttaactttgttgggcttcagtttttcctctgtaaaatggagttggaccagatgctggtgaacatttcttcaaatctcccactctgacgttctgcttcagaacctcagacataaaaggatttggagtgtcttccaggccgcctgcatgtttctctctgctggtaggcacagcccccaagcagtgaggatgtgtgatgcataaacacctccagaggaatcgttctactattgctcttgaacaattcttccagtgtttagaagctcttaaggcttaaatattctatgctgcagcctaagcatcattcctcttctcttcttagtggagataaaattacccactgctctccttacatttactttgtccatatttgctcctatgctctaggctcgtgcacaacaaacacagtgtgggcccttaccctagaagccaacttctcatgacctttctctatctccagaatccatgcagtgggaatgaaggtaaaagaaggttttcatgggatccagctgagagctctacggggaaaatggatctgaggagccatgtgctccatctcttttattttacaggtagagactaggggtatagagtgaggtgaattaccgcagtgacccacacattgttggcagacctaggattagaactctgtcttcctggttcccagcttggtgcttttgaaagcatacttgctgctttcttaccggcctggtgtctgccactttgggacagagtgtggacttgctcacctgccccatttcttagggattctcattctgtgtttgagcaagaatattcttattctggaaagaaccacataccacaggattctgggtgagcataaggaagattgtcttggggatctgacttagctcacgtatagtggctatgatgaattcagtgtcttattttttgcatatgtatatttttagtctaatattgcctgggtgtctgagcaagtctagatgaatttaattgctctcatttttcccctgcccctcttcctttggtctctcttttaggaaatgtttttctttcaacattcgtttcattcattatttactcattcggccaaccaacatttattgagtgccttccctgtatcagggacaggggcttacaaagtagaatttgatcccacctctgccctcagtagctcagtgtctaatggaggtagtgatgttcattaagcgtcgccagatactgtgctaggtgctgtgcctgttctctctcgcttgttcctcacacacttgagaaggccgaagctgattcatagcttggaaggcaggggccttggatttgaacccaggcctgaccaatggcagaacctatcagatgtgtggacagatgacattgcctttctttctttggatatatcaaaatcagccagcaggcaggaactcccattttgagcaagcaatgtgcaggaatgatagggtatacagagaggaacaggagatggcccctgacttccagcatgtgtctgatggacatccaggctgcaggcatcatggtgctgtctagagagatgagccaggtgcccagagcccatgggccaatgctgccctttcttgagcatgccaaacaaagcggttggtgtgttagaggcacagtctcctccactctaagtaaaaatcagcatgagtcctagcccacatttccctagtgagtataccaaagatatctatgaactggcagtcatcagtgacttcctaaggttccggaaatgcatctcttactcaggagtaagcaatgatgtgcctgcggctttacgagttctcacagaatgactttctggacccaaatgttttttctgcttcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaagtaagtcatggaggctgcgggcggtttgggggtaggggggtgagtgcggagactgaccacacctagggagaaaaaactcacttgagagaaagctgagtccattggaagggcttccaggaggatgcctggtctagggcctgcatggtcaacacacacagcatagtggtttcaaggtttttggaaggcagctatgctcaccactatatcaccaatgccatcagggtgttacacagtttttgaaattgagagtccctgcataatctcaaaatgtttcacgagcccaccccatgcgcagttgcttgcacctctgtgacctggttcaggaatcggaaggtcagtgagttcatctgcatttcctgctcccacccagccccctctgcctctattaatgctgtttgtggcaggtttttgtcagctctactttactgtgcttgtacagaggcacaacctttgctagcagactaatgactagaatccttgccctccccacttccctgccaccttctggaactaagacactagtttctctttcagtgctctagggcaagaggagaagggtcccatttaaagctgtttctgcagaaacacaggggcagaggtcatcagcacgccagtgctgtactgtacccgttctgtcacttagatggtatggcaaggccatccccaggcctctttgttcttaagacttttctcttcccttggggacttcattgtccttaagacctttcccctcccctgcactgcacttccccctgtagggtagaggttaattggtcacctgactgaagtcaatattcaacagcagaaatgttaaacgataacccatcccacattcttgccttggacccagaggcagccaggccccaatctctgcacctctacttgcgcccccatacagcctgtttgctgtgggaggatgagaagccaggtggttttgcaggcagacagactctgagagtccgtttatcttatacaggatctcttgactttttcttcttgtaaccttattaaccttcattccagagatgaaaaagacagacccagtaggggaataatcagggtgaacacgtatatgaaattctttcaaaaacctaaaaagcatttaagaaaagaaaaatagttttgtgggttgccacctctatttttttgtttataaaatgggaagggtctggattgccctgtgacttagggtgtgaggaggctttctcagttcagaacttgttgagagataggaagagtagtcagacaggtggagattactaataaaagctaggttggggctgcgtgtgggggctcacacctgtaatcccagcactttggaaggccaaggtgggaggatcacttgggcccaggagtttgagaccagcctgggcaacaaagtgagacccccatctctacaaaaatacaaaaaaaaaaaaagaaggaaagaaaagccaggtatgttggcaccagcctgtagtctcagctactgagaaggttgagctggaaggattgcttgaaccctgggaagtcaaggctgcagtgagctgtgatcatgccagtacactccagcctgggtgacagagcgaggccttgtcaaaaaaaaaaaaaaaaagccaggttgggtaacttgatgaagatatgtaggcattggactgagccctgaattcgagagactctgaccttggtaagatcaatggtaggagcagcagggaatttgtgctttctggaggcaggtagatcctgaaataggagaaagaaaagggctgaaccacacacaaatctgatcatgtgagacacttctctgccttgggaggagtgtttggatagagagaagccagatatgtttctctaatggaggtccctctgcagggaaacataaagccaggggaagggggtttctttccagcccttggcttagggcgagagtacatcagagaactctggacagtggcgtggtcagttcatggagcaggagtgagagaacacagcctgcactcaaggctttctcttggggaaggagtgggaatactgggtctgtgcccattgatgtcccccttttctttgatctttagcacccccaatgggaacagcctcagtgccgcagaactcacttgtggaatgatcatgtgcctggccaggtaagtccctgacttctcagcaaagctagtctctccgatatgccaattattaccacttgccaagcaaatggacccagaaaaacttagaaacatttcgtctcagcgacttgcagactgctaagaaggcgacatgcagactgcaaagaacctttaaggccatcaggtcctctattcaacattcattacacaggttccctagtgcacaaaggtgcacttctctttactcatgttctattctccatgctgcagacaatctgccttctctagcctccaactcttgcaaatgttctccataccctgctgcctggagataacaaggaaggatgttccaggcagcagggtatggacagtgtctaggtaccctctgcttacttttcaagattaagcttcagtattaatttatccaagaagctctctggcttttccagctaggctatgtccctcactgattcccctggccctcagggcttatctctgtcactgcccttacaaatctgtattgtaatagaatggagtaagaacctgcttcagggtccttgtgtgttctgtgggttcataacacaatggaactcaaatgggcaagactcttgctcttctagcaggagttccaggcctcttgagtggatggggcagcctagaaatcaaatggttgtggcacagaatgtgcttgagtctcagtgtgttggttagtaatttggcaaaactgattgcatggagcacttctgttgaacaggcaattcaagcatttatgtggtcaaggggaagaacaaggctcccaataaacagggtaggaagttgttctaggtccctttgaagctccatggattccctaaaccagcggacctaggcatcaaggactccttgtttctctactcaggcctgaaaccttccgggaccaagaaattacttttcccatggcgagacctgctttccctcctgctggaggaggatctgggggaatttacctctgctctaactcctccctgcagtttccatctgagctctctggtattcactgatattcactggtaggtgaaaggaggcagtggggggaaaggagaaacagggatagcttacacagcagtagggtctcagcctagaaggggcccccaggctggcagccgggttctcccagaacatctaggctgagtgtctctccccctggagaagtacagaagcctggcaccctggtttcacttcagctattaccttcagggatttttttttttttttttgagtaagggaaaagatctcaatgtggctttctgattaattacctcactttttttctggaggtggaaggaaaggattgggagccagcaatactttccctccttttccaggaccagctttgtttaaaggaatcggtgaaatgctgtggtttaaaagaagctccccattgtcaactgctcaccatgacctcactcatcaaaggtgcatcaaaactaggaaacacgcacaccctattgggaaggaatgcgttcgtttcatcagactgttcctagcagggaggacggtaggagagtgtgggtgcctatatgtagactctacaggattgggcaatgtgggtggagagcaggcgtggctgggcctcacagtagggactttgagcagatggcgggggctcctgaggtgcagaagaacagcacacagaaaggaaggaaggagagaatcaacaaatgtaggtttcaccatttttgcctgctttaccatctcctcctctagtaagtcaggccagcaaccatttaattattgtgaggaccctcgcccacattagagtcctctccagtctggcctgatgaggattccaaagcattgaaacctggagaggctccatgatcagctgggagcagcagccagagaaaagggttagggatttcttgtgttctgtggtgccgcacgcatacatcttagatagcactgtggagtctggtgggaagaaaataggatgtgagggagaggagagaggggccaggtggggctctgtctcactaggtcaaaggcattttatcaggcaagctttcccaagaagtgaacagttcctcaaggcaagtccctgtccttattacctgcctgatgggtcagagcagtgaggtgaatgcagcttgtcccccatgtggcttggtactgaagttcttctgagtttacccataagatcgtgcgcctctgtgatggaggacagattccaccttcagccttaccctcagatggagatcaatgtcctagtgatgtgtagagatgagagaatgtttttgtgttagaagttagtgaagtgaaagcacggaagtagcagcttgagatttctctttttgcacgctcgctcactctgaggtttttggcatcaggttaaaggcctacatttaagtactcaggaggctggccgtgctggggttgactttgctggctttgaatctgttcaagtgcctccagttgggtgatctggggagaactgtttaacctccagtgcctccctccgtgcagctgtgaatgttagaggagttaatgtgtgtctaaacatttcttttaggatgtctaaaataaagtgctccttaaacattgtttctcaaatcttccttttttgcctccagagatgtgttgatgacccatgcccacaggacatatatcgccctttgacctctaatgttgccctaattgccacttcctctgtctcctccagaaaacacagatgtagactcagacttccatctggactaataggaggagacaggctgtgaagagtgtgtgtgtgtgtgtgtgtgtgtgtgtgtgtgtgtgtgtgtgtgttggtggtggtgggacaggaaggtggtgcggatgtttaaaaatgttgggaccacgcattcaggacagaatggaagtgtctgggctttggcatccacccacccactctagggtccagactagtctaagaccctcggggttaagaaactctcaaggaagcataggtaattaggtgtcctcttcataatagtagaagacgtcataggttatggtgctggatgagataggtagatcaaaataattccttgagcttctggagtactcgatgtcatcagagttgcccagtaccccactcagttatccctacagaccctggaggattggcgatcgcttaaagtaaaaaactcactctggttgatgcctcagtggctgaggtggaatccatacctcctcccagatgcctggctggtcacagaaatcccaggctttctaagtcagatcttgccaagggtttctctcttctgttttccctttatcccccatcagtgttcctaaacctgaacccccagacccagttcttggggaagtggctgtcatgggcagtgactgtgcaaacctgatgttgcatctccttcctgggctggcgggagtccgaatggaccctctgaacctgtgtctatccttgcaggcagattccccaggcgacggcttcgatgaaggacggcaaatgggagcggaagaaggtgagcagcggccttgactcgccccacctgggctcagggcccggggtccactcatgttgctgacttcagcttctttccttttgcctgtttggttgcagttcatgggaacagagctgaatggaaagaccctgggaattcttggcctgggcaggattgggagagaggtagctacccggatgcagtcctttgggatgaaggtaagatgttgctggaaccctgtgatgtgggactttctgcagcaattttgggaaaggcagcatgtctgggcagaagccagaagctttgttctaggagggtctgaccctctcttggagcccccatctaaataagtgttaaagtcaaggagggagagaacactggcctgctgatctggactcaaaagctggaaatacttggtgggggtcctttagctctctggtgagtgaatagccctgagtcccagtgaaccaggtgttgatggctcttttgagactttggttcctgtcttcttagtttaaaagaatttaaacaagagacacggtgcagcattgaggagtttattgcaaaggaaaaagaatattttgaaagttaagtgcagagtagacagtacacctcgggagagagagaattcagggtgggctgctcataagagtgaggcagtgttggccgggcgcggtggctcacgcctgtaatccagcactttgggaggccgaggcaggcagatcatgaggtcaggagatcaagaccatcctggataacatggtgaaaccgcatcgctactaaaaaaaaaaaaaaaaaaattagccgggcgtggtggcgggcgcctgtagtcccagctacttgggaggctgaggcaggagaatggcgtgaacccgggaggcggagcttgcagtgagccgagatcatgccactgcactccagcctgggcgacagagcgagactccgtcttaaaaaacagaaacaaaaacaaaaacgaatgaggcagtgttgattattgctggagaaactccctttataggagttttacatgattattcataaggaggtgggaagagctgttactagtaagcatgttttgggtggtcctctgggtgcacatgagtagtagctgtacattcttgttcatttggcacatgtcttattagcatcttaaatctccacccaggagtgtgttttttactattataatgagccagggggtcagtttgaggacaggaaaaatcaaagtgcacaggctgtctagatgggaagttccctactgaagatagctttgcttgaatgagctcagttagaatatgaataccgaggcttattgtgttgactataggatcaccaaggttgctgcacttccttgattacctatcctgcctcacagggagggtgcttgtgtcctgcccattctttctttccttcctgcttttgttttgtctgctttcctgtgataatttagaaaacaggaacaagtttatggcctcacagtagagccttacatccattgtccatctgtccttccagtttccctccatatttcagaaaagatttaaaagtgcttgtatgtacactatgatatgattgtagagcctatggtggctggaagacctcacaccggtctcagaaatcacacctaactcctgtcttcccccaggtctctgccttttcctactctgggagctcagtaggcttctggctactcccttagcctgattgcaaccctctggttgccatcagtagcagtgccacccacttgggctaatccaggagaccttgcaaatgagagaggcaattcagctaagagaggggatctgcagggcttcccagataggccaaagagatgaacccactaaggctactatgggacatctctctgttcactttctgttttagggaattacagggattatggggtcaaactgcagccaggaagtctttaaacattaggagatcagttttgacaaccagatcatgtcaaatctagaaaagtttacatagagctgctatggaactctccctttttctacatccctcctaccttcttagagttagaagggatcttaatagattaacccttaattttacattgacatctagaatttgtaagcttatgcctaaggactcatagcaaatggacagtagcctagagcctggtgagcatcccattgtacacattgaatattatcctctccctcctgcctccactccccatcttatttatttaagtcagccagatatctttcctaagcctctgcactgagaagggccaggtgtattcttgatccctggactcctgagagaggcagatgtagcccagcaggatcattgatcatgtaaacaaaccacagccttgccctctgtgcagggatggtgggatgccataagccacaaagagcactccctcctccatcctcttttgtaagggatcaagggtcaaggtttagtccatggagaattttgatataaaaggcagaggtcaggagttaagtaaaactaagagcactcatagccaaataggtgagcatttcattgatgaagcagtaactgggagacaggctccagaccagtggccgttccaaggctcctgcccccttccccagggggtcctcttccccatgactccccttccccaggcttccttctccgtggcaccactacacatcaatattcctggcaatattcttcatcatggagacttcggcagcgacttcaaccagatgaaaagccccacctcattcctgaatgattgaggtgctaggtaagcttgtctgtccatctggcactgcccaactctctaccctgggatgcttccaagaggtgcatgggtacctgggaccttgagcatcagtgtcaggaaatggctgacacctctcgtgcatgtgtttgattgaaagagatgtctacggcctgctcatttcagtgttaatctgtgcctcagagcaggtcacccactgaatgttttattcccattcccagcatggtgtggagggtgccagtgccttcactttgcatttcttctgtccagatgtctctggagggtcattcttaactgtcttgcttccagaacatgctctttgtaaacccctgaaacatggcttggatcattccgtctcccacctcagcccctccggagctgcctggacctcatcattccggagagtctaagtggcctcttctcgtgctcagctgcttacctcaaccacgtcattatcatacttttgagtctggatgaattttgtcttagggcggagagctcatcagttctaccggtcttggagaacaagattttctaaagggaaaggaagattcttgaacatattgtgaaagagatgtataagcacccagacaggaaatgaggataagtgtttattaaacacaagttatttcatactagcctcatcctctttttggaaaccattattaaactggtagagtatggaaatccctagatgtcagatacccggactatttaaagttatgttttaatcatgtaataaaggaatgcattctcatataaattaaaacttggacaaggctatacttgattaccatctgaaccctagtctcctcacggtaaacatcagtttagcatgtcatccgagacttttctatgcatttgcacagaatgcatacagttccatgcctgtggatggattctttggctgcaaacaatagaatattgtttgtgatgttaagaaaaaaacatgtttatctcagaacaactaaatctagcatatttttaaacagttgtgtggaattttattgtgcagataaattgctttttatttggccattctctcaatgatgggtatttagattgtgtatagatatggactttggtaagacatctttcatgattccctcggggttcggatggagccccttgagcttggtgctattgaagggattagtgcttggtgctgttgtggaatgggccacctcagtttggagggagatagtatgcaatagtgctccaccttgcccaccattctcatcaacagcctgaaccatgtgtcatttgtggatggcaggaagcaaggagaggtagttaatacttaagggtgcagaatcaggtccaaaaagacatatgaaggctagaatggttgggcaccctcacaggaaatttagctagaatacatttctgcaccctacttgtgggtccaaaaagcagctagacaagttttagatgtagaagcatttgtcaaaagcttttctgggggagcagggctttggtttacaaaagagcagtgtggttgtcagtggcatagctgatagaaaaggtaacctgacatttggcagcattaaaagaagtatggcttccggagcaagggaggtgacattcctcacactgtggcctgacctgcagcctacctgtggtctgagtcatacaggtcttaacgctctatactgttgtgtctgcgagagactttttctcaatagtgttgctgaatgacaggtcgtgacctcagagactcagctcattcatgctggtgtgttccttagaatgtgttaagaggcacaaaccaatcaagaagcgagccttgtgctttatgatcaaggttttccttgagggaacagacaagcatctcttaacagtttctttgtagccagcgttgtgatgaatccaactttagcccagagggttggatgttgaacctgaggcaccagttatcaccgattttttcaggtccagctaatgtttgctgaggtctactgtgtcggttcctgtgcttgaaatgactctgcagggtcagaattattatcccaggtttacagataaggaaactgaggcccaggaaggttctatgatatgctgaagataatgcaactatgaactggtgaatttcggctcagccttccaggctggcattctttgcccagtaccacttaactttattcatgatccattttaggtaaacagtccctgtgccatgccggtatgcttagctattccaaagacagatactctccaggatgggcagctcctatctcagtgtgttacctggaatgcttactgcccagagcagtgattctcaaactcaagagcctcgggttctggcaaggtgccttagggacacaggtgggagcaaggaggggcccagggagacagcaggtggtggcacattgagcctttacctctgcagctttgaattgacctatttttatatttgggtctctgtttaagatttcattgccgtggtagggagagttccaatgctaaactaaaaattcagctgtggggcagagagagcacgtgacggtgagggttcttcttcagagcctctttaactgggaggcctccttgctctcctctttgctctgctgagccagcaaggccctgcagccagcataccagcctctcagggctgtcttctgtgacctcaggcaggtaggagccaccagctgccctggagtcctgcttagaaagtgaggcttcctctgttgcctcaacatcaggagtctgccctggggctgggattgaggtgagggaaccccttcatgtttctccccaaggcttctctccgggagtagtctttgaatggtgggtacccagaggtgctccaatgtctgtatattaggacatctgaccctttccaggacacaccaggaccctgacaggcacgtgtgtcctgggcctgttgtcaccctttccatcccctcagtgttgtctcctagtgtcggaaccccaacccccagctgagttcagctcttctctgccctggttatctcaaatggaaaatgagaacagaggtttgctcagccagattccttccctgcagtcatctgcagataaatgagatactctctgtgaaagaaggaagctgagtcagtgcttcgctcacccctgaggaagatgctcacctgctcctctccccaaccccctccctccagccccagtcacctgtctgtggagggggccaggttcagcctgcagggtccttcctcctgccagcccccaggttgttcttggctcctgagcatggagtagacgtcagtcaggctggaccttgtgatctctattggtgttcccttcctctccccactccatatgagaaaaaaaaatacatctggattagagatgaacagggccattgttctggccggcctcagggccagcagacgaagaagacttgtgacaacgatggcagggatcccatctcctcgcctggacactttctcctccccaccagaaatgagtaggttacagccgaggggagcagcagtgtctgaaaaagaccaccagcgttctgagctggaggttcttatagggcgtgggagaggcagcatctttccccaaaacctgcctgatggttggtgtggggccacttggctttccttattccacaaggctaatgatgaaaaaagggatccagaggcttcaccttaatcataaccattttagcttctgccctagaattactgaatttgaagtcctctttcctattacgttcttttttattttgttttatttttttttttttttctgagacatcttgttctgtcacccaggctggagtgcagtggcacaatcttggctcactgcagcctcaacctcctaggcccaagtgatcctcctgcctcagccttctgggtggcacaggtgcatgccaccaaacttggctagttttttaaattttttgtaggggggggggtctgactatgtttctccagctagtctctgactcctggggtcaaatgatcctcctgcctcagcctcccaaagtgctgggattataggtgtgagcaatggcacccatctttcccattatattctaaagtatctatactgtatccctaatttcaaaagtaatttatgaataatgtagtagaaaacttgaaagcacaggaaagcaaaaaggagaaaaataattccactacccagagacaaccgctgttaaagtactatgctgtgtattctttgtttttgtctaatcctgggctcactctttacattctgtctcggggttaagggggatttctcttcaaataattcccagtgattgaatgtgagagtgagagatggctgcaatcatctgcccagctcctttatttagggttgaggacccaggtccaggggaactgacctgtacctttccacacagtgggcagtgactgggggaggacacaggtcaggcttcctgatttagagggcatgcagtcttgctcccactctgggtcctgccttgtacccctgttgtcctcctccttcgcttctgctcactctgttttagtacctgatgcacctgtttcctggactggaccctccagctgcagctgccatttctccttctccctttcctggctgtccgctccctacatgactgccctccctccctcaggactccctgctttctaaggacttccaagctccaccttgtccagacctatatgagctattgttgcatctgtgtgtgatcacagcatggaggcagacgcaccttcttttgagctctggctgtgcccctcctcattgtggaagccctgcttccctcagctctcaagcagacaagaacagtcccagcatcattgtgtggtcatgagaattaattaagctgatcatggtacttagtatatggtaaatagtacttagtatgtggaacatggtacttagtgtatggtaaattaactggagaattaattaagctgagcatggtagttagtatatggtaaatgctcaaaaaatgtttgccattcttaataataacaatactaataattaagaatgacacttcctccctctctcttgcttccaaccagactatagggtatgaccccatcatttccccagaggtctcggcctcctttggtgttcagcagctgcccctggaggagatctggcctctctgtgatttcatcactgtgcacactcctctcctgccctccacgacaggtaggtgtgtccttacattgtggattggtcacagaagccacagaccagttaacaaatgggccctccatctgggccttccccagacagtggtaaccagctgtggggagaggtccacctgggtcctgcagaggctggtgttttgttagacacccctacgttggataggggagggtgagccagctagaagtgcttggggtctaggtaagctgggcacagggacaaccagtgacccccatggatgctttctgcagcccctgcagggctttctgattcccagacccacttgaaacagtaatatctcaagaatttctaagatgtttctaaactgagtctggcccagatccataacagggactcctgccccagagcatctgaggaggaagagatgagagcaaagaggctgccgtccagcaggagagaggctctgggaaagagctggctcaaggaaagggaagacctctggaagccagggatgagcgtggggatcctggtgctgccccagcaggaagatgcttcgctttcttccaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagtaagtgcctggcagcctcagcgtcaggaggacgggagagatagggagcagagaggcccatggcagggaaagcctggcgttttacagaaagcctctagcttattgtctctttcatccatggtaaaaggagaaaactgtgttgccaaaaacacacctttgtggtttgaggagtccttgcggagcctggtatggaggcagctatgtggttttctgcaaaactcgggctttaaaggggacccagttcctggttccgggcttctcagactgctaacatattgacaaagataaagccacaaatcagttctgaagttgagggtctggagcaggaagagagggggctttagtgtatagttgagggaccctgatggaaatgcagtcccattgccaagaaaatgtccttttcagtgtccatgggcattctttttcccttcttctcttgctgggtggacagaagcccgaggatactggcagtattccctcagggtcctcggggtgggctgctttcccagctggagcagaggctcagcctcacaccagatccagtagggaagagtgcatttgcactcgaatccttttggctcctctcctgaaagatcctgtccccaacattggagcttcccctggtgaggaaggggaaaggacatggactttggattaggtagttgtggttcgcaggttactagctgtgtgtccttggaaggtcactggccctctctgagcccctgtagcactcactgtgtactcccagcccagggcacacagtgccttttggtttgtaaccttggtcatctttctcagctcttagatcataagctccctgaaggcagggcaagccttgtccatctttgtatcaccatcctccctaacacagcaccttctcctgctctcttcagcatccttgaaccacttgctggtggtacttacatggttacatgtggccgggactcacaggattacatggttacatgtggccaggactcacagggttaaatggtcaaaattcaatgggaccaacagagccctgaggagaatggccggaagatgcctaaataacatacccaagggcaatcttctcagtgagcagaagggtggaaaagacactggagggtggggtggaggtgccacagatgggcaacctgtcctgatgagagccaagatgcagttacctgcgtggagtgtcttggaagagcaggacactgtgctaaaagtccagcaaggcacatcgacagcaagtgctgcatggatgcaggggggtgagtttcggggaaaagcccagtaacaacaacaacagtagctcctattggtcaagggcctcccatgttaaaggtgcataatccccacagtaatgttatgagggagataggatcaacccatttcacagataaagaaactgaggcttagatcaaggttcacccccaaggcacctaggtggttaagtggtgaaggtgagatttgaatctggttcacactttgtgctgtgtccactctgctgagatggaacattcatgtggaagcccattattgagtccagtgaccaccctgacaaaatagaagtggaaggcaccagaactcctgactgccttccctccaactttcctgttgcctggggtggcccaagagggtgtggccagtccatggcagccaacttagaggtatctctttctgggcaggagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtaagtatcaccacctggggctgggggccaggagtcagagggaggagaggaaggaaggcatcttgtaggggctggtggcagcgtgggtgaatagattcagccctgggagctgaagataagggaaatctgcttgagtcagcactctccggagcaggtgggcgggagcctcccgtctccagccttgatagcagaggccttggcagcagagagcccggctcaggcctgttatatcgtagtcttgctgcagagattgtggcccttcccaggcccagcctctagagaaaggctcctttgttctccacatgccgtgggagtgaaggagtgctgcttgggtgccagctggacgcagccgcagcaggtggggatgtggttggggacggccatgtagaaatttgcaccctgtaagctccccagaccctgccttgacagcctgccctacctactcccaaatgagccctctgtgctggctgacccccttgctttccccaaatcaaggcataagacccccacttcttgtctttgcttccatcaagcccttcctggcatgtgcgtctcctacgagcttaacctgacttacacttcaagtcctgtctcattcattcagtctgtggatattccttaagtttcactgggtaccagacattgtcatagctcttgggagacacgggtgcatgagggaggcatagctctccttccaggggcttgctgcctccttctgaagtcttgcttggcctttccagccccttctcaattctgagaaccatgttctttcttgttattaaggttcagttccatggggtgtttttttttttccctaatctttctacttaacctaagttctaagttccctgaggacaaaaaaacatgacttaagcctctctgcagcttgtgtgggtgggcccaggccatggagtcaaagggtcaggaaaatgggctgggtgttcttggttgtcctggctgaccctcagctgggtgattttcgctggtgaggacagcactgtggcaggagagacggggattttggttctgccctcccacctctggattgagagcccagccctccaggcctctctgccccctccatcctgaggaaagaagggtgcctcctgctgcccagcagccccacacagtccatggaagtcagcagggctatgaccagcagcatgcgaggaggtcagcagagactctgacctgtctgcatcctctgtcctctatgctgtgtgggctcctcagggcagagcacacttcactcatcttgcacctggtcggcctctgagcaggttcgttcctcccaggagatgctgctcgtttcccaggctgaggtttgagctcatcaccattgccagccaatctgggcttcagggttttaccctttcagccttctcagaaagcagctgtctgccttccccatcgcagccttgcaatttattgccattaccattaggtagcagtgacattccagagcttttcctgaaagggactcctgaatataagctctggcagagcgagggggtgggggagggagggggaccttgcagagagatggggaggagggggtgagaggtgtatgggctctgccctgctgggtgtatctgctgcaggacacagagttccatcaaatggaccacacagtgtccccatcttaggaggtgaaacctcttggtcaaaataactacccttagcaaattgaactgttcacccacatcagcaaatagtcttagagtagccatttggaaaaagagacatttttgtcacataagaaatatattttcctaattcttccctgcattttccccagttcaattctgttctaacctcagacacagaataacattagggtcaggttggtgtcccaaagtgcctgactcctccctggaattctcccacctgtccaccagggaagactgagaatcctccttttacttgggagccctgtgatggacacctccccgggcttgggctctgcaggcccacacagaggacagagagatgtgccgaggtgcctgcgttatgggccctcttagttggactttcctctgctgctgcaggccctcagccccggcagtggcagcatggtgctccagatctcctcccagcagctagctgctccaccccaccacccttcttgtctgtgactccttggagaggatccaggagccatgcagcaagaagcctgcagacctgtcacctcccacactggagaggctcccgtgaagcccggcctcagcagtcatttcccataccatgattctttctctgtttaaaaaaaaaaaaattcttccaatgatatctttatgaaaacagaaagagaagcatctgtgtttccttctaattacatcttgtagctgcctgtttgatttgcatctttctaagatggttgactttacaagttatctcaataaaagtggccagatgcctaactcagaaccagagcattttgaaccacaaaatggaattgaaattttggcccagaacaagctggttctgttatcaggcccctgggtggggcagggggcagccagccaggtcctagacataacttttgggggatatggggcttgtgtcccctcagtgtcacaacatgcctcacagtggacttcgcatgcgttgatatttgaagcacgatcatcaaaactttgtgataattgatcgtagtgtttagtaacaatgtaaacacttaaaaaaattcaagatagaaaataaaaatgaaggcaagttgggactgccagagaagacccgtcactcctcatccaagttatctgcgactcccatatgttttgtgtcaaagactcacctttattgtgctgtccaatcccttccccagtgcagaaacaagtctcccatggagggggctggggcagacacagtttgctgaaaggagcaattttgagtggttgtggcattctgtgtccatttctggctccacagctttcttcatttgtaggaacaagtccttgtcctgttgttagtggctgatggaagttgtcacccaccaggcaccaaggcaggagtgaccctatactgtctttcttgtggagctgggtcttggcagccagatcttgattcaggatctgccatgcctcttcctgaccacagccccgctcctccatcctctgcaggtgaatgcccaggcccttaccagtgccttctctccacacaccaagccttggattggtctggcagaagctctggggacactgatgcgagcctgggctgggtcccccaaagggaccatccaggtgataacacagggtgagctggggaccttgcagagggagggggaggaggggatgagggagtgtgggatctgccctgctgggtgtatttgctgcaggacacagggttagtgagaggcagtgagggtgccttggaccctgccctgagtatagctcccttactactggtgggagggtggtaaagggaggggttaaaaaaagtcgttggaaagatgtactgaatattcataaatcatgtttatgtagcatttttaagacctagatattttgggtgcaagagaaacctctacgagagagagagtttcatgcgagaggtcgtaggatggctggagggaggccctaattaagcaacaggatgctggattctggtttttggccctgtctcttccctgctgtgtgactctcccttctgaggcttggattcttcacttgtaaagtgagagttaggggcagatgagccaggagcggtgaggacactttgtgctctgtaacttactaaggtggtaccttgggccgtctgacagccctcgagagagagtttgctcagccgtggagtgggaatgagaacagtgccctctgaccacccctcgggctgctgagtgggctgtggccacctttgcagtggatccagtactgtgcggatgtggttgagtgaccaaggagggctccagtttccttaaccctgtagacgtgtatctttccccatggactcttgggtgtctcacagttgggcagagattgcagggagagggcagctaaaccctaggcattgacaataccagggaagggcagagccagggggtcccactggcctgggtgtccaagcgccgaaggaaacaaggcagggagctgggcagcagttgcttcggttacttctttctgctttgatttcctgaggctggcaaggctctgagtgccaggaaggggtaagagtagggaattttcctgtgtcccctgggagaataataggtaggccaggatggccaagccaggtgcagggttggggagcggagtggagttgagctgagttttggagaggagtttctcagggtggttaaaacatcctgggtttcctggcttgggcccagattatgcctcttctgagcccactgaagggcgagtggacctgcctggagcaagctgcctttggggtccccagggcagcgaggagcccatagtccagagctaggtgccagtggcttcctgccccctcctgtagtgctcaacaaacagtgacctcatggtagcttctctctgtccccaggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtgcgcccctctcccccacgctgcctccccatccctgtcagcactagtcttctcccccacatttccagagcccgttctctgagcggaggcctaggtcccagccttgcatcggcctgtctacctgtgaggggtagctgcagtttcttcaactgcaaaatgaagatactgcctggccccgagtgttgctaatggcactgctttgtgtatgagtgctgtgggaatggaggcagtagaagtgtccccatttcacagccaaagaaaatgacgagctagtgtgtttgactctgcccgacatggctgccaggccatgtttgactctgcctaactcccctcagggctcctcatgccgtagcacccgggttcttgattcacttgcaagctctaggagccctgctgccttgcacggcttcccgttggcgccttcccctctggttccctgtttagatcaaagtctgtttcaaagcctgttgctcagccagtgggagctggcagaagggataggcagtagagctgccatgtcctcacccctctgctcccctccactcctgcatgccagtcatgccactgatgccgtgcaggaggctgtgtcagagcaggaggggccagagtggagtctcctcacagccctgcctccctgcttttctttcctccctgttttcctccaagccttcgcctgtgcctggcagatctctttgccctccctttaaggagatcattggctgttccaggaagctgatgccgaagggcacacagcttggcccatttgccctctcccttctggtcctgaattactgagcacattatccaggctggagccctacatcctaccaatgggtgatttggccaagagaggagggtggacgtggtgcagccaggaggtgtaacagtcaccttgccttctccacacaggtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggtgaggagggccctgtagggctggctggtgtccttgaggctggggtggggtctgccctggaattgaactctacccaccttcctttagcccctcttcatgtcccagggtgtctctggatctgcaccatacagagggtctgatgccagttttcagaaccttcagggagtggatactcagttcaaagagggaaagtgccttatccagggtcacagagcagcatggcaggggtggggccatagcctctattcctgcccagctgtggatcctcagcttgccatgttaggtacactggaccagcttgtggagccatagcccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcctaatttcaccattctttctggctgcccaagggaacttccctgcttttctcccttgctgttggctggataaaactggcaatcagaaagtcaagagctacagctgatggtcatggtgttcccagagagtcaggaatatccatggaagctgagcagatgccctgttgctctcccatctcagctctttgattctgagaccatcatccgctcattgcacctttgatcacaaaagctttgaacttctgattctgctcccaatccctcgctcctttttcccctatcccctgtgccaaccaggagtttcttctatttccaggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccc

SEQ ID NO: 35861 - DNA, 24404 bp, Homo sapiens
agccccgccccaggcgagggcgccgcacccacaccgcgctgcgcagttttgttctgctccagctgttcgaaggtgatccaggtgagtgctagcacctgcgggcagccacgagcaccgggccgccgggggcacttcagcctttgcgcagggcactcccatatttcagcctatgcgagctgaatagagacccgctgtctctaacctccccccacccttatcagtaaattagcgatctgaatttccaccctctctgctctccccttgccttgcatcttttccctggtggagtgggttgggagcgtctaagcgaggcccgacctatttatgtgtaactcaggaaaattctcaaggtcaacccttcctccattccttcctttcctctcctgctgtccccgggctctgcagtctgggggcacctttctgccttccggagaccacccgaccttgccctctgctgttccggcgcagaggatggcgagccggacactgccgggggagtggttgtgcaggcctgatcagtaacactggtttcagaagtggcctgtgagcaatgcacccgctgcggtggggatgtgttgctagggacggtcgggagagcctctgaaggaattgtgtttgttttcctcctgcctcttagaatcgtttgtccatttgtactgggaaggtggtcatttcctaccgctgacttagagcaagagacgcctctaggcgggtgggggactcttcaggttcttccttggatttcagaaaatgccccttctttatgtggggtggcagcacggagccgtagggctacagtagtggggcagttgcagggcggtggaaggcgctggagactccttagtgagtcattccccgaagttgtggcttctgctgatactttccttgagagtcacgagtttacaagctacataatagcgtcgggggcaagtaagtgtggaagacgaggtaaaggaaaagcagatactaggatgggtagaaggagaggcaggggttagaactttaattccttccctggggacaggagatgccctggaggggaaggcgcttccggctctgcaggtatgtgctgttgggcctaggtgtggtcctgcggaattgctgcagattttagattgctggtgggtaggagctgcagcgcttctcttgggaaatctgtagatcacctggagccagcagttctgggaggcaccccaggttattggtcagagttacaggctatattttatttcagtgaattcagagagcacattgagtcagatcaagaatgtttattctcataggagatgaatttaaggagttaaaactaacatataaaatagaaacaaatactttcatccctgggaagactttccgttaagcttccctcctgacacaatgttacggaaatagaaaactttgtcaagtgattttttttaaccaatgttactatatataaatctgcagggagactgtcgccaactatagaaactgcgctacaggggcctccttagattaaggaacaaaactggagaagggcagccttccgctttatttagatttcttcctgttggcttagagttctgaaaagacacaatcctggaagagatcctcctcgcctggagattagcaccgagaaggaacatacaggaaagaagggctttacccactattcagagaaatgctaaaaagcccctggagcagtctggaatgaggtggatgtcaaatcaatctgtcaaaagcaattcagtgcctactgcacatctatctgtatttaaacatattgtgccctatgtttatacttaaatcttctgaatctatatttagaacaccattaccgaccacaattgaccatgaaccatctagcattttaaagcaatatttgtttcgaagaatatactgctacggtttttgcagctcaatttattaatgctactgtaagcttaccatcttcctgaacaaaaaatttagcagttagcagcaagtagattatcgctatgtaaaataaaattcctgagtttctgtcactcgctcttacagtacctacctgcctacctgcctctgaggagaaacgctgtaattaggcaacaggaaaattgtactatctttcaaatgcatttgcaaatgcctttaaggattttatcctttagaatcatagatcttgctgttaccttctgagttatttctagagttgatctgttcattaactggaacttgcgttctacgatttagttgccttatttccacccttcatttttttttatttttttaaagcaaaaattaatttttttatttttttattccaccctttaaaaataagtaagtgatattttattttataaataaatgagcaagcaatgggagcggttgtaccacagcttcattctaagtgtagacaggcatgaaaaggtcgaacccctgtttcaggcaaaagccagcagcctaggtggttccttcctttggggtggttggtaccctaacgggcattcagcagctgctacaaattaactacagtctgcctgcatttcttgtaatagaaaattaccaagtggtgtcaatgtgactcattcgagatttttttttttccttctggaagtcatagcttagtttctcaatgactcttggttcctatgtaatgccagttaagggacagctatatgacatgatatataaatgaagtgccagtttctgtgttactttgctccttgcaaacctatatgcctgaaagattggaggaagttttttccttctcgtaatctctacttcttttgtcatactgcagtgctgacactcattaaaaagaaaacattccttgtttggaactttcccaaagttttttttttttttttttctccttccaatttgaaacatctcaggctttagtcagtggcaaaattgaagttaattgtttgctctctcttcttgttaatgtattttgtactcaggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtcacttaacctttctggtactgcgtttcttcatctgcaaaatgggagtaatatcatagggatgctgtgaggatctaaatgagttaatactgatgaactaactgcttagaacaaggtttgccccttactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgtcacccttatgttttatggtatggtcctgctgtgtttttgtcttccctgactgcatgctcactcgtgctctctctcaatcatgcgctctctctctctctccctccctccctctctctccctccctctccctccctccctcccccccactctcaactgtgtattctagagagtcaggaccttccttctcattcttgatcattctcatagtagccctgccccttgagtggaacatggcatttagtaaaggatgaataagggaaggaatcattctgagaaaatactgaagatgatagctatggacttgaggcaagcatcccatttaggtaaaatgctttgtccgacattgaatttatcatatcagcttcatttaatgcattatgagatgttgtctttatttttccttctgtatcccatggcttctcaccattcccctccccctccaccccgccctctgaggttgctgcctgcagaccatgggaaacatccagtgggttgtccctgggatcacatctcttgggaagctcagctccaaagggtctagcaaagcccagggcttctaggttaggtatctcccacagaaccttctgtgtcaagaatctgggaaagtttgtccttatacctgcaggggaacctggaatttattctgtcttgttataaatctagtattcttagattcctgaagaacagaattaccagttttttctcagaggagatttcatcaggcatgtgtgtttagtgccttattacacagaaggcacactccagagaagaagaaagcaggtaatttgcttatttggctttaacagagtttcaacagagttcgtgtgagtgcaagcttgtgctctataaccaagaaccattcactggaacttgagcatcctgctgatcttccctcccccactcccagccagtgcagccatgtattaagcaattgttttcagtaccaacagtttaccaaagtgttggaataaaaacgacatctaaaacttgaatattttatatggccaaactatggctatttaactatacagttgaatatatttggattataacatatttatctcttaaagggacagatcttccatcctcctaacatatagttagcttccactctccaaatattccaccagcaacattgatgaatattgaagactatggactgtgaggtactgtgaaagacccactctaggacctgcttgctgctatttgccttacttgaaccagtaatcaagtgctggataaataatatgatttctattcaactttttgtttttagcccttagggaacaatctactgaatatgcaatgcaattgtcgggggatagttacttttcattacctaggtttctgttccttcttttaagtgtaatttaaatctggctgtcatgaaggtttggcgctcaaacagattttagcatctgtttaatgtagaagtggactggaactagcattctgaaaatgtagtctgaacccaaagaaatcccatgactctccttttctgtcctatcatagaaacagataattacatttttaaagtttttgtgtgtgggtgtgtgtgttgtcattttgaggtggggtttcaccatgttgcccaggctagactcaaactcctaggctgaagcagtcctcccacctcagcctcccaagtagcagggattacaggtgtgcactactgcacccagcttaagttttactttgtttctaatagatatataatattggatatatttatgagatacagtgtgatgttttagtacgtatatacattgtgtaatgagcaagaggattgcgtttatgggccaggcacggtggctcatgcctgtaaccccagcactttgggaagccaaggtgggtggatcacctgaggtcaggagttcgagaccagtctgatcaacatggtaaaaacccatctctactaaaaatacaaaaattaaccggggcgtggtagcacacacctgtagtcccagctacttaggaggctgaggcagaagaatcacttgaacctgggaggcagaggttgcagtgagctgagatggcaccactgcactccaccctggcaacacagtgagactccgtctcaaaaaaaaaaaaaattgtttttatgttacttccctctaggctctttaatttctccattgagcattgtgtgagctccgctgagcattgtatggagggtcagctgccctggctggagatggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaaggaagattggaatagcacaggcagccgaataaggattttaatgaaacattggagaatggcttcaagttaatctgtgaatgctttgtcattgtcccatccctggacacattaaaaagaaaaaaaagagcagttgagaaattgcagtacaatttgaggagagcaatatcatacacagaagtagggactacttttgtcaaagctggattttatttatttgggagcaaagagagagagctgaaagacataatcttctctcccttaagaatctcattgtcatttagtaaaataaaaggtagtgtcacttcatggctcagaagtggtaaattatttgaggcaggtacccaaatccataaagcctgccttttgctttgtttgtggaatgctgattgtgtgctggggaatttctgatgggcagccaagaggaatttgggaagtagtgaaggagacctttaccccaggagtgttctattggatgtagttcaggaagctttctgggtaagccttgcaaccaaaggaaccctgccccagtaagatacgtcaaatggtggcagaagcaagaattagaggaaaggttgagcaacattttggtatttgaatagctgtgttcccaggaaactctgtcagtaaaatttctagaggttaagtaccttagccagatgtcataatgaacccctgtgttgctaactcaaatgctggaatggagcatgtgttttaggagttagaccaacactgcctcatcttaagcccaagtctgatcactcctaaactgaaactttgcaaatgtgtgtgttgtagcttacttaaaacccattgggtgtctgctaactctggctacactgaaaagtttttgctattctaccacccacggacgtcagagccctgctgcttaccagggcatgttagtctcctaatctacccctgaaaacctaccatggcccggggcttttctgctaccccccacgtcctataccctgcttgcttcaaaatactgttcctagttttcttcccctaacttgataatgtactccaaaacaatcatgtttggcaagtaatacactgataaatgtaaaagttacaaatagaagtgctgctgtgtttttaaaacattatagggccaggagcagtggttcatgcctcttatcccagcactttgggaggctgagagaggcaaattgcttgagctcaggagttcgagaccagcctggccaacatagcgaaaccccgtctgtactaaaaatacaaaaaattagctgggcatggtggcacacacctgtaatatcagctactttgaggcagaaggattgcttgagtccagaggtcaagcctgcagtgagccctgattgtgccacttccactccagcccggatgacagagggggaccctgtctcaaaacaaaaacaaaacaaaacaaaaacccagccaggtacggtggctcacacctgtaatcccagcactttcggaggccaaggagggtggatcacttgaggtcaggagttcaagaccagcctggccaacatggcgaaaccctgtctctactaaaatacaacaattagctgggcatggtggtgcatgtctgtaatctcagctacttaggaggctgaggcaggagaatcacttgaacccaggaggtggaggttgcagtgagccaagatcgtgccactgcactctgccactcactctagcctgtgggacagagagagactccgtcttaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaataaataaaagacatccacattggaaaggaagaagtaaaactgtctctctttgcagatggtatgatcctctatgtaaagtattccaacgatcgtggatctgtctctccctcccctatgctcttgggccctggctctgtttctctcctggagtagaagcctgtggtgcagcaggattcaattgccttcaattgaacgttgcagaggactttcccctcggtgcttcccgtactgggggaagaggtgatttaacttctgagtaagggacaaacccagtagtgtgttagtagcaaaaagcatggacactggcatcagtctgcctgtattcagacaccagctgtgcactcatcagctgtgggaccttaggcaaattgttgaatttctctttgcctccatttcctcatccatagaatggggataataatagtaactatcatatgggattgttgtaaggatggaaagtgttaaaatatctaaactctgttacagtgcctgccataaaagaagcactctaggcctggcgcggtggcccatgcttgtaatcccagcactttgggaggctgaggcaggtggactgcttgaggtcaggagttcgagaccagcctggccaacatggcgaaaccccatctctactaaaaatacaaaaattagctgggtgtagtgacatgtgcctgtgatcccagctactctggaggttgaggcatgagaattgcttgaacccgggaggcagaggctgcagtgagctgagatagcacccctacactccagccttggtgacagagcaagaccctgtctcaaaacaaaacaaaacaaaagaagcactctatgggaccaggtcttatagttaggtattatatatgtagtagtgatattttcagttttgctgtttctgccagatgggatgaaaaattccatgagaagttggctggaagtcctactgattcattaaataggcctttcatttgaagtcatgtttctaatcattcagaagttgaggtatgcctgatccatggtattagaagggatgatcccagagaggtcattctgtagcataatgagcattacttttgaaggatggagaacctagaactctgactcatttgactatgggaaaatctgatctggtgagtgaccatgaccatgaagtgagatctggtaacccaatggtggtcacaggatagagactctgaagatactgagctggcttacacacttgctttgttgtctcgaacctctgttaaagctgaaagaagaagtcagtcttctgctgggcacactgttagtgtgtaattgtgaagagcttagctggagcttgctcttcacaacagtctctgatctcatcagccccattctgttttcaggggtggtacagaaggagcacctcaggagcctccaaagatagtagtagaatataaccaccaagacaagactgtgactgtggttttgaatcagatagaatcaccacctcctgcaaattttgtttttgctcagaacagtggttcttaaaatgtggtccttgaccaacatcatcagcattacctaggaactagttagatatgataatactcaggccccacctaacatgactgaaccagaaactctgggactgaggtatgttttaacaaactctccaggtgattttaatgccaccaaagtttgagaaccactgatctaggatatagaacagcagcattctactgagtttctgtcttcatgcaagttgctataaaaaatataagcaaggagacacgctctctgtcctcaaagagcacatagtccatctagagaggtatactatattcaatgccacacaaaggaggccttcccagccgggatcctgatgcaacagccctgcccagtctctatgccattgccgtgtgttttccccagaagagttcccattcttggccaggtgcctgtaatcctagcactctgggaggctgaggcaggtggatcacctgaggtcaggagttcgagaccagcctggcctacgtggtgaaaccccgtctctactaaaaatacaaaaatgagcctggtgtgatggtgggcacctataatccctgctactcgggaggctgaggaaggagaatcacttgaacccagggggcggaggttgcagtgagcctagatcgtgccacttcactctagcctggggggaagagcaaaactttgtctcaaaacaaaaaaagagttcccactccctgaagctgttttttgtttgcatgtttgttgtcagtctcctgtcatcattcgaaggtcagggccttgagggcaggaccctttcttgttcactgctgcatccccacccctcagcagttcctggcatagacagcaagtgctttatatattctggttgaataaatgaattaagtgttctttgattcattatgctgtctacggtaggaaactctattttgcaatctaattagaccagccttttgccaaatttgaattattttaaacaaaatcagaactattgtgtaagagcatacaactgatttgtagaaaaaccagtatatcctcatttaggaactgttgcatatgtggacagacatgtacagttaccagtatttatttcttcatatttggaccaacatttattgtttataccaggtacatatctagtttatctaatttaattcttcaaaccacactgtgatataaatgggtagtattttccctgttttgtagagaaattagatacatcctaaagcttgcaggggctatgtatgaatacaggtctgtctgactcctcaattcctgctatctctagtcttgtagatttcccacaggaaaagatgaatcataaaacagtattgaagtccactaggagtaaaaacatttaggatctctacccttaaataagtgacaaaaactttctaatttaaaaaaatagataattcaaatttcttttaaacctttaatgttctcttgactgatctattttgacttaagactgccaacaaacagttaactaggagcagctacctctgcaattgctaataaggaaagtaagaatagaaactctttcatcctatttctgtctttccctacccatttattttgtttttgttttattgtgttatacctagtttgtgattattgctaggaagggaaaaatctggaattgggtacttgtttacttatttgcctgtgtcccctgctagaaaatgagtttcataaagaaccaacctctggctgttccctgttcgtctccagcactagcccagtgagtggcacatagtgggcactcagtaagcctgaataagtaaatgaatgcacgatcaccctcatgcagtgctgagcagtgtctggctgcagcaagagtttgaatgactgcagcttccggatgtccatagtcagtgctaaaatcctgcttccttctggctgcttctgcctttcacatgatagcatatattttaacatggctggctgctgagagttcagaaaaggaagaggatatatgtggttctaaactttgctattttaaaatggcagttataaattctaaaatgtatattcattatcatttagccaaacatccccgttgagtcaggtcaaggacagttaaccaaacattagcatatgtaacgtaacataatatataacatttactgagtccttcctatgtgtcaggcatcatgatgaatgtttatagacagtatgtccatctaatcctctcaacaaccttccaaggttatattagtatctccatttaacaagtgaggaaactgaggtgctgaaaggtgttaagtaatattcccaaggacactcaactaggaaatatgagaaccaggttctgaatgcagacaatttgattccaaaactgcattcaactgcaaagctgtctcgtgaactgcacttagcagataagtggtggtactcaagccagaagtcaggtctgatctttcggttccatcattccatactgcctgttcctctgtcttctcaatgaataatgattgtcaagccactctaagtttttttagatatgtatttgctcattttggaaattacagaaaattacaaagaaaaatctataatctagccatctagaaataactatgcttatgattttaatactttcttaatttttttctattattaagaaaaccaagattattctacatatacttttattttcttttttccccactcaacctgctgtatattgagcctgttttaacctctttaatatttgtacacaccatttttaacagttgtataatgttctatttaacgggtatattatttatttaactggccctctattattggacatatgtagtatttctggttttgccatcataaatattgctgaagtaaatatctttgaaccaaatttgtttgcatttctgattgttacctcaggatagatttctagtaggattaatgagccaaagaatattaatattaaaaagaatattactggccaggtgctgtggctcatgcttgtattcccagcattttgggaggctgagatgggaggatcactagagcccaggagttcgagaccagcctaagaaacataggaagatcctatctcttaaaaaaaaaaaaaagaaaaaatatacataggctgggcgtgatggctaacacctgtaatcccagtactttgagaggctgaggcagccgtatcagttgaggccaggagtttgagaccagcctggccaacatggcaaaacccccatctctactaaaaaataaaaaaattagccgggtgttgtggcgggcgcctgtgatcccagctatttgggaggatgaggcatgagaattgattgaatctgggaggcagaggttgcagttagctgagattgtgccactgcagtccagcctgggcgacagagcgagactgtctcaaaataaataaaataaaataaaaaaattttaaaaatacagaaattagctgggcatgtcaatgtgtgcctgcagccccagctacttgggaggctgagttgggaggatcacctgagcccagaaggtcaaggctgcagtgagctgtgatagcaccaccatactccagccttggcaacagagaccctgtgttaaaaaaaaaaaaaaaaaattacctattgccaggctgtcctctagatggttctatcttatacttccctcaacagtgtagaagagggaaaactaggtacttttaactacagttatgtgttcactcatgatggagatatgttctgagaaatgtgttaggtgattttgtcattgtgagaatatcgtacagtgtacttacacaaacctagacagtataacctactacacacccaggctatatagtctagcctattgcttctaggctgcaaacatgtacagcatgttactgtactgaataccataggcaattgtaacatagtggtatgtatttgtgtgtctaaagatatctaaaaacttagaaaagatccagtaacaatatggtataaaagacaaaaaatggtacacctgtagaaggcacttaccatgaatggagcctgcaggactggaagttgctctggatgagtcagtgagtgagtggtgagtgtgaaggcctagggcatttctgtacactgctgcagaccttacgtacactgtatacttaggctacactacattcattttttaatattttatcttcaataataagttaaactagattactgaagcttttttactataatttttaaacttttgaatcttttgtgacaatacttagcttaaaacactaatacattgtaactgcataaaaattgtttctttgttttttgttttcttttgtttttttcttgagacagagtcttgctgggtctcccagcctggagtgcagtggtgcaatctcggctcactgcaacctccacctcccggattcaagcagttctcctgcctcagcctcccgagcagctgggattacaggcactcatcacctcgcccagctaatttttttatatttttagtagaaacagggtttcaccatgttggccaggctggttttgaactcctgacctcaagtgatctgcttgccctggcgtcccaaagtgctgggattacaggtgtgagccaccatgcccggccaaaaattgtttcttcatatccttattctataagatttttttttctatgttttaaatactttttttatttttaaagaagcaacaccattcagttcagaacacccatactgactttgagctgatggcctttgtaggtttctaactggaagtgaaattttttctatttttaaaactttctttttatttcatagttactttttaagctttttttgttaaaaattaagacacaaacacacaccttatcctaggcctatacagggtcaggatcatcagtatccgtcttctgcctccacatcttgccccagtggaaggtcacatggacacacctgccatgtgtggagctgtcctctcctatggtaacaaggccttctggaatacctcagggaggacctgcttgcacctgttttacagttaacatttttttttaataagtagaaggaatacactataatgctaaaaagtatagtatagtaactacataaaccagtaactgtcacttatgatcattatcaagtgttatgtgctgtacataattatacatgctatacttttatatgactggcagcgcagtaggtttgtttacaccagcatcaccacaaacatgtggatgatacagtgtactacgatgttacaatggcacagtggctatgatgtcactaagcaataggaatgtttcagctccattacagtcttatggggccattgttaaatatgcagtccatcactgaaacgcatggctgcatgtggtagaaggtttcaattcataaatattaatttatactgctggtttatgactaacccaggaaactgcataatgattaacaaatgctacgatataaccaagtgaattgcaaagtcatctacacctgtattaaagttcagctcagaaaggactgtttggactgtgtgtatctagcactacgtagaagagaaagtcaagggcaaagttcccactctcaagaactttatcttgttgggttcatgaaagggtttctggtgacacagagtaggtatataatcagcaaaatgtggtctgcggttcaaatgagtgctcatgccagagattggttgggtgccagctatcagttcttccaccctgtccctggaagctatctgctacctctggggctggcacaacccagggtgtggctgcgactgcctagggtgtggccactgtgaactgagctgcatccccttcctggtgcacacccgcacacacaaaagtcactctctaaggagtgggaatatctatctcttcgccttggaatcttcagaaaataatgatgtagcaaatgatagtttttttgaatgttgatttaattaagctgattctttctttgaaagagaagatttaatgatttttcactccctattgcatttatgttttccacaactacgacaagagttttctctgtgttctgaattcttctttcttaagatttctctttctggattagtcataaaccagtctttcttaaatacattcagtttcttccctggtttcaatagatattgagggaagaaacggaaacctgaattggttagatgcatactttataccagacactgtgccagatgatagagattatttcaggtgtgtattcaggggacggggtgcgtggtggtggtcattctgaaagacacctgcagttgcagctcaaatcatttattccgtaagtatctatgagcgtgcacactgtgcttgacatggaagatgccagacaaacgtggtcctgctctgttttaagtgaaggttgttatggtgtataaagcaggacacctcacttggtaggagtgcaaggaggtatcagggagggctgttctgctgcccttctcgcaggcagcttttcaggcattgctcctgcacctatgcagacgtgtccatggctcgtgcgggggaccctcagggagaacagtcacgctgctgccccaggcacttgcactgtccctatgactgagtatgcatcctctgcaaaccactgctgtagcatcagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacaggcatctatgcaagaggcacttctcttatcttgccatctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagcatcctgtccaaagattagagtctgaaagctcactctactgatttgcaaactttaacctaaagcaaatatgcttaattttattgtccttacatttattgcttctgagagacacctttttttttttttaaggcaaggtcttgctctgttgccccatgctgcagtgaggtggtgcaatcatagctcactacagcctcagcctcctgggctcaggtgatcctcccacttcagcctcctgagtagacatgagagtctccctgtgtggcccaggctgcctggcctcaagtgttccttccaccttggcctcccaaattgttgggactgtaggtgtgagccaccatgcttaggtggcagctttattttaaatgacctgtttgccccagatgtgttgaatttaaggataggctggaggttcagtcatttttatttattttcaaagaggtgttcagaattcacactctgtttttcttttaataactactgtggcttcctcctcatgctgactttctacacttgggaagagaatgtgggcaaggaagcttggagggaagccagagactccttgctctctgcagctgcacagacaggccaggatctgctgacctgtggaaccagcccgctgcagtgtgtgccccccagcccccggaggggcagcgggcatgcctcagagagcagctcagagtgaagacggtagaaggggaaaactgatgagaattattgtgaatcatggtggggaggaggggttttaagaagttaggcctgttaggctgggtgcggtggctcacacctgtaatcccagcactttgggaggccgaggtgggtggatcatctgagctcaggagttcaagaatagcctggccaacatggcaaaacctcgtttctactaaaaatacaaaaattagctgggtgtggtggtgcgcatctgtaatcccagctacttgggaggctgaggcaggagaatcacttgaacccgggagatggaggttgcagtgagccgagatcgtgccactgcactccagcccgggcgacaagagtgaaactccatctcaaaaaaaaaaaagcagttaggcctattttgctgtgctaagagaaacttacttttaatgaactgagctgcatgcctatcccaaattctgttttaaggaagatgctctgaccacagtgtcagtttggctctaaagtttcaagggatactgaaagggaatattggaaccaaatgaatctgaatgggaatcccaggtctgtcactgtctgttttagaccttggaaacattacttaacctcttttgaaaataaggatttaccatcttgttggttggtttgttaggatgattagatacattccagatcagggtaactctcctaggttaaaagcagggactgaagccaggcaattaccagggatggaaattttaaagctgacggcagaacacacaccagagctgctggctcgtggaagcctttgaagtgatgatttgatgggcaatctgagttcctcaggagctgcccaaagcctcataggctcaggagccatgctctgctttcagagtactcaacctgggccttcccctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctccccactccctctctctccctctccatccctctccccaccatgtcctgctcctctcactccctccctccccctccctatgtaatgtatactttagcattttaccatgttaaatattttttcaataatgtgatttttgttggctatattattctacagcaacgactactgcagtggtgtagataaatctcataatgttgatcagaatctcccaggcacaaaagagaaaaaaagatacatgactgtatacttttctgtgtatagactgcatagttgagtaatttttaaattattttatatggtactgtctttgatgacttctcagaaacatcagattgattcatacctttttttggtctctatttactcatttgccagtaataaagcatcttgctccctaaggcttcacaccatgaaatagccacagtgctgggggccgtcccaacgtgttctttcttccacagacgcaagatggctgtcctctctaaggaatatggttttgtgcttctaactggtgctgccagctttataatggtggcccacctagccatcaatgtttccaaggcccgcaagaagtacaaagtggaggtaagtgggaacacaagctggtgcccttgtaggcttgtctgggggccacaggcttagccaagaacttattttcagccatggagggagaggcaaggagctagttgtgagaagtggcagtttcaggactgtgttagcgattctgcttcttcatggtaggaaagaggcaagaaatacagggccctgctagggagtagtttccatcttgtttgactttgtctcttcggtagaaagaccaggaatgctgggattccaatagtacacttctgcttggagctatttgctaggaagagagttactgtattttccacagagggttaaatagcaatattgtttcatggtgtgccactttaaaaatgatgtcttatggtgattttcctgttttccaagtagaaaagaggtatgtggtgttgagattagcctggacttagacataggaaggtggtctattaaacacttcctttagttttaggtgatctagaagggataattaccaaagttgtccctggtgagtggttttaaatgtctgtttctgtttagcaacttaataattaaactcccttactagagcttcttttaagtttttatatttagtttcttcttttttttcccttccagtggacacttccattaagattctcacacactcaatttctgttcttctattaagggaaatcttaaaaggatgtggtatttgatgactcttaggaaggctctatttccctacagtatctttgtaatgcatctgaaatccaccattgatgcttaacgtcaatgaaaagcacggagtttggcgcaaagctgcctctttcccttgtgcaactacagcgcagacatacattcttattcctggatatttaatagaaacattgactctgcttctgagaattgagacccttgtcaccataaatatttaagcagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctcaaaaaaaaaaaaaaaaaaattcataattctacacaggcatacttaaaaagggcactttttaaaagtttctttctgtcaattccaggttggaagtgtatcctcccttcttattttttctagctgttggaggtgtttaccacccggtaagttttccaggaggtgttcatctatttggatagtagttcactgagctattatcagggacagaagaaggaaataaacatttaatgaatatcttcagtgtctaggcactgcatatttaaaaggattttattcaattatttcttacagagttctttaaaggagatgggattttcctcatattttacagataaggaaaagcctctcatatactatttaaacttcacaaggtcaaatagctacagagtagaaggattagaatttgaactcaggtctgtctggttctaagtttcatgtctataagagttcatttgttatagtaattcattcacacaacaaactttcactcaccacctggggtaaagcagtgatcaaagcagacaaagacccctggtttcatagagcttgcctttttgttgtggggtgtggggtggtcacagagaagaagcaacctaagtaaattacatcatgtgttaggaggtggtgagtgcagagaagaaaacaaagtggggaaggtggaaaggggatgtggagtgggataattttgaatagggtggtcagggaggggggctttgctgagatgatagttaagcaagtataaaaggaggtgagggagcaggtgctgcacgagtttccccaacctccagccagaagacaagcaaggcctgaggcaggcacctgtctggtttgtttggtgagcagtgagaagccaatggagccaggagaggggcagcaacagagggcagaggggtgatgaggcaggtcactggggacttgcaggcctctgcagtatagatagccctgtgggatggagatttagtctgcacttaaacatatctaaataaagcaagtttatcagcctctaattaattgccatttgggtcttgtcttagacagaagtgttccccttttctgaggacagattatctcctgaaaccaagttctgaccagagtggcccttcagacttctggttctaagcctttcctaaccatctggttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagaggcccatttgagaaaacggcatttcccctagtcctgactttggggcagttctcttttctggcctgccctgagaccggctggcccacatgtccttctcttgagctctgacacaagttccccaagatgcccagggcaagtggggggattccttctatcccacctgtctaggagaaggccaatactcatctcccaggtccacaagccaagccattcatagaagaatcacagatattttattttcccgctgaaactaacttaattctacctaatttgcgtggggagtagttggccaaatcatcaaattgttaactttttgctaacatattgtgtaatcaaccctaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggcgaaggcaggcagattgcttgagctcaggagttggataccagcctgggcaacatggtgaaaccctgtctctacaaaaaatacaaaaattagccggatgtggtggtgcacacctgtagtcccagctacttgggaggctgaggcgggaggattgcttcagcccagaagtttcaggctgctgtgaaccatgattacactactacactccagcctgggagacagagcaagatcctatctcaaaaaaaaataaaatcttatgctactatattttttttcttgggaatttgagaaaaggggaagtcacctgatatttaggtgaaaggtctgttttctttttattaatctttcaattgtaacgaaacttatttttattgagcattttctatgtgccaaccactactctaagaactttgcatatgttatttaaccttacaacaattctgtaatacagatattattgcattttacaaattaggaaactgggactcagcatgattaaagctgtaggtcacagagctactaagcgtaaactagtaaactaggaatcaaacccatgcagtccgactccagagcctcaccattactatacctcctatatctgagtaaggaggaggaaaagccatttttagctgtacttctttgaaacagagggaactccttccaaaggtcctagagcaaagttgctgtaattattatcccataattttctaagatccaagcaatactactgtggcacgttacttggcatgtggtatctgacttgccaacagcttcaggctaaagagttagttaacctcctaaggccagtttgtctaatgtacaacctcagatgcgatgatagaatggcttgcgaatgttgaaagcatcataattctggagcactcctggtaacttctgttctttcttctttttcagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacct

SEQ ID NO: 35862 - DNA, 51192 bp, Homo sapiens
gctgcgtgacgcggcggcgcgcaagggacgtgcggagtgagtggcgctgcgggtggggccgtcggcggcgctggtgagctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggagggtgagtgcgcgcctggccgcgggacagagggaggtcgggcaccgccgccgacccctgcgtccccgtctgccgccggaacgcgaggggacccctttcccgccccgagacgagtctctgggagcgcggcgcggcggacgaaccgaggagggggcgaggaggctctgggcgcgggggagcggcctctgggagcgcggtcaggggagatcgggggagagggggccgttcccgcggaccctcgggggccaggcccgccggccgaaggctgtgcggagcgggtctgcgggagacagcctttcggaaaggccgccgggctccgcgcgccgtggtgctcgcctccggtgacccgaggatggggagaggatgcctgccactgggctttgtgcgtccgtggaatcactgttcttctctgttctctttgtgcattgcccttggctgcctccgattgtcgttccgggagtgaattttacgtatatatatataaacctgtccttaacaggactgcttcgtctgctctgcatttttacacaatgctatatagaatggattcttcttaaagagaggataaaattagcgggaattaatctaccgtttgttacttggcctaaaaaaattgtaagacaagatatttgatcaggttgaagatgcacctaagaaatgtgatgtatgtagatgggtttgctgaagggattggcttttgcatttgatttgagcagagcttaatttctgcacaaacttagtgaaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctgggaggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcgattcttccgcctcagcctcctgagtagctgggattacaggcaccccgccatcatgcccggctaattttttttgtatttttgtagagacggaggtttcaccatcttggcctggctggtcttgaactcctgacctcgtgatccacccgcttcagcctcccaaagggctgggattacaggcgtgagccatcgcgcccggcatatttttatatattttaaactttgcttgtaaatttaaatattttaaaaatatgtttgtatctcaatttatttatattttatttcattttccatatattttgtaggcataaaacagatttatgttttaaaatgtttgtatccttttaaattagacgcacctttatatgattacaggtacttaaacttcacgagtgggttgtgcaaggttactagaaaagacactgggggaaaaataagtgattccatttgtttttgtgaattcaaattaaatatttggtttgtacaatctgttttccttttttgggggggcggggggggggcgggtaagaattgtagtccagatacgtttctctcttaatttagcaagcgttaacaagttgacctcctccttgccaggcaccagcaatcctaagataagacacagtctcttcactcaaggagctcccagtctaaacaagtgtctttcaggctttttcagcctcctctctgtcctatgttcagcacacattctatcagtacttcttcatcctacagaagcatatttagtttgacagtgcccccaagggattcttaaatattctaggtttttcagctccttcccagatccagacctgttgaaagacttgtccagagcagacttgaattttctagtaaataattatttttaatcttcaaagaaaattttgtccacctggattttcagtgatattagatgctagttagtgatattttgtaaagctgcctagcaagaataactatggttagtgtttttagtgtcaaatgaacgtgtaagtaaaaatttggcaagaatttctctgcattaggggaaaacattcagcaggacctgatctcattttaaaatgctgattgtagccccacaacatattcctgattgttttttcttttttactgtattaaatcgcagatcagctatacacacttctggtgactacattttatgagttgctttttgtttttcttttttaggtgggcgtattattgataagttttttttgttttttgtttttttgagacggagttttgcgcttgtcacccaggctggagtgcggtggggtgatgttggctcactgcaacctctgcccctgcaggtccaagcgattattctgcctcagcttcccaagtagctgggactacagcatgccaccacgccccggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcattttaatacaaacatgccatttaatgtaaaacagaaatattgattttattatttggacggtgcatattctttcggtatgttttcttggattaacttttgcttagaactaaaaaccaaagacttctactttatcccctgtagtgaccctgttggccacattcttgtggcttaccatagtgttttgatcatttaaattgaagctagtttgtatgagtattctggaaaatccggtaaaagcttcttacttagatgagtggttctcaaagaggggtgggaaatgggagtatagcagaatcatctggggaacttcattcaaactataagtgctaagtttattttggaggaagtgaagtggaatgagtagaatctaatgcatttgggaggaggttagtatggaaaactgctgctgggtgaataagagtgccagctctgttcccaaccacagtcttgatccaggtatttaaaaactgggatgtgccagttgatatagtatgtctattatgtgtcatatatgtgataatatgaaactgtttagaatttgctttttcctgattatgaaagggcagcattctttcaagaagtcccctgtaattccacaatccagagataaccgttgttgaaattttgatatatttttgtttaaagatacttaacatactttgtaaaattcacatgctttacatcattagaatattctttacatagctttatgagttaatttttcatgtagtattacatcatgaacattttcccttgtcattgaaatgtcttcaaaaataccgaaaagcgatttgctgtgtgatagaaaagtttttcttaaagtattttttaacatattaccacgaagctgaacttgactattacaatatgagttgtagaatattagcactgtgtaaagttccatagcaaaatgtgattgtgttacatttttggcccacttacagttttatgaaaatcgtgggatgtgtttgtacctgttttgttttttaaattcatttttcatttaactttgacctgtcagatgtctgaatttgtgacactgcttgtgatctcttagtgcgtatctcccttttctttcttgtgaaacaggtatagtactcttaagatttagttaggctgacagactacacttttaacttttcctattcaagacaggctggaatgcagtggcttgatcatggctcactgcagcctcgacttcctggtctcaatcgatccttctgcctcaacctccctagtggatgggaccacaggcacatgacaccttggctggctaattttttttattttggtagagacggggtctccctatgttggttgcccagtctggtcttgaacccttgtgctcaagcaatcctccagccttggcttcccaaagtgttgggattacaggtgcgaggtgctgcgcccagcctgtagtgtccttttgaaggttaaaaaaaatgaatggatttgaaaaatgaaatcgattaatgaaagcatattaaagccctccattttaaaatgacagctttatccagatataattcacataccatacagtttgcctatttagaggatatgatttttagtatactatagagttgtgcagccatcaccacagtgaactgtataatattttcaaacacatataccccccaaaaaaccctgttcccggtagcagacaccccatttctctccattccctcccggcccccactaatctacttttttttgtctcttagatttgcctattctggacgtttcatgcaagtgaaatcatacaatatgttgtcttttgtgactggtttcttttaatgtttttaacattcatctttgttgtagtatgtatcagtactttattccttttatggctgaataatattccattgtatgtatacaccacatttttaattcattcatcagttgatggacattttgttttctttcggctattgtgaatacttgtagtgctgctatcaacatttgtgtagaagtttttttttgtgggcatatactttcaattccgttgggtatatagctgggagtgagatttctaggtcatatggtagccctatgtttaactttttgatgagctgccaggttgtttaaggcctctttactgattaaattgtttaattctgacccagcaacctaaaggttaggtggttggaaagaagtgtcagttgttgccgacaacctccacttctgtagggaaggtgttttgtgtggatgtgcagctagacttgttagaaaaaagagcatgttggggagtgggggagatcacccgaggaatattttatctccttgattcttctggatgagatactagaggagacataaggtcgtggcatattttttaactgattcagagattaggtgtttgttttctctgaattaagttcagcaagtaagggaaactgacagtttgaagaagtagcccagaggtgtttttattttgctatctgaatgcagacctggagcttttctggtaaatatctaaatccaagatgaagattcgttgggatttaatacattatttaaattgagtctagagacaaagccacattaagagtcaggattagtggggaagatagttgcatctagtaggtctttttcttccttattctccacgtttattacttttaaaagagtatacattccaatgccatgcatttttaattttttttaattaattttttttttttttggaggcagggtctggctctgtcacccggttggagtgcagtggcatgaacatggctcacctgcagcctcaaccttctgggctcaagtgatccttctacctcagcctcacaagtagctgggaccacaggcatgcaccactaattaaaaaaaattggtagacacagaatcttactttgttgcccaggccagtctcagagttctgggattacaggcacccagccccattttcaaacatttctaacaggtaaagtaatacaggtatgaaggaatgttaagattcttagaaatactgacttaaattctgttatgtatttctgaaaggttattctcgaatgttggtggcatatagggaggcaaggggaagaaatagtttgtaaatgtcagtaggtttagcagtggtgtggtagatggggattcccagtggagtcttctaggatttgtgattggatacagattgatacccttaggcagcagccactgcttctagcagctttaaatagccatttcaaggcttattcaagtataaataaccagtagccagttttttcctgatttgatagaggaagtcagtccttggtctagatgggtacttgtcatacagtaggaaaaagggcgggggcagttgtcctttattctgcctctgcactattcacatgtggagcacagtgatttgtgagagtatgtataaccttcgtgaacatcactggcctcagaaccctcccttgccaaatttacctgcatctgtgcaaagacaagtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgagaaattcctgtcacttagtgacatcataggcataatgtcatagtgcaatgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttggtggcatgcatatgcctgtaatcccagttactcaggaggctgaggcaggagaatcacttgaacctgggaggtggaggttgcagtgagcaaagattgcaccactgctctccagcctgggcgaaagagtgagactgcatctccaaaaaaaaaaaaaaaaaaaaaaaaaagtataacacaattatatagagtacataatacttgataatggtaataaacagctatgttatatatttaccttttttttttcttttttttgagacagagtttcgctcttgttgcccaggctggagtgcagtgacgcgatctcagttcaccacaacctctgcctctcaggttcaagtgattctcctgcctcagcctcctgagtagctgggattataggcgtgcaccaccacacctggctaattttttgtatttttagtagagacggggtttcaccgtgttagccaggatggtattgatctcccgacctcaggtgatccgcctgcctcggcctcccaaagtgttgggattacaggcttgagtcactacgcagggccctggaatatattcttattttaaaaaactagttaaaaccgactcaggcatgtccttcaggtggcattccaggaaaaaaagcttcgttatcctgggaggtgatggctccatgcatgttactgcccctgaagaccttccagtgaagatgtggaggcggaatatagtgttactgatgatcctgactctgtaggcctaggctaatgtgtgtgtatatggcttagtttttaacaaaagtttaaaaagtgaaaaatatttttaaaaataggaaaaggcttaataggataaggatataaagaaaatattgtacagctgtatgatatgcttttgttttaagctaatcgttactagaaaattcaaaatgtttaaaaatttttttaagtttctaaagtaaaaaatgttaagtaagcaaaggttaatttattcttgaagaaagaaaaatatttttatctttattactgtatatacattgtgccttttctgtgtttagatatgtttagatatacaagcacattgtgttacagtagcctgcagtattcagtacagtaacatactgtgcatcatgctttgtagcctaagagcaatagactataccatctaggtttgtgtaagtccactctgtgatgtttgcacaacaacaaaatcacctcactgtgcatctctcaggaagtttccctttggtaaatgatgcataactggacttgtctgacaccattttaaccttccccctagtcctacctctcattctcaagatttggagaaatcaaaatctaagttttcataataaaaggttaggtatattgggtgttacatagctttcactaatgtcatatctagcagttgtaatcacgtattttaaaactttaaatagtaaattaagaaggaatctttataggtacttgtatgtttcctcaatgtggtttgaattgagcgttttatttaaattactatcaaatacttgagccaaactagcgagacaaaaagaccagaccttttcttttttccgagatggagtctcacactgttgtccaggctggagtgcagtggtgcagtctcggctcactgcagcctccgcctcctgggttctagcgattctcctgcctcagcctcctgagtagctgggattacaggcgcctgccaccatgcccagctaattttctgtatttttagtagtagagatgggatttcactaaatctcgaacacctgaccttgtgatttgcccaccttggcctcccaaattgctgggattactggggtgagccaccgcgcccggccgagaccagacttctgagggggagaaacttgcaaacctgtcagtgagaaagagtgaggtctgattttagatgacagaaaggaatagcttttgtgaatttcggactcccaactactagaattatgtgaatcctgaatgataatcagatgtttactcagttaagtgtttactcaaatattaataagtattgatacattgggatgccatcttatataatgattaacgacacagattctgggtgtatttcagccccagtttcttctgcatatatgatagtaagtgccttcaaacaattcttgacacattaaaggtcagaaaatgttagccgtcattattgcttagtacaaacctgagctaggaaatactaacagagagctctttgtgccactgagtcctggaacttccccatactaattttgagaaggctttcttgtaagtatgtgacagatactgtttcctccactttctgtttattgcatataaccactattcttgtatgtaagtacgtataacagtttctttactattcccattattcagcgtttataatctggtttgacatatcagtgttggtgctgagagggaaaggtatttctaggtaggataaaatggtgaaaagtgatttaacactgttgtatgcttgcttttggccaggaactatagggcagtgtatcttaaactttgagtcttgagaccctcttacactcaaattctccatatatgtaaagaattgaaaacgagcttttatttatgtgaggtatttaacaatattgcattagaagttaaaactgagaatttaaaaatttctgttctcggccgggcatggtagctcacacgtgtaatctcagcactttgggaggccgaggcgggtggaattgcttgaggccaggagttcaagaccagcctgggcaacatggtgaaaccccatctcctaaaaatataaaaaagttagctgggcgtgatgtcacatgcctgtattcccagctacttgggaggctgaggcacaagaattgcttgaatctgggaggcagaggttgcagtgagctgagattgcgccactgcactccagcctgggcgacagagtgagactgtgtctctaaataaataaataaatatctgttctttaagtagcaacatattacattttagcataaatgttttttatgaagataacttttctaaagcaaaaatgtgagaagtgccatcattttatgcaaatctaatgtctttttaacagaagacagctgaattcacatctctgttttgtttcagtcttttgataccttgttttagttgaatatgaagaaagtctgtagtcctacagatacgtagttagaaaaaggaggagtagtttaatagctgttctagataattgtgggtattctctgatgtttataccaaaaatcagcaagtggtggttttttaaaggtgaattttaaaagagatgtggaatctgaaattatatccatgaatttttatgttctcttacattaaaatccattgatctttcttgtactttaaatggatcttacacatgactttataatacgcgttgttcatttggataatattgattcagctgagttatgcagatgtccagatgttgaaacagcttattatctaatacagtatccagaaatgacatttgttaatgttacaagatctcatcagaagagtccttaattatggagaagctgtcagattcatggtgctgattacaaggtttctagaattttagtttgtaacttgaaagcttgaattttatcattggcaacaagtactgtcagttgttttccttgaaatgacagggtcactttgttcatgttcacgtgtatctgttgaatatctaagtctgaataaccatagtttgtcagttaatactttccagtaaaagtgtttagtgaaaaaaagtgtctaggtctgcttggaactaaaacagtcacaggagtgctttcctttgcgacaaccattgtactttgggatggagcaggagtgctttgtgggcatttccattttatcatgtagattattaaagagatgtattcaaagattgaagtttaataaaattgatcatttgtactgctttaccaaagggcatacatgaagctgccttttttgtgtttcactgcatgtgtgttgcaatgaacaacacagtgactgactaccagtggggtttggtgccactgacttggtgtgtactgagacacttaacagttttacccatccttgcttttgtattatcaaagcagatgtcagtgcagtggaaaaaaaaaaagtcctttattcctgaaatgtctagccctcacctatatctgtcacttttcttcttcactcttttctcattatacttgctatttgtttaccaatgtacctgaaatgactttttacttatgctttgtgaattcatgaaagccatgggccttctcagaaaaatatttttacatatacacaatattacagacaatttgtggtactatacagagccactaaaggccattttggtctctgaatccacgttagttattcttttgttttgagacggagtctcactttgtcacccaggctggagtgcagtggcaccatctcagctcactgcaacctctgcctcccgggttgaagcgattctcctgcctcagcctcccgagtaatctgggattacaggtgcgcgccaccacacctggcttattttcgtatttttagtagagacggggtttcagcatgttggtcaggctggtcttgaactgacctcctgatccgcccaccttagcctcccagaatgctgggattacaggcatgagccaccatgcccggcccacattaattattgttaacaggcagtcctaagatgagagggaagtacagcagctgcctaattttttttcacttaaaaccgtgtgtgtgttgtgtgcatagagaaagatggggaggaaaggaagacagagtgggagagggagaagaaaagcaagagagaaagaatgaaaaagcaaagggggctggacgtggtggctcacgcctgtaatcccagcactttgggaggccgaggcaggcggatcacgaggtcaggagatcgagaccatcctagctaacatgctgaaatcccgtctctacttaaaatacaaaaaattagctgggcatagtagcacccacctataatcccagctactcgggaggctgaggcaggagaatggcgtgaacccgggaggcagagcttgcagtgagctgagattgtgccactgcactcgagcctaggcaacagggcgagactccatctcaaaaaaaaaaaaaaagagagactccacattttagccaattgtagaatttttatttttctgcctttttgttgcttaaaagcaggcttttgtgctaaatatggagaaaatgctaggaaaaaattaggatgtctagatttaactgccattaattagtatgtaatcttgggggtgggggttgagtaagagttagaataccagtggtcagtgaagattactaagattttatgaggccaaggcgagtggatcacttgaggtcaggagttcgagcctgggcacatggcgaaaccccgtctctactaaaaatacaaaaaattagctgggcatggtggcacacacctgtaatcccacctacccagtagattgaggtaggagattcacctgaagccaggaggtggaggtttcagtgagccaagatcatgccattatactccagcctgggtgacagagagaccctgtctcaaaaaaaaaaaatttatgagacaccgtgcataggtgttggaattagtgcttttttcttgccatcttttctgttttagagaggtaatgataagtaagaacttgctggggaaagtagcataaggttagtgaaaagtaaaatttagtatacacacaacacacagacacatatatatcacatacccttggatatgtgcgttggaaagacaaacctgcaatggaaaagtttttacactgatataaaatgtgaaatataatggttgagtaaaggacagaattcttttgggagaggatacacattttgcttaattgagattcaaagttaatgttctctgtcatcaaaactgattgcaagtggtcatctcttgatgctgatctgtagtgagattctatgtatttcatcttagaagatgtctttttacacagggacatactgcatattcatcacttggaaagcatttatagaattctcctgatacttgcctttcagcatgtcattacattgcagattaatcacttccagtagagggttaggtggaagctcctcggctgcacagttaaatggattttgatatatggaaattttttttgcgcttgagtcaaggtttgaagaatgctagtttgagtttgaaaaaatgtatctgctgcaaaattgtgtgggaatgaagatctcacttgtcttaacttggcagcacgggttatgtataaagcagtttgctgactgggtatggtggctcgcgcctttaatcccagcactttgggaggcggaggcaggaggatcacttgagttcagcagtttgagacctgcctgggcaacatagtgagaccttgtctttatagaaaattaaattagccaggtgtggtggcatgtgcctatagtcccagctacttgggaggctgaggcaggagaatgtcttgagccagtaggctgtagtgagcctcattacaccactgcactctggcctgggcaataaagcaagaccacatctcaaaaagtaaaaaattaaaaaataaagcaacttgctttaattcagacagtattagttgtcagaatgacttaccacaatggaagtttctcatatatttttttgccttataattttaggctgaatttattagaaaacatttaggggagctttcattctattttgtagaatagaggctacctcgaattaaaaggggaaaaattactagatctgccgcaaaatttaatttctaaaactcttctgtgtttggtaatagtgattgagggtggtggttcttgtttagaaaaaattcagtatcagccctgaatgcaaataaattacaataaagctgtcactgctaagccatcaaaatcctgtgtggttggccaaatgaggatattcagcttttattactaacaaatagtcatgtaactgacagtggttaagttcattagagcaaatgaagttgaccattgatgcctgtggttcagtaatacctgattaagatatttttccacaaaaaaactgcaccagacttcaaacatcctacattttctcagactttgtaaaatagtccaactaagtatttttctactttaccatcatcagttgtgacatatcttagcagattacacttcaggttgtactaaaatagtttttctcagctgctttgagaatattcttgcctctagttgttccacatagattatttatagagggtaacttttcagtcacttcgaatgaggattggctccccaaataacaagtattggtaatacctgtcatcgagagccaaggaacaccactcagaaccatttggcttgttttttaattgtttactaattttgctcccagtgttctcaactcttcaagcaccgtttttacagaaaggctaatggcgtttaaaagtttattgtctcagctggggtggtggctcacgcctgtaatcccagcactttgggaggccaaggcaggcagatcacgaggtcaggagattgagatcatcctggctaacatggtgaaaccccgtctctactaaaaatacaaaaaattagccgggcgtggtggcgggcacctgtggtcccagctacttgggaggctgaggcaggagaatcgcgtgaaccagggaggcagagcttgcagtgagccgagatcacaccactgcagtccagcctgggcaacagagcaagactccatctcaaaaaaaaaaaaaagtttattgtctcaaaaaatacatagttcttcagcttttccaatcagatacaatttaattaacccaccattgataaatgacttaacttggctaacaaatgggccacttggaaacttgagttgcagactcatttttatttttgtgaagaaattctgctgtgatgagatttcattttaattttttaaaaagttcccttaccattgctttactatgaattgggaatgctgtggtgagtgctccatctggtaacatcagtatatgttgtggttttttttttagcacagctacataatgactacaatgccttagcacccaattaaataacataatccacactttattgtgtcttaaaaacacaacattcaaagttcactttttttgctttgacatgatgagtatgcactggtagtaaaagtaaataaaatgttgcagtacagcaataatcgtgacacccatgacgctgccaggttgtaactgcatctgtataatttgtgatgcaccgaaaagcagtgtgaagtgatgagagtaccatatgtagtccatcacaactgctcagctctgccattgtagcatgaatgtgtccagtgataaataagtggctatgcttcattaaactttatggccaccaaaatttgagtttcatataatttttatatgtcacagaggattcttttgttttgcttttttgcaatcatttaaaaaatgtaaaaaattattcttaggcccctagccatgcaaacactggcattgggctagatttgaccccttggccttagtttgctgaatactggtgtagtttttctgcctttcctaatgtaaacatgattgtagaaagataaccttactggaagtcaggaaaccttggtgctcccaccaaagttgtgtgactgattaagtcaggtgaaataaattgggattaggagccatggtgtctagtccttgacaagtcattcctcaatttttttaatgtaatcacctgaatttctagtgtatgcataatcacattttgtgtgcctctcggcagccattccattgttgaagaggcagccaacacagaaaattgttgaggggttttgatctttgacaagggaagcgtatagtgtgagctcaccagtcaccctggcttttttccctggagacatttcctagtttgtggcataggggaaatagatcccaaataaaaagtgacggtctcactgggctaaggaagaaaggtggaagtttggggccactaaagcaattgaagcttaagtccaggagaggagagaaccacataaaatctaacctcaaaatctgcagtcaggtccctctaaagtcattgactgacttcagaggtacacataagcaagagaagaaacccagcagaaaacagtagctgaaaagctaaagatctgagcagacatttcagtatctaatgccagagaggcaaaaatggaagttcaaatcctgccaagttagaggggccttattacaccctgagttttccactgtggccccatcatgaccactgcctaagattgaaggcaaaactaaaacagaccagccctcaggaaaatgagttactgctgtgctgctgctaaaaggaaacagccttctttggagaaaggtattatctaaaacttctacaattttgtatccataattcagtatttcattcaccaaaataggatatgctgttttggacaagctaatgaaactgaattgaccaaaaaccaatagaaattatctagtgctgacagaaaaaaaaaagtgtacagaagaaagcatgagagacttatgtattgctgatagacagtggaaaggtctatcatgtataataggaatcccagaaagagaggagatagacatacaatgggatggaaatattgactaataattttccaaaacagagatatccaagcacatattaaagaagctgtgtgattccaagcagggtaaatagagagaaaaccatattgaacatagctgctagaaatccaagagaaagagaaaatgttaaatgctgtcagaagaaaaaattcattatcttcagggaacaataatatgaatgatggctgatctatcacctgaaactgtggaagacagaagacaatagaatggtgttctctttaaagcactgaaagaaaaaaaatgacaacctagaattctttatttattttgagatggagttttgctcgtgtggccgaggcttggagtgcaatggcgtgatcttggctaactgcaacctctgcctcccgggttcaagcgattctcctgcttcagcctcccgagtagctgggattacaggcatgtgccaccacgcctggctaattttgtatttttagtagaggcagggtttctccatcttggtcaggctggtctagaattctaaatctagaatatccttcaatagtaaagtaaaatgaagacaaactaaagctcagaaaatatattgctgatatgctgacactagagaatattaaagcaagttctttgtgttgcaagaaaataacagataaaagcaaagaactgcagaaagaaatgaacaatggtaaggataaatgtgagtaaatacaaattctgactgtttaaaataatagttgtggcttgtgggatttaaaatatgtggaaacaaaaatacgacaactgtagaacaaaaggctggaggcgggtggtaatcagtcaaaagtgtatttgtaatctctagagcaacctctaaatgaaaaaagaatatataacgaaaagctaatagaggagaaaatggaatagtaaaaaaataactgattactccaaagaaatgcagggaaagagagaggaatgaagaacagatgggacaaacagaacagatgacagaatggtagacttaaactcaacttcgtcgatgattatattaaatgtaaaaggagcaaatattggctgggcaccgtggctcacacctgtaatcccagcactttgggaggccaaggcggacaggtcacttgaggtcaggagttcaagaccagcctggccaacatggtgaaaccctatctctactaaaaatacaaaaattggctgggcgtgggtgcctgtaatcccagctactcaggaggctgaggcaggagaatcgcttgaatctgggaggcaaaggtttcagtgagctgagatcatgccgctgcactccagcctgggtgacagagtgagactccatctcaaaaagaaaaggagcaaacattgaaattaatgcaaagctcagaagacctaactattatagatactgtttacaagggatgtattttaaatctaaggacacaaatgaggaagtaaaaaaaaggggggggggaggggggtgtgggggagacgatatcatgcacacattaatcaaatgaaagctgacttggctatatttatgttggaaaaagctctaaaaccagaaataacactagaggtaaagaagggcattatataatgctaaaaggataaatttaatggaaaaatatctaaaatttttatatatgtaatagtataggtctaaaactaaaaggaaaggttgacaactattataaaaagttaaaatagacaaaaccacaaccatagatcagtgcccctctttcagtaactagtagaacaaacaggaaaaaatcagcgaggataaagatttgaacaacacagccaccctgacctacttggcggacatagaacacttcactcaataatttcaggatatatatgcttttcaaaatatgtatgaaacatttactaaaatataccatatgctataccataaagcacccctcagtacatttgaaagaaatgacatcacagatgtcagccaaaatccatttaatgaaaaacgtgaaagactgccatactagagtatataacattgctgagagaaataaataaaaggagagataccatatttgtggattggaagacttgaaattgtgaagataccaattctgtctagacttacctacttattccctgctcccccccccccaccctttttttttttttttgaggcagagtttcactcttgttgcccaggctgcagtgcagtggcacgatcgtggctcactgccacctctgtctcttgggttcaagcgattctcctgcctcagcctcctgggtagctgggattacaggcacctgccatcacgcctggctaatttttgtatttttagtagaggcggagtttcaccatgttggccaggctggtctcttcctgacctcaggtgatccacccacctcggcctcccaaagtgctgggattacaggcatgagccactgtactcggccttattcccaatttaacacctcacaagtttgggggtggaggggctagacacaagccaattttaaaacatttgaaagttcaaaaggaaaatctaaagaacaaaattgggatgtttatattactagataccgagactttataaaaagccatagtaattaagacattgtggtattgatgcaaaaatagacaaatggggtaatgagctatatagtggctaaaaacagacctgttcctgtatggtcacctgatttttctacaaagctgccattgcggttcagtggggaaaaggatgatctttatgataaatggtgctgaatcaactgggtatctgcttagataaaaaccttgacctttacatcaaaccatacacaaaattaatttgagatgggttatagaatgaagtgggctaaaacaataaaatatctggaaggaaacataaggaaatatgtttagagaaggcaagaatttcttgaataagatgcaaaaggccttaaccaaaaaaagattgactaagattttttaagatttaaattcattaaagaacttctgttcatcaaaagatagcatgaagagatggaaaaagtccagttttaaagaatgaacaaaagacttaaaacgaacttgtccaaaaaaaaaaaaaaagataacctaaagggtctattaggcacatgaaaaagatactcaatggccaggtgcagtggctcacgcctgtaatcccagcactttgggaggccaaggcggggagattatttgaggttaggagttcgagatgagcctgagcaacatggtgaaaccctgtctctacaaaaattagctgggcatggtggtgtgcacctgtaatcccagctgctcaggaggcaggagaatccttgaacccgggaggtggaggttgcagtgagccatgatcttgccactacactccagcctgggtgacggagcgagactccatctcaaaaagaaaaaaaagggtacttgacaaccttggtcctcggggaaatcaaattaaatccaacgaataccaccatatacccaacaaaatgactaaaattaaaaatactgataatttgcagtatcagtaaagatatggaccaacagtgttaggaggattatgaattggtatagccactttgggaaactgatggtatctactacttaatgaaataaactgacccgagcagttctactgctttgttctatacatacctaagataaatatgcccatggatattcatagcatttgtaatagccccaaactggaaataatccaaatagagtagtaaagatattgtcatatgttcatagaatggaatacaggttgaatattttttatccaaaatgcttgggaccccaagtgtttggaatttggatttttttcagatttttgagtatttgtattatacttaccagttaagcatccgtaatctgataatctgaaatctgaaatgctccaatgagcattttctttgagcatcatattagcactaaaaaaggtttcggttttggagcattttggatttcagattagggatactcagcctgtatttcaaatgactgttaaacacaattatatggatgtatctcacagatgcaataatgagcaaaagagcattcttatgtttctttttatctaaaagtctaattcacaaatacatcaaatcaatatatactgatagcaataaggatagtaacctcaggcattactgtcattagttagggtacaagggaatcttcagggttgcaggaagcattctgtaccttgatctggatgatggttactcaggtatatagatagtttaaaattcgttgagttacacccataaagttagtatactatatgtatgtaatatgttaaaatattttctaaacagtagtaagtatggtagatatttgctatcatgggattttatctggtctgaaattactacatgctgaaaatttctaggaaatttttgatccaaaaattttatgtggtgaagtggaaaaagtactggcctttaagttagaagactaagtctgaatccctctctgctgcttctcactcctatcagtcttataaaacctgggcactgtgatcttatgcgagttattgaatctctgtcattgtacagtggaaagaatagcttctcttttcagttcctggggtgtgaaaaggattaaatgaaatgattgatgtgaaggtgctttgcacctaatgaagtatgctgatttataatatttttataatccagcagcgttcagatatccaaacactggaatccctcatggatgctgtgatagcagtctagttgccctgtgtaacaggttgcccggatgatttcttcctttttttcagaagtcttgagagtacataaaggagcaggacttttgaattggaagacagctgggattgccctgggacatctgccttattctgtccaacctttggctaatttatttctaatttctaaaactcttgtcagagttttaaacattgggaaaacctttagcttctctaactgcattcatcaactcttaagatgtgactgattattaaatgcacttttatgtgccactaagttggtggggggggctgccaattataattgtaagaagcttttaattgcaagagtctcacaacttcagagatattagttaagggagaaatgtgcatcctacagttagtgaaaatataaaaagtttctgtgcagtgtgtttttggtaaatttttagtttctgtggatttgcttgacttacaagttgaagcactttatagttctgtaaaaatgttacacaattacttgagaagtgaaaattatacagagggaataaaataaatactaggtaaaatattcaccactgtcatttgaatattttaaattgacatattgaagtgacccacattagtcttttgacttagtagtcaagttacaactaagttttgataatgtactgttcttcttgttcattgctgttctctataaacaactaatacacagtagactctcaaacatttgttgaatgagttaatacagtttgtaagtacttttagctgtgtgtttgttatctgaaagcagtttgagacccttaattcttccaaggcgaatactttttttttgagacagaatttcgctcttgtctcccaggctggagtgctgtggtgcgatctcggctcactgcaacctccacctcctgggttcaaggagttctcctgcctcagcctcccaagtagctgagattacaggcacccgccaccactcccggctaattcttgtatttttagtaaagacagggtttcaccacgttggctaggctggtctcaaactcctgacctcaggtgatccacccacctcggcctcccaaagtgctgggattacaggcatgagccaccgcacctggtcacattttttttttcttaaactaaaatcttccacatttaaaactaaagctgagatgtctttttggtgttagaaaaacccaaatatgcatcagaagtaggtaattgatgtttgagaacaagcactaatgaagctatatcagttcccataataaaagcagttctgctgatcattgttttgaatttcagggatagtcttataaactagcatatttgctaaagcacatttgaatgttgtctgtgtctcctgtttattgcctcctttttacttttatattaatatattaatggaatatatagcttttgcatgtggaggcctttttttttttaaagcctcttattgacctgacaaaggaatcagcaatttttagcaagaaatatgtggaattttattttactttggagatggggtctcactctcacccaggctggagtgcagtggcacgatctcagctcactgtagcctctgccttctggggtcaagtgaacgttccacctcaacctctgccttgagtagctgggaccacaagcatgcaccatcatgcccagctaattttttgtattttgggtagagatggggtttcatcgtgttgcccagggcgatcttgcgctcctgagctcaagtgatccacccaccttggcctcccaatgtgctgggattacaggtgtgagccaccgtgcccggcctttatttttattttgcagagacagggtcttgctctgtcaccaagactgaaatgccctagtgccatcatagctcactgcagcctcaacctcttggcctcaagcaattctctactatgctaggctaattctgttttttaaaaacatcttttgttgacacagggccttgctttgctgcccaggctggtctcgaactcctggcttcaagcagtcctcccgctttgaccccctaaagtgctgggattacaggggcaagctactgctcccagcctattttcttttcttaaatgctctttcacttaagattaaatgagagctcagctgtaaatttaaggttaaagggagtcaggggagatggtgatgagaggaaatgattacaagttgagttcagtggggcaaataaggaactcttctgtctctccatgcaacattctgttccccttcatcccacaagttactggaaaccatattatcttatggctcagtaatgcaaagatgcctcactccatctaaatagcctttagaggttttaatataatgatctattgggaatgtaacgataagttaatttttaatacatagctgatatcttttttgtatttcttttgatcagaaagtagagataggagttgctaaaattttggggactgctggtaacattccaagaaagtgtgtgaagctaaatcacctactgacaattactatttaatctccctttcttcatagcacattgttcttaatgaggctgttttgacatcctactagatgcgagataagcaggccagaccttaaagggtgcgggctctgaaatgtttttttgtgtgtgttttttttgttgttgttttttttctgtttgtttgttttttttttatttgagacggagtctcgctcttgttgcccaggctggagtgcaatggggcgatctcagctcactgcaacctctgcccccgggttcaagcgattctcctaactcagcctcccaattagctgggattacaggcatgcgccaccacacctggctaattttgtatttttggagagatggggtttctccatgttgatcaagctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaacaggactgcatttcatcaacagcagacttgaggagcatcatcaggaaccagtaacaatgaaaatagaagtcagagatcatagaataacattattttaaaccatgggaccaaatagggtaatttgctgcctgtgtgacttttctgatttttaaagtatgggcatgactctttttgaaagattattatgagtaaattttagaaaactgactgttttatttatcgtttgtcagtacgaggatgtcgtccaggaaagattgtgcagatgactgaagcagaagttcgaggcttatgtatcaagtctcgggagatctttctcagccagcctattcttttggaattggaagcaccgctgaaaatttgtggtatgtaaatgggtaaagttggaaacaactcttttgaatcatgtttttcctcccatgtttaagatctagagaaaacattttttgaaatttttgtataaaacagatcagtaggctttactaaataaaagtgtataaaaattgaaacttataaaaatgacaagttacagacaagatgaaaatacttgctatatatcaacagataaaaggagttctatttataatatataaagagttcttataaataagagaaaggcgatacagtataaaaataacataggaagaggaaggtcttagaagaaattcaaatggccagtaaacataaggacgtcagcttctttttttagtaatcagtgatgtgcaatttaaagcaagtctccaactctagtcagattataaaaaaataccaaagattgatgtttagtgttgtcaaggatgtcacgaaaagggcatcatagtacactggttagaaaaaaataggtgtataatttagagggtcaatatggcgatatctgtggtcttctaactttgatgttatttaaatttgttttgaagattatactactttataccttgtattcttttaagttttacagtgacttttttacagtcctttgtacagtgcccagcaaataagagatactcgctaagtaaatgtttgttttttgtttgtttggttggtttttctttgagacagagtttcactcttgttgcccaggctggagtacaatggcacaatcttggctcactgcaacctccacctcccgggctcaagtggttctcctgcctcagactcctgagtagctgggattacaggtgtgagccaccacgtctagctgactttttgtatttttagtagagacagggtttctccatgttggccaggctggttctgaattcctgacctcaggtgatccacctgtcttggcctcccaaaatgctgggattataggcatgagccaccgcagctggccaataaatgtttgttgaatggatcagttaacttagaatatcacaccttcaagtaagaggtagtagttcagaatttgggggaactaatcaatcccctgtataaacttaagcaaatgtagttacttagaggtgatcttaaaattattagaattaaagtattctttgaaggtgttctttaaaatgtaatatagaaataacttgaaggtaatggaagttatttgtactacatatttctaaaggtttactatttgtctccatatttggtgttaaaaagtgacgtaagttaaactaccagataataaaattgttttagttacctattgttgtataataaatcattccaaaactttgtggcttacagcaacattaatttaccatctcacaatttctgtgggtcaggaattcaggaacagcttagtgggtcctctggctctgggtctctcacaaggctccaattaaggcgtgatctcgggctgcagtcatctgaaggttgaactgtgaaaggattcagttccttatagactgatggactaagagcctcagttccaaatgagctgttggtcagaggcctccctcagttctttgctacgtgggatgcttcattagacagctggtttcatcagcgagcatggaagaaggtgagagagtgcaagcaagatgaaagtcacagtcttttgtaacttaatcttggaagtgacagcccatctcactttcgcttattagaagtaagtcaccaaatatagcccatactcaagggtaggggaggattacacaggatgtgaacattgggaatcatttcatagaagctgcttataacagtaaccaatttttctaaaactgactctttctctttttaggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgtaagtgaaaataaagacttagaaaagtaattcatggaaacattgcctaataattttctggttcagaagagttgctttgattcagagttttttcaaaataagatctgtcaggcataggccaggaagaggaacctgaaactgggaaacatgttactaattaaattggttccttgagatctccttggtcatatttcagattgactgcagcttacttggctgaagaggctcttttaaaattagtttatctagtaaactatccaggtgaaacagaagtcactgtaggcagtggcccttggttttctagtgtccattaaggttttaactctcggcattcttgtggtatgacagcttttattagtcctgtgtcacaagaattattgagaagttctgtgaaactatttaaaagtcaaagtttaatattattagaatttaaatctatgtctgtaaaccttgaaagataaagatactgaatactctggggtatccttattttactctctttttcattagtaggaaatcaacgatttggtattgtatgtttccaagtgttattattaaaataccctactaggttcaaatatggtcttttggttttattagaatacgggagtaagtatttatttggttaattactacttagaatcaattataatcttcaaattgaattttttattgctgtcttccctattagaatctacttttgctttttttcaatccttaattatgttagagacctattcaaactcatatctccttgatttatataatgatttgacaaagtttgagggtatgttatatgtgcaggcactattgtgaacacagtgcgtgaagcaatacacaatacagatgatctctgttctcatggagcttacattttttttcccaagtgtttctccagcattgattggccttccctgtccagccaaatagcaggtcatcagcctagctgggactgtatgtccttgtagtgaaaaaaggctgtatcaggcttccaatgcttaatgaaaatagcctttcttttttcttttttcttttcttttctttctttttttttttttttttttttgagacggagtctcgctcttcttgcccaggctggagtgcaatggcacgatctcagctcactgcaacctccgcctcccgggttcaagcgattctcctgcctcagcctcccgattagctgggattacaggcatgtaccacgttccctggctaattttgtatatttagtagtagagatggggtttctctgtgttgatcaggctggtcttgaactcccaacctcaggtgatccacccgcctcggcctcccagagtgctgggattacaggtgtgagccacggcgcccagccatgagcttacattctaatagaaatgattctgtatttgattttgtattgtatttttatttctgagatgtagtgtgtggtttgaattatttaaatcagactagcagagagaaagtgggttggagtacatcaaactacaacattcttcctaaagctacatcagaaatggaggtatatttttaaaggataaaagataggcaagaatgtctttggggatagaaatgacatcaaatgaaataatgtatgggagagcaacttgtaaacagtgctttgagttatgtacttactcattaaggggcaggttgtggcataaaagcacaggaagttagtacttgtgtctttcatcccttccctagcttagtagttgtaccttattaccaaattcaggaaaatcgagtaactctaaaaaggtgaacatacacttgaggttgtctttgtcgtagctttttatgctaggctacaggaaaattatagcctttgtgcctctatttatacttgctatagtgccaagttgtaattcacacaaaagaatactagttaaacacttggaaattttccttccttggcaataagtttatactgtgttaatcaatgcattagtgttaaaatggacagtttccagaggcaccttttcacttctgcttgcttatttggctaggtatttaactagtccacacactgaacggaaaaaaatgaactaagagcctattagactgtttaaaaattgctatattatactgatcttaaaagacaaaaattgtttgatgtatttcataaaacacctagcacaatctttgggattttttaagtgttaaatttgattaggtttattttatttgtcagaaattctatgtatttatgatgtacaacatgatgttttgaagtatatatacattgcagaatggttaaatcccgctgatttaacatatgcattacctcaaaaagttagcattttgggagaaaacaacacttaaaatttactcttagcattttacaaagatacaatatagtgttaactgtagtcactgttatacaatcgatcttctgtatttattcctactacccaactgatactttgtattctttgaccaacatcttcccatcccacccctacccccagcacaatctttgaagtcttggtaactttactgaaggtattgaatgtttattgtagttgttgcctttttgaaagtacgtaaataacatctttgcattgtagaaaaagttcttctttatagataaacatgaagaaatgaagaaaattgaaatcattcataatcctgcggctttgagataactgatgagaacagttttagattttttaatttattctatctgttctttttacaggcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatggctaaacctcttttaaaaattagaaatttatttataaatgaaaacgtaatgcttctttaaatacagtttcacatataaggagtgtaactagagttgtttgagaaagtctcctttgcctcaagttttaacagaaagacacccctgctatttattagtaaaaatgagaggatatcttcctgcctatattgaaatctttcatcagaatccaaataaaattgagtttcatattcacatatatcaagaattctaggcttcatataatatatttgctttagtattaacaataaaataataaaataatctttggcagattggtaggttactctgtatggcttatgaaataagcttgaagttttttgaaagtttatttgaaaaattaatgtatatgtctaacacctagctagtagatagtgtatgatctgaccatcttgaagagttaaaaacctgttgctaagatacatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccgtattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggatacgaatgtttagcttcattccttgtgatgatacttggattgcctatcagagagaaataatagcttatataccacttcaaagattgcagagtatttttatgagcttttcctgttaatccttctgatcaatagtttatgacttcatgaagataatgaacatgttggagtgggatgtgaaaagaaggtcttagggaaccaagtgaggcactttcacttagaagttaaaatgtttaagattagtggtaagaactggcaaaagtggtaggaagggttgcagttgattatgtttctatgaaggccagggaatgattggaaaaaagaatggtagttttttttttccttgggaagtcttttgaaatataaaggaatttcatttccctggtagggaaaaatggaaaaaaacaattataatgctgtattatatcaaagtggaattcctaataactctgtgttgccctttaagacattaaaaggggcagggcgcggtggcccacgcctgtaatctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactgcagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgtaataaataaaagagcttttttcatagtcaataagccagctacagattactttatttgcagtaatacacaatttttcactttgcactgatcctcaaaatgcggaacctttttatttatagtcataatgtagttatttgatcacaaaaaagattttgctgttgagtccttatacctatttttctaaattccctcattcatactagcattggttatgttcttcaaaaatttgttaaattagacaaaagttttttaattaaaataatctattctttgcttcttaggcaaggatacaactaccttcttttcaaatgtctagtagttttttgttattttctatgtcctctatttgaaatttttagagctttttttcaagggggtgtgggagggatttcaatctgttgcccaggctggccttgaattcctaggctcaagcaatcctcctgcctcttctgagtagctaggggactccaggcatgtgccatacctggcttaaatttttagagctcttaaggctctagagacctgtggtcagttttgtgaaaattacattggaaatctctgggaaggctgggagcagtggcactcacgcctgtagtcccagcgctttgggaggctgaggtgggcaggatcacttgaggtcgggagttccagaccagcctggccaacgtgatgaaaccccatctctactaaaaataacaaaaattagctgggcatggtggtgcgttcctgtaatcctagctactcaagaggctgaggcacgagaattgcttgaacctgggagacagaggttgcagtgagccgagatcacaccactgcactccagcctgggtgacagagtgaaactgtctcaaaaaaaaaaaaaaaaagaaaaaagaaacaacaatcaccacaaaaaatgctgctcagaactacacatcaaccattataaatggtatagatcctctgatgtcagtagccatgtaatacactgtatgttgtaataaattgtgttaggagcttttttttttttttttttttttttttttgagacagagtcttgccctgtcaccaggctggggggcagtggtgcaacctcggctcactgcaagctctgcatcccgggttcaagtgattcttctgcctcagcctcccgagtagctgggactacaggcgcccgccaccacacccggccaattttttgtatttttagtagagatggggtttcaccatgttggccaggatggtctcgatctcttgatcttgtgatccacccaccttggcctcccaaagtgctgggattacaggcgtgagccaccacacctggcctgtgttatgagcttttttacataacacgacttgttgtgttgattattttttaaagtatgcattttatcacagtttttgattgtaattatagaatacatttgactaaacctaacaaactggtatttaaatagtattttatttaaaatgctgtttttaggcctggtgcactagttcatgcttgtaattccaacagtttgggaggccaaggcaggaagatcacttgaggtgaggagtcgagaccagcctgggcaacataacacccatctctacagagaaaaaaaaaatttttttttttaattagccacatgtcgcagcaccgcggctactcaggaggctgaggcaggaggatcacttcagcctgggaagttgaggctgcggtgacctgtgattgtgctcctgcattctagcctgggtgacacagtgagaccctctctttcaaaaaacacccaaagtgctatttttaaaataaggtataatataaatatgtattactggtcattcttcagaatatctgtttatagttcagatgtaaactgatctagtgtgatatgctaggcttctgtttttagcatgttttatttattttagcgtattttaatgagaagttttcaagatgctgaaaacagttattttgatctttgatagtgtctgcaacattcagaaatttaatttataagttaatacattatttgaagcagcctagttgattgtgatgctagctcattaaacaataaatcttgactctgaaattctttttgagacagaatttcactcttgtcgcccaggctggagtgcaatggcctgatctcggctcactgcaacctccacctcccaggttcaagcagttctcttgcttcagcctcccaagtagctagaataacaggttcctgccactgtgcccagctaatttttgtatgtttaatagagacagggtttcaccatgttggccaggctggtcttgaactcctgacctctggtgatccgcccacctcggcctcccaaagtgctgggattacaggcgtgagccaccatacctggcctgaaattcttatctagaccctgttaaggttaaagaattccagattgttgttgctaccattatttgatttttttaatgcatccagagtgtcatgtttcctaaacctcaaactctattctaattttatacagttttattgtctcactgaaattatagattcttgagatcgagaccatcctggctaacacggtgaaaccccatctctactaaaaattcgctgggtgtggcagtgggcgcctgtagtcccagctactcgggaggctgaggcaggagaatggcatgaacccgggaggtggagcttgcagtgagccgagatcgtgccactgcactccagcctgggtaacagagcgagactccgtctcaaaaaaaaaaaaaaaaaaaaagaaattatagattcttaataccttagctttctactggaaagaggctggaaagtatgaaagcattattaagcactgggtgggtgtatattttcgaagagtcagcttcaaccagaaagggcttaagaattgagactgactattccagtggattttgtgtgctagtgaatttcttaaaacaacatacagggagcttgggatatatcaatgatagagattgaatacattgccactaattctacaaatggttttataatgcctctatcaagatatgatgtactgtaactgaaaatgaagatgccctttcctcctaaaccatactatgatgtttatggattatttaaaattcttaaaactgacttaactctttaaaaattatcttcttggctgggcgcggtggctcacacttgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatgtatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactaccattaatatgatgacaatactcaagtaaatatttttaaccctgacctcttttccagggctccaaacattaccaaagtcaaggatctgatctgattttgttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctgttattggctcagggataagtaaaatagactaacagaatagactgtggtgctcagaaacagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttgtatggtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaatggcgcaatctctgctcactgcaacctgtgcctcccgggttcaggcagttcttgtgcctcagcctcccaagtagctgggacgatagccgtgtgccaccacacctggactcttaaacatttattatttgttaacttcacataagccctctcattttgttttgaggaaacatatccaagaaagctaaatgagttgtacaaggaaagcagtaggagaggtggcagagccagttcctggatctcacacttaacaatctagtgatttgttaaccttttatcaccctaaaagaggaaatgtttagaaatattttggggctgggcatggtggctcacatctataatcccagcactttggcaagctgagatgggtggattgcttaagtacaggagtttgagaccagcctgggcaacaaaatgagattccatctctacaaaaaaaatcaaaaatttagctgggtgtggtggtgcgtgcctgtggtcccagctacgtgggaggctgaggtgggaggatcgcttgagcctaggagatcaaggctgcagtgagccatgtttatgtcactgctctccagcccttgtgaaagagctagacccagtctcaaaaaaaagaatgtatttttgtagtatacagcaaacctaacaaaattttcagtgcttctttgaagctttgtagatatgatttagatttttttttttttttttttttttgagatggagtctcactctgtcacccaggctggagtgcagtggcacaatctctgctcactgtaacctccgcctcccaggctcaagcgattcttctgcctcagcctccggagcagctgggattacaggcacgcaccaccacgcctggctcatttttgtatttttagtagagacagggtttcaccatgttggccaggctgcccttgaactcctgagctcaagtgatctgcgcctcagcctcccaaagtgctgagatgacaggcgtgagcgtgaaccactgtgcccagcctcatttttatataatctttgtgcataatggcgattttgataagagcaaaccacactttaaaaaagtatttttgagaccattgaagaatttgattgtggctcagtgcagtggctcatgtctgtaattccagcactttgggaggctgaggcaggcagatcctttgagccccaggagctggagaccaggctgggcaacatgacaaaactctgtctccacagaagatacaaaacagccagatgtggtggtgtgcacctgtagtcccagcttgcttgggaggctgtggcaggaaagtcgcttgagctcaggaggcagaggttgcagtgagtgtagatcgtaccatttcactcctgcctgtgcaatgggtgtgaaactcagtctcaaaaaaagagaacatttgattgtagacttggtaataggtatgaattatttaatcttttaattttttgtttttgtttgaggccgagtctcactctgtcacctaggctggagtgcagtggcatgatctcggctcactgcaacttccgcctcccaggttcaagtgattctcctgcctcagcctcccgagtagctgggactacaggcgcctgccaccacgcctggctaatttttgtatttttagtagagacggggtttcactatactggccaggctgatctcaaactcctgaccccaggtgatctgcccacctcagcctcccaaagtgctgggattacaggtgtgagccactgctcctggccggtatcaattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgccaccactaactagattgtgtactctaaggaagggattacaacttgtttttgaatctctgttgctttatatagttgctgacattgtagcatagtgtatcatgcacatacagtgttgaataaattaataaaagcgtatttaattaagtatatgctgtcccacagtacttccctttctttctggagctttactccccatgacacttactactgctgcctctttctttgatcctaagtgataaaaatgactggctttttattctttgcttattgtatattacatgccacttttatttagcaggatttcttggtggttccattgaaatgaggtcatgttcccacatcctttgattttggcaaagtagttttttgttgttgttgtttgttttttttgtgagacagagtctcacactgtttcccgggctggtgtgcagtggcaccatctcggctcgctgcaacctccacctcccgggttcaagtgattctcctgccttagcctcccgagtagctgggactacaggtgtatgccactagcctggctagtttttgtatttttagtagagacggggtttcactatgttggcctggctggtctcgaactcctgacctcgtgatctgcccgcctcggcctcccaaagtgctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgcttattttcaaataattgtctctaaaattctagaaatattccctttaaaaaagaaaatttgaaagaatgaacaagtaagcaaactaaaaaaccaagaactaaaaacatggagtccatgaccagcctgggcaacacagtgaaacacgaaaccctgtctctacaaaaaaatacaaaaaactggctgggcaccgtggctcacgcctgaagtcccagcattttgggaggctgaggcgagtggatcacctgaggtcaggagttcgaggccagcctgaaaaacatggagaaaccccatctctactaaaaatataaaattagctgggcacggtggcacatgcctgtaatcccagctacatgggaggctgaggcaggagaatcgcttgaacctgggaggcagaggttgccgtgagccgagatcgcgccgttgcactccagcctgggcaacaagagcaaaactccatctcgaaaaaaaaaaagaaaagaaatacaaaaaaattagccaggcatggtggcacacacctgtggtctcagctactcaggaggctgaggtgggaagatctcttgagccccaggaagttgtgactgcagtaagccaagattgcaccactacactccagcctaggcagcagagcgagaccctgtctccacacaagcacatacacagagaaacaactaaaaacatgagtgccatttgctatgtggagcaggggtcacagggattagataaggtggctatggtcttaggagaaaaggttcatctaaattgtaccataaggtaatttcagcagaagcatgttcctagtactgaggtaggagttattttaataagtaaatgccttcgtaattgcttttttatattagcaagtggtgtcggataattttgctaattaaaagatacctaaaataaatttaaaagtaatcttgcccaccgtaaataaatataaaatatttacatattattgtgttcctcaaatttgtagactgagagaaaaattgtttaaattactcagaaattgacaactggttctagaaatgttaactcatcaaggccaggcacggtggctcacgcctgtaatcccagcactttgggaggccgaggcgggcagatgacctgaggtcaggagtttgagatcagcctggccaacatgacaaaacctcatctctactaaaaatacaaaaattcatcgggcttgctggtgggtgcgtgtagtcccagctatttgggaggctgaggcaggagaatggcttgatctgggaggcagaggttgtagtgagccgagatcatgccactgcactccagcctgggttgacagagcaatattccatctcaaaaaataaaaaataaaaataaaaatacagtctgttggcagttaatttaaggagcatgatccatgtaaattaaactcaacttagtaatgttttcagtgtgtagccagtagtgttttcagtgtgtagccatgtaataataatacatattttaaaatcaaagcaagaagtaagctcttcgcaaagtcgttcattgtctggttgttgctcatttaattaaggattctgtagttggattataatgccctcatcaaagtaataattgatgtccctctgaaaaacacgtagattaattaaaataaaattaaatttaaaacttaaaaacaaaaaaagtacttagtgtcccagctccctgtagtcatgatgcctattagtatgttttgtttcatggggagccttgcaaatggcatgatttttaagctttcaggagtggtgaatttattattccaattaagctaaattgtttccattatagaaaaggcacaccagttttaatgttctaagcaaagtttaagaataaaaatcacaacttccaaaacaaaacagggtggtttgggggtgaggtggggcacagtctttgccaccttaaccttaattagtatagatggttcagaattacccaccaataaatgttttttcttctgacatttcctttgacaggtggtggaagatggatatgaattttttgctaaacgacagttggtaaccttattttcagccccaaattactgtggcgagtttgataatgctggtggaatgatgagtgtggatgaaactttgatgtgttcatttcaggtatgatgtaaacataaatatataagaactagaaatctaataaaaactattatcagaattcgttttagatttgtgaagtttccttgagcaagtgttgaaagtctgtttaattcagaagtgattaccactcaaactcattagatatttctattttcagtcacaaagtttccagcatttgtggtatatatcaaatatgaccgttttagggaacctaagttacgtcagtcattcttgattcagatgttttaattgttaaaattcctctatgaccttttgaatagtggcttactaaaagaatgtgaatgtaatgaatagtttaggcttttgttttcttttgcaaagtaaatgggtggaacagacactgggaaaagaattacaaactcagatgaaaataaagtaaaatagttccctggctgggcacggtggctcactcctgtaatcccagcacttcgggaggctgaggtgggcggatcatgaggtcaggtgatcaagaccgtcctggctaacactgtgaaaccccatctctactaaaaatacaaaaaaattagccgggcgtggtagcatgcacctatagtcccagctacttgggaggctgaggcaggagaatgtcgtgaacccgggaggcagaggttgcagtgagccgagattgcaccactgcacgctagcctgggcgacagagcgagacttggcccccaaaaaaaaatagtttcctgaggaaaaaaaactttcaaaataatactaaactacccgtttatgtcacaggaacatttatttatttatttttttcttttgaggaagcacattgtataccatgtacggggggttgtttgctcacttttattataatatttttattaatttatgtacgtactaggttcaggggttacatgtgcaggtttgttccatgtgtaaattacatattgctgaggtttggtgtatgaatgatcttatctcccaggtagtgagcatagagtttttcatttcacattccccctcaccctttccactctagtagtccccagtgtctattgttgccatctttatgtccatgtttacccagtgtttagctcctgcttatgagtgagaatatgtggtatttgattttctcttcctgcattaattggcttaggataaaggcctccagctgcatccatgttgctgcaaaggacctgatttccttccttaattttatggtcgcatagtattccatggtgtatatgtaccacattttctttatccagttcactgttgatggacatctaggttgattacatgtctttgctattgtgaatagtgctgtgattaacatacaagtgcttgtctttttttgtacatacccaaagtagtgggattgctgggtcgaatggtggttgttttaagttctttgagaaatctacacactgctttccacggtggctgaactaatttacactcccaccagcaatgtttgaacattcctttttctccacaaccttgctgacatctattatcttttaactttttattaatggccattctgactggtgtgagacagtatcttgtggtttgatttacattaatagtgatgatgagcattttttcatatatttgttggctgcacgtttgttttttgagaagtgtctgttcatgtcctttgcccatttttaatggggttgttttttgattgttgaattaaatgccttatagagtctggatattagacctttgttggatgcatagtttgtattttctctcattctataggttgtctgtttattctgttgatagtttattttgctgtgcagaagctctttagtttattttggtcccacttgtcaatcattgttttggttgcagttgcttttggggacttggtcataaattatttcccaaggacagtgtccagaatggtatttcctaggttttcttctagggtttttatagtgtgaggtcttatatttaaatctttaatccatcttgagttaatttttgtgtatggtgaaaggggtccagtttcagtcttctgcatatggctagccagttatcttagcaccatttatcaaataggcagtctcttctccattgcttgttattgttgactttgttcaagatcagatggttgcaggagtacagctttatttctggctcctccatcctgttccattggtttatatgtctgttttggtaccagtaccatgctgttttggttactgtaagccttataatgtaccttgaagtttggtagtgtgacgcttctggctttgttctttttgcttaggatgctttggctattcgggctctttttcaatttcatatgaattttagaaaagttcttttctaatgctgtgaaaaatgacattggtagtttgataagaagagcattgaatctgtaaactactttgggcagtatggagattttaacaatattgattcttctatccatgagcatggaatgtttttccatttgtttgcatcacctctgatttctttcagcagtgctttgtagttgtagagatctttcacctccctggttagctgtattccttgatattctttttgtggctattgtaaatgcagttcttgatttggctctcagcttggatgtttttgatgtatagaaatgctactggtttttatacattgattttgtatcctgaaactgattaacaaagttgttcatcagttccaggcacgttttggcggagtctatggggttttctgtgtatagaatcattatcgtcagtaaagattgtttatcttcctctcttcttatttggatgccttttatttctttatcttgcctgattactctggcagggactttcagtactctgttgaataggggtggtgagaatggtcatcctagtctcttgttccagttctcaaggggaatgcttccagcatttcccttttcagtacgatgttggctgtgggtttgtcagatggctcttactattttgaggtatgttcctaatttttcagtgcctaatttgttgagggtttttaacatgaaagggtgttgaattgtattgaaagcctttctgcatctattgagatgatcatatggtgtttgtttttaattttatgaggtgaatcacatttattgatttgcatatgttgaaaccttgcaccccaggaataaacccttcttgattgtggtgagttaactttttgatgtgttgctggattcggttttagtattttgttgacgattttgcatctgtgttcatcagggatattggcctgaggttttcttttttccttgtgcctctgctaggttttggtattacaatgatgctcacttcgtagactgagttaggggggaggtcctcttcctggattgtttggaatagtttcagtaggattggtactagctctttgtacatctgatataattcagctgtgaatctttctgggccagggctttttttggtttataggtttttttattactgattcagttttggaacttgttattgttctgttcaggattttaatttcctcctggttcagtcttcggagtttgtgtgtgtttctatgaatttattcatttcttaggaggtcatgtgtgtttctatgaattcatttcttgggagcgcatgtgtgtttttgtgaatgtattcatttattctaggtttcctagtttgtgtgcacaggtgtttataatctctaggtattttgtatgtctgtggggttggttgtaatgtcacctttctcatttcagattgtgcttatttggatcttttcttaatctagctagcagtctatcttgtttattcttttgaagaaccaacttttggtttcaacatttacatttttaaaagaggccagttttagctttagtgtgctcctacaaatcattcttgttcactgagtaaaacagcttcagtactttgcttttgcaaaggctattctatgtctttgatgtacacacactgtatttctcttaaaatgcattggggctttcccattcctctttctctttatcataatatactgtttccatcaattagtacaattgaatggtaaatggttgattgctcatttacaaattaaatatagtaaccataccttatccttccagcagttgtcatagtggtgttggattaatatattctcttcactaaggcactattatgttctaaatagtttttaaaaaatactttgtacatatttctatactgttttagttttggaaaatcatgacttttttatgtataatgtaggttaaagctctatttacatccaccagaatgagtgtagtaaaaaagccagactgtatcaagttttggcaaggatttggaggcattagaatcttcatacattaatggtgggaatagagttctcatatgatgcagcagttttacctctaggtatatacccaagatatatgaaaacatgttcacacaaaaactgttacataaatgtgcattattccttatagccgaaaaagtcacacaattcagatgtccatcagctactgaatagataaactgtggtacatccatacaatggactgtacaatgtacaactcagcaataaaaaggaatgaaggactgatacttcaaaactggttttgaaaacctgagtgaaagaagccagtcacaaaagaccacatattatatgatgccagttatatgaaatgttcagaataggcaattctatagagacacatagtagattagtagttggttagagttagaggatgtggagagcaggaatggggagtgactgctgatgggaacaagctttctttttggggtgacaaatgttctaaaattagatttatatcaataaagctgttttttaagtaaaaagatctatttatacataaataaataaggtctgaagggtttgtgacttgtaggttagttaccctcctaagttactgtatcagaattatgatgacaacatagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatg

SEQ ID NO: 35863 - DNA, 51192 bp, Homo sapiens; identical to SEQ ID NO: 35862

SEQ ID NO: 35864 - DNA, 248680 bp, Homo sapiens
atactttaggttataacttaatgcaatgtactttatattgctgctcaaattgtcccaggcgcggcccccggaagctctctgggtagatccctgcgcccttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgagtgtccctgtttagtccggacgaccctagctcctttcccctctggcccgcgcctctccagattctcctctagagctgcccagcctcgcgcccctctgaggggaccccgcaccgcgccacctccgcggtgtccccactccctaattttccctgaggctcctggccacgggtccgcccacctccctggaccaccctgaccttccccaggtccgccctctcagtctcccctagagcagcccattcgagagccctcccagtgggcccccccggcctctcagaccccttcccatcgcttccccggcgtccgcctccggtcctttccccgagcccctcctctccggccccgcggaccctcctcctttcccgactgcagcctccgccttgcatcctttctggccgctcgggagtgtcccacatgtctgactgccgggacctgctgcggcccgccgcctggggtctcccggcgtccgatctctacccctgctgctccctctgctccagggaacttgccttctcagttctcctgcccagaggtctcccctccttaagtcccggggggcgttgaggctttaccctcgcggtgcggtccgcccccgctgcatttcacctgctcttggccttgcaatgtctttagtcataagtgcttggtgtaccttatcttacatatctctcttcatgtttgattctgttactcaactagattgaaaactccggaggtcagggatttgcatagggatccccgccccgccaccccgcttaaatctcaaatgtagaccggttcagggtgggtggaggaaaggaatgaggtggagtggtcactgtaaaaaattaaaggaacatggttaattcaaaataatactgactcatggtctcagcctttaaatttttagtgcttaggaaagggtggaaccaccaccgagggaggagggctgacagctgaggggaggaatattccaaggtcttctgtggcctttggtatgaaccagtaccaattcaggaagtgacttgtccgaagtcacatgaggaattaggacccgagctggcactggtaactgcctgtttagtgtggccctcagtatttgttgactaaactaatgaccaaaacatgtatgcacagacacagctgtgcgtctgtgcccatgcagtgggtgtgtctgcctaaggacctgtgggggtgtgggaatactgctgtgacggttcaattgtggtgctcaggagtgttccctaggttcagaaagttcctaaccctgggctggttggctggatattgataggactggagcttgtctgggcttcctttgtgcctggtgtttactctctgtggtggtgatctctttactcgactcttccctattcgtactgatctccctgaggacaggaatcaaactgtgttgcagggtttccctaataaacagcatagtgtttggcactttgtaggtggtcagtaaatgcttattgaagaaggctgcagaaaagaactcagaacctgacagcggttctttgctagcattatattttaaaggcggtggtacattctgtaagtaaatttcctgctattctcaaggactgagttgattaaatgtgtacagcagtggtatagagaggacagatactcttgtggtgttactccttgggaaggtggaggtttctctcagctctttctgaaagctttgcttatgcttttcagcttgcattaatatttttgtttctcctttcctctgcctgccttcttactgtttgtctaaagaaattaaagaattaccttattaataacagtaactaccaaaaactgcaaaacacactgttaaaaatgctcccaaagtgggggctaattgacccagttgttttgttagttatatatttgcttccacagtggatcatggaaacggaaagttggacttccttgcctctttgctttctttgcctgtctgccctttgatggtgcttgtattaggcttgttgttaagaagtggttcccaactggaaatggccaatgccacgtgggaactgacctctacatgttgatgggtcacccaaccttctttcccttctgtttcagaatgtacctgtgacatctctttgactctccactgttgcccttgaagaacagagatgagttttcttcctttttcataaggaagccacttttatagcgaaagagagctggagaactgggatatcatgaggagttgtagacagttaaacctgaattctagcttttggaacaaaatagtaatgtaattgtagcagttctcacttttttattttttatttttttgagacggagtttcactcctgttgcttaggctggagtgcgatggcgcagtctcggctcactgcaacctccgcttcccgggttcaagggagtcccctgcctctgccccccaaatagctgggattacaggcgtgcgccaccatgctcggctaattttttgtatttttaatagagatggggtttcactatgttggtcaggctggtctcgaactcctgacctcaggtgatccgcctgccttggcctcccaaagtgttgggattataggcgtgagccaacgcgcctggccaattctcacttttggaccatctactacagggctgtttggacatacctcctttaattgtcacagtaaccccatgacgtaattggttgtgcctggtcatacaggtaagaaaactgaggcttagagaggtttagaattttgctgaaggtcatactagtgagtagaaggcaaagtaggcttcaggcttagaactgtcagattccaaaggcagtattttttgtccatctgttgtctgtttcgattcaatgctttcaaagagatacaaattcaaatttaaaataatttaaattgttgaatatggcttacattttaaagctttgcataggttttattggcataaaaataatgttcttttgcagctagtttgctggtgttttattctctagagaccaacagctagggcttagtgtttatctgatgagttttagtttatgcattcagttttgctccaggatataaatagtgaaatgttgaattaagttatggagtggtgtgaaattcagcatgctaaggcaatcaaacagaagtcttctgagccatttgagaagcagcttgatgtccttgttcttagaacagggctgtccaatctttagactttcttgggccacattggaagaaggccatacataaaatacactaaccctaatgatagctgatgcactaaaaaataaaattgcaaaaaaatctcataacgttttaagaaagtttacaaatttgtgttgggctgcattcaaagctgacctgggctggggccatgagttggacaagcttgttctagaatattttcggcaaattttggtaagggggaaaataagtaatagtaataatagtagtaaatagtaataattgctgtcaaagcagctaccatttatcgagttctagtaactgtgaggcaccatgccaactacttacatattatttcacccaattttccgaacatcctgtcaagtaggtggtgggaattttcgttttatagatcaggcttggaaacgtgacttgtccgattgagtcaggatctgaacataggtcttttaactctaaagcttatacccaaacactgggttctgtgaaatttcaaaagcatatgataggctgactgcagtggctcatacctgtaatcccagaactttgggaggctgagatggaagaatcccttgagcccaggagttcgagaccagcttgggcaacatagtgaaacctcgtctctacaaaaacaaaacaaaatgtgatcaaaatcatacttcatgatttttggtttctaaagatactctctaaatttctctccccaatttaaaaacgaaagcagagcactgttggaaggttcaaataggtagattaatttaggttggtttttttgttttggtatagttgaagataattcaggttattgtttacatgtttacatttatcaaaataatacatgtacatagattgaaagaccaaataggctgagcgtggtggctcaagcttttggaggccagcacttttggaggctgaggcgggtggatcccctgaggtcaggagtttgagaccagcctgaccaacgtggtaaaatcccgtctgtactaaaagtacaaaaatcagctgtgcgtggtggtgggcgcctgtaatcccagctacttgggaggctgaggcaggagaatcgcttgaacctggaaggcgatgggtgcagtgagccaagatcgcgccactatactccagcctgggcaacaagagcgaaactctgtctcaaaacaaacaaacaaaaaaaacaaccaaatagtgctttaaaccttagaataaaaaaaaatatatcaatctcttgtccaccccctttttaaactatagacaactattttcacctttttttggcactttttaaaatagtattttggctgggtgtggtggctcacacctgtaattccagcactttgggatgccaaggcaagtggatcatgaggtcaggagatcgagaccatcctggctgacacggtgaaaccctgtctctactaaaaatacaaaaaaattacctgggtgtggtggcggttgcctgtagtcccagctattcgggaggctgaggcaggagaatggcatgaacctgggaggtggaggttgcagagagctgagatcgcgccactgccctccagcctgggtgacagagtgagactccgtctcaaaaaaaaaaaatagtattttatctttgtggatatggtaaaattgctattgatttacatgtaatcttttgacttttgatcatagaagacttttgctgccttgtaaaactcttcaatccaccagtgagtcaaaaacttgtaggaaatttgtcagttactttttttcctcccctgtagtactcggtcctgctccagtctggactgtttttttttttttttttcctccccagtccttctgcacagctgcctttctgggaatttcctcccctgccagttgaagaccgaatcctactctgtcgcccaggctggagtgcagtgacatgatcattcatggcttactgtgcttctaccttctgggctcaagcgatcttcctacctcagtctcccgagtaggtgggactacaggcgtgcaccactatgtgcagctaacttcttatttttttgttgagaatgtctcactgtgttgctgggttggtctcaaactcctgggctgaagcgattctcccaccttggcttcccaaagtgttgggattatgctcaagagccaccatgcctggccttgattaatgatttgactgggtgtggaattctggcttggaaataattttccgttagcattttgaaggtattgctctagatgtcctgtgtcttgctgattgttgatcctttatatatgcttttttctttgggaagtttttaggttctcttctttgtccttgatgttatgaaatttcagtcatcctacctatggagaatcttttaaaattcatcatgctggacagtcattggatcttttgaatctagaaatgtgttatcctgttgcaggaaatggttttatagtattatttctctgctcttttctctgtggtttatttatgaaattctcctataagcagaatttttttttttgagacggagtctcgctgtgatgcccaggctggaatgcagtggtgggatctcagctcactgcaacctccgtctcccgggttcaagtgattctcctgcctcagcctgctcagtagctgggactacaagtgcgtgccaccatgcctggctaatttttgtatttttagtagagatggggtttcaccatactggccaggctcgtcttgaactcctgaccccaagtgatctacccacctcagcctcccaaagtgctgtgattaacaggtatgagccactgtgcccagccagcagaatattttatattccaggctcatcctctaatttttttccatctcttggtcttttttttttttttttttagctcttcatttcagagagatttcttccatcttgatctttccaactcttgtattgaatttttaattttggttattatttttaattgagagctctgaatatttctttttattcttgttttttttttttttgagatggagtctcactccagtcacccaggctggagtgcagtggcactatctcggctcactgcaagctccgcctcccgggttcacgccattctcctgcctcagcctcctgagtagctgggactacaggagcctgccaccacgcccaactaatttttgtatttttagtagagacggggtttcaccatgttggccaggctggtctcgaactcctgacctcaagtgatctactctcctcggcctcctaaagtgttgggattataggcgtgagccactgtggccagctgtaaagtaatatttttaaagttttcttttgtacccagcattgtctctgattcttgaggtttttttcttgaaaattttattttctttaatctctatcttttatggtctagatttttctccagtgtctgattgtggtactgtgaaatgtttattttgtctttgacctcatttcctgccttacaactcctatttaatacaatccttaaaaatctccaaaatgatgtctttttgtatgctaatgattgattgatggcctgcagactcccttcaggatgggagctggtcatctgaaacacctatgcgactttagagggttggaactttcatgtctgccccccaaccttccaggaaggagagaggggttcaaggtgatgttgatcaccagtggctgttggtttaatcaatcatgctaatgtaatgaggcctccataaaaacccaaaaggattgggtttggggagcctccagaatagccgaacacctggaggttcctggagggagggtggtgtgcctggagaggcctgaacactaacaccttgccctatacatctcttcatctgtgtcctttgtaataccctttataataaactggtaaatataagtcattgtttacctgaattttgtgagctgctctagcaaattaatcaaacacagggagatgggggaattctaatagacctaaagaaagaaactaaagcaaaaattactataaatagagagtttatttaggccagatttgaggacagcaacctgggaagcatagattcaagttgctctgaatatatgctttgagtagcaacagttagaagtgggattttaaagggcaaaaataggggcagtttctaagttgaacataaactattggttggctgtatattgttctttgtaccacacattccaggaacatgaagaaaatgattgagggtcacattgtgtaacttgtagtaacagtcttggtaatttatcagcttgtctggaaactacaggaaagggaagattaaaaaaaccccaagtccctttaaacagttaaccctgagcgtggctggggctgtggtaactaaagacccattttctaaattttgccggctttatgttcttcagattgctctgagctacttttctttctcactgacttaaagctagttgatcacatgttccagaggccctgacttgtggctggtgtctgaagggtgggcagtcttgtgggactgagccctcaacctgtgggatctgatgctatctccaggtagatagtgtgacagttgaattgcaggacacctagttggtgttcgctgaagaatttttttttttttttgagaccgggtctcactcctgcccaggttggaatgtagtggtgtgatcacggctcactgcaacctccccatcccaggctcaagtggtcctcttacctcagccccccagtagctgggactacaggtgtgtgccaccatgccccgctgatttttgtatggatgaggtttcaccatgttgcctaggctagtctcaaactcctgagctcaagtggtcccctgaccttctcctcctaaaatgttgggattacagatgcgcaacactgtgcatgggcctgctgcataattgatttcttgcttggtatgtggggagaaaccctcacacatttggtcacagaagtcttctatgttgattgttgtgacgtgagagcagaggaaaaacagtatttttttctactcagactgatgatacttgctctgtattcctatttaagagaggtactgaaaagctgattggaagtctgtgtgtttgcttcaagtctgtctcttggtgagcttctctggagggtgttaggcaaagtttggctttttcattacagaacacccagttgtcagtatcagtgagcctttcctcttgggactatgcctttgctctgagctagagtctgagaagtaaggaagaagatggagaatttgactttcacggactatattcttctaagtgtggcctgcgactttaagctgtgtgtagtgtggccacgcccagtctccagaggcatcatcttcaggatcagggagggtccctgtctgcttgggtagggtgcctagtgacccctttgaagactttccattaattcttctgatttctccccacctctagaattctctcttacccccaatttctgagtctgtttttatgtggcaggagttggcttgctgtgttttggcttctgttagcacataacaaagtagaggtggccatattttatgttagttgacacttgtctgtttgtcttagaactttcaaaatgttgtgtctcgtctgcttttgtctgctgctgttctctgtggatttatgccttgttttctccttaactctcattttagttgcatttcaggagggagtggcccaggctggagtgcagtggcgtgatctcagctcactgcaagctccgcctcctgggttcgcaccattctcctgcctcagcctcccgagtagctgggactacaggcgcccgcccccacgcccggctaatttttgtatttttagtagagacggggtttcatcgtgttagccaggatggtctccatctcctgacctcgtgatccaccctcctcagcctcccaaagtgctgggattacaggcgtgagccatggcccatccctgccctggagacattttgcccattgtcttggtgattaacattggacttcttgttacttatgcaaatttctgcagcaggcttgaatttctccccagaaaatgggtttttcttttctgttgcatcatcagttggcaaattttccaaacttttatgctctgcttcttcttgaaggctttgctgcttagaaatttcttttactagataccctaaatcatctctctcaagttcaaacttccacagatctctaggacagggacaaaataccaccagtctctttacataacaatagtgacctttactccagttcccaactagttcctcatctccatctgagaccagtgcagcctggaccttattgtccatatcactatcagcattttggtcaaagccactcagcaagtctctaggaagttccaaactttcccacatctttctgtcttcttctgagccctccaaactgttccaacctctgccttttacctgtttccaaagttgcttccacattttcagttatcttttcagtagcattccgctgtactggtaccagtttactgtattagtctgttctcacgctgctaataaagatatacccaagactgggtgatttataaaggaaggaggtttagttgactcacagttccacatggctggggagttctcacaatcatggtggaaggcaaatgaggaacaaagtcatgtcttacatggtggcaggcaagagaacttgtgcggggaactcccatttataaaactgtcagatcttgtgagacttattcactaccatgagaacagtatgggggaaactgtccccatgattcagttatctccacctggcctcactgttgacatgtggggattattacaattcaaggtgagatttgggtaggaataaagccaaaccattatcagaaagtatgtctttttttttttttttttttttttttttttttgagatggagtctggctcttttgccaggctagagtgcagtggcatgatcttgactcactgcagtctccgcctcccgggatcaagtgattcttctgcctcagcctcccgagtagctgggactacaggcatgcgccaccatgcccagctaatttttaatatttttagtagagacggggtttcaccatattggccaggatggtctcgatctcttgatctcgtgatccacctgcctcagtctcccaaaatgccgggattacaggcgtgagctactgcgccctccagaaggtatgtcttttctttaacacattctactgtaatatatctcattttaatcatcttatacccagggtacctttcagccttagttggttgtaatagactgtaatttttactttgaattttacacttgtgtcacaatttagccattagattctctttcttcagctgagtggcttcttgatgctttctgaaggcactcttgaaagcatctgtgctttttgataataagatatcctgcccctaaactgtaactagctcattttcaaagagtactggcttgttttagaggagactagtggtagagataaaaatctgctctgggaggtacatgagattgttccacagaatgaggagaggtagacaggatgacataagataagaagctacttgagtcagcagaggaattactcttttaaaaagtgaagagtttctgttgctaattccagtttaagttcttttctgtctcataatctgatttcccctttctctaatagttttattttatataggcacatgaaagatacgtttataatgtcctctagatgtagacatttccatttcttttttctttttgaatcttactcaagtggcccgagttgtttcccaagtctgctgttcagtttctccttgttgccatcccttgagactcaactgcctgaaaagtaagagaaacccaggctaacctcaaggaaacaccagagaaaacataggcacaacattcgttgtattagtctgttctcatactcctttaaagaactacctgagaccgggtaatttatgaagaaaagaggtttagtcgactcaagagttctgcagactgtacaggaggcatggctgtggaggcctcagaaagcttacaatcatggcagaaggcaaaggggaagcaggcatgtcttcatgtggcagtaggaaagagtgaacacacttataaacaagtagatctcctgagaactctatcacaagaccagcaacagggatagttgccaccgtgatccagtcacctcccaccaggcccctctgccaacactggggattacaattccacatgagattttgggtggggacacagagccaaaccatatcatctggcaaatcagatgttcacccacacaattagtacataatactccaagatatcaggaaatctcaggatccttaaggttttacctaaaagtctcttttaactctttatcggccaggcacagtggctcatgcctgtaatcccagcactttgggatgccaaagcaggcagatcacttgaggtcaggagtttgagaccatcctggccaacatggtgaaagcctgtctccactaaaaatataaaaattagctgggtgtggtgacacctgtaatcgcagctgcttgggaggctgaggcatgagaattgcttgaacctcagaggcggaggttgcagtgagcctagatagtgccattgcactccagtctgagtgacagctaaactccgtccaaaaaaaaagatagcaaatgtagccaaattaatatcaagaaccattagaaggctgggcatggtggctcacacctgtaatcccagcactttgagaagctgaggcgggtggattgcctggccaacgtggcgaaatcctgtctctacttaaaatacaaaaaattagctgggtgtgatggcacacgcccgtaattctagctacttgggaggctgaggcaggagaattgcttgaacctgggaggtggaggctgcagcgagcggagatcattgcactccagcctgggcgatggcacaaacaaagaaacaaacaaacccattagaaatgtaaagaaattgaccacagaagttcaggagactcctgttactccacgtttttatattcactgtgtcctgtaaccgcctgcgaagttgcatggctgtgtttcagtcaggttttgtatttgtcatgactacgtagttctcagtaccttttctagtaatttttagcctgttctcatttttttttgtatgaaatatactgggaattcacattatggatgcaggaagctgtagtatgaatataaatatctaggatttgacgtgaatgcgtacgtgctttgccctctcatttttttgtgttctgggttaataaccccactgcacagatgtgatactgtctacaacattccttcctttttgtttcgcctgtttcttctgctgtactaagctacatgagagtagcattttggcttggtcactgctgtatccttagtgtctaggacaaggctggacacaagtaaggtgttctaagaatatttaatgaaaatatgatgctggtagttctctgcttcaaatccttttggaagtaaaatgattgttttaggatattttaggctgtaagttgcaggaaaccaaattcaaccatcttaagtgataaacccatcatgctgcttagtagaaagtcttgggtaagggtgggtttgggggttggtgaagtaagtggctcagcagtgtgagctctgctgtctctgcgtcagctgcccccagccggttcctcatggtcagaaggtggctgccagcacagtgagcagcagtgtgcttccctgttaacatcatcttagagacagggagactggcttttgtttgctggggattgtatgtttgagaacctaaatgtggtagagaaagattggggaaaaatgaaaaacatttcgtttcttggtaaggacagatagcatgaattgaaaaaaactgcaaagagagcaagaagcttcagcgtgcatgattttggagatgccggagtatggggtgactgaggcttgtggcactctttttaaaggtttggagaaagatgagaagtcaaccatgcttagatatggggaaggagctacattagagactcatttgttcttctgaggtgcccacttgcgcttgtgctaaccttaccaaccttagtgccttaaagaaatagctaaaaaagctaaagcaaggccaggcgcggtggctcatgcctgtaatcccagcactttgggagaccgaggtgggcatatcacgaggtcaggagatcgagaccatcctggctaacatggtgaaaccccgtctttactgaaaatacaagaaaaaattagccgggcgtggtggcgggcacctgtagtcccagctacttgggaggctgacgcaggagaatggcgtgaacccaggaggcggagcttgcagtgagccgagattgcgccactgcactccagcctgggtgacagagcaagattccgtctcaaaaaaaaaaaaaaaaaaaaaaaaaaaaaaagctaaagcagaaaacaaaagtggcccatggtctcagcttccagataataactattgatttcaaaaaataaaatggcctgggtgcggtggctcatgcctgtaatcccagcactttgggaggccgaggcaggtgggtcacctgaggtcaggagttcgagaccagcctgaccaatatggtgaaaccccgtctttgctaaaaatacaaaaatcagccgggcatggtggcatgctcctgtagtcccagctactcggggaggctgagacaggaaaattgcttgaacgtggaaggtggaggttgcagtgagctgagatcgcgccactgcactccagcctggacatcgcagcaagaatccatctcacaaaaaaaaaagcatgcaagttgttaactgtttcaaacagtacagaaaggggtaatgggaccaatcaccctctttgttctgtgacacacacagaatcgcctcattttgtttccagagacacatctttcaaaggttttaggattcctcccaggaggcagcctgcagcacatgctgctccgccttgcctgcctggtgatctgtcctgtgtggaggtacccgctcagcagtcctccgtcgtggggcatgttggcgcgcttctgcagtatgtgtgatgttgccgcgagtgtttatatatatatctgtgttggtgaacctctgcacatatctcagtgaggcaaattcctagtcatggtgagattgctggggcaaagtatatgaactattaaagtttcaatagattttgtcaaatttccctttggaaaggttgcatcagttttctttctgccattgtgctttctccttgctgggtgtcttggaggttttcatttgtgcccacctgagaggtacagtagtttactgtacagttggaattgtatctgttgaattgagtgggaaattcagtgtctttttacgagtttgttgttcttttttctgtgtgttcttttttctgtgaactgctaaattattgccttttctgtatgatatgtgtgaactttgtaagtgaaggaaataagctccttgctgccatatggttatgaatatttcttcttcttcttttttttttttttttgagacagagtcttactctgttgcccaggctggagtgcagtggtgcaatctcggctcaccgcatcctctgcctcctgggttcaagcagttctcctgcctcagcctcctgagtagctgggattaggcacggaccaccacacctggctaatttttatatttttagtagagacggggtttcaccatgttggtcaggctggtctcaaactcctgacctcctgatccgcccacctcggcctcccaaagtgctgggattacaggcatgagctgctgcgcccggccaatttttgtatttttagtagagatgaggtttcaccatgttggccaggctggtctcgaattcctgacctcaggtgatccaccctcctcggcctgagccaccgtgcccagccgtgactgtttcttctaatttatcacttttaaagtctcatttaactttttttccatacagaagatttaaatttttatggagttgactttatgaacctttttcttgatgacttttgtttttttgccctgacctggccactccacgtcactcactgctgacaccagtgcagcacccctgcctgggccatgtggaccccactgggaacgccaaatgtaggcacctcagggctccagcaagccacgagaatcccccatgtccttgacagagctaaatcctgtgtccctggggctgctttatgtttgttgagtggtgttagactcggtcaggtgggctgggtggtgaggctgaaggcgagtgtgggaggaagggagggggtacagagtgcggggcacatgaaccccaatgaggaggtgtttgttaaatgccaggggggcactgagctaaaatggccttgggcccttcctcagctgatgctgaaggggataaggatagagactcgggccggacaggctattctctttctgggtatgattttgaacctgcctgtttttgttctgtaggtgaagagatggcgtttgtgaagagtggctggttgctgcgacagagtgagtacaggatgtgcggtctgcgatcggcattgccgaagggcagtctctatttctgtttgcttaaagttgatcatatttaaaagcaaataacaaagttttatgagtgctatggccttgagtttccccttggacattcctagatctctgtgaactgtcttgcacaccacggagctcctccttggttgctgagttgacaggaaccaggaaatgatggcagtccctgctgctttcgctctcctcactagcatgctttactttttaattttaatttattttatttatttattttttgaggcagagtttcactcttgttgtggagtgcagtggcgcgatctcggctcaccgcagcctccgcttcctgggttcaagtgattctcctgcctcagcctcccgagtagctgggatcacaggcacacaccaccatgcccggctaattttgtatttttagtagagaaggggtttctccctgttggccaggctggtctcaaactcccgacctcaggtgatctgcccacctgggttcccaaagtgttgggattacaagcgtgagccaccgtgcccagctgcgtgctttattattaatgatggatctgggactgcctggatctaactgagcccagctgagatactggaacagaggtgctggtctctctgcctgtcttatctggggattgagcagtgactcagattctcaaatattggagtctttgtaattatgtggctgaagagttgatctgaggcaatgagttcatctaaaaccaaaacttttgtgtctccaaaaggactagagaagagactcagttctttttttatgggattgagatccactttcctaggcttatctctgcaaacctgtctttcatacactgtctgcttatctctgaggctgtcactccaggtgggattcatactgtgttttatttttatttatttatttatttattttttgagatggaattttgctcttgttgcccaggcgcgatcttggctcactgcaacctccgcctcccaggttcaagtaattctcctgcctcagcctcccgagtagctgggattacaggcgcacgccaccatgcctggctaattttgtatttttagtagagacggagtttctccatgttgagcctggtctcgaactcctgacctcaggtggtctgcccgcctcggcctcccaaagtgctgggattacaggcaaagtgctgggattacaggcgtgagccaccgcgcccggcctcatactgtgttttaaagtgggaagaaccagtcttatttattaaaaaatgcaagcagaatattctgctatactagaaagagtgaagttaagggaaaagtgactaccatgtcatttatgattctagtcaaaaactgagctgtatcacataccattgattgttcagagacttgagtttatctatgagggttactttcagaaatttagctaaagtcaagtctaccagtaagaattgatggcatacctgagatggtttatcaaaactattgtttacgaattgtttgtgttcctgttaaatagattttatgtatatattcttaattctcacaacagctgtatgagaggtaagtggtattatttccagttgaagaaattgagattcagtgaggttaggtacttgtctaagtgtgaactgtgggtgacaaacctacattcaaagtcaggactgtgtgatttcaacactgacattatatgcacccagagaccggtcttcagcctgtgtgtctgtgactagttccatgttcccaacctggagctgaactgtatgtccccttgtctgttagtcctgtagtcttagaatagacaaaggtgtcgtaatgttagcttcacaaagaaagtcctggcttgttgaagtctagcccaagtttcctagtcttgggttttgcggtctcaacgtccccatggtcaggggacatggggacccttgctcagaccttgagggtgtgccctcctttggccctttggatgtcctttgccacacccttgtttgagggcaagctttcccttttccaccacaacttgaagtaagtgctctgtcaacatagtgatcagtgactcttttgacaattttgtcctccccatcacgcctagcatggtgatgtacacaaaatagatgtactttaaataagtcacatagacttttccagtgttctggtccatgggtgtttcagaagtgtgtattcagacgatttactctgtatataaccccatccccatatgtatgggttaattttccttctttcctgaaagtagaagtatcaatgccagtaaaacgaggtgagatacattatattcacggggttgtagagcagcagagatacacatgtgatgtggtcacaggtaggcaaagccagccttgggacttattttcctgccattgccacatgtactgttgggacccagtcctggcctctggaggacagcctgacttgggagtctgcagccagggctttgatggcaggtgagatacttgggcagaactccctgacccagtggttccacctgtctctgtgtttctgtggctctatttagtagggctttttgtttgtttgagacagagtcttgctttgtcgcccaggctggagtgcaatggcatgatctcaacttactgcaacctctgcctcctggcttcaagcaattttcctgcttcagcctcctgagtagctgggattacaggtgtgcgccaccatgccaggctaatttttatatctttagtagagatgggatttcaccatgttggccttgctggtcttgaacttctgacctcctggtccaccccccccacccccccccccgccccccgccctcggcctcccaaagtgctaggattacaggcatgagccactgtgcctggcttttttttttttttctttttaagacagggtcttgctctgttgcctaggctggagtgcagtggcgtgataactgctcactacagccttgatcttccaggttcaggtggtcctcctgactcagactcccaagtagctgggactgctggcttgtgttagcatgtctggctatttttctctttgtagagacgggatcttgctttgtagtccaggctggtctcaaactcctgggctcaggtgatccttccacttcagcctcccaaagtgctggaattacagatatgagccattgcgcccagcctatttggtagtttctgcacagctcaggtagtcaagtggatgcttgggtatcacttagtggtcagttaggcaagtgcagtggacacccctcctggtgaggagagtgcctgatactactggcaggaaagccgaatggcgcatatctggttgacaccagttgcaggcacggcaacataaagggaagtacacgaaatgggattgtgtgtgttggccaagaatgggatgagatgtacaggaacagaaggtgtagtgggcagtgaatggatgtgaggaaggtaaagagatgaccggagctacaactggcctttaagtccactgcaggggttttcccttcatgcagtcaaggaaattactgttttatataccaagttaaaggaaattactgttttatataccacgttaaatacctggtccaagatcacaaatgaaaggttgaatttgctcaagctgacagaagtacgtgaggtagtaggatgtgcacagcatgggaggccaggcagggcctggtctatatcctgctgtgctcatttatccagtgtatgcatcaggaaggggggagccttccacactgtgggcttctgtgggaaatggtaggaaagagtatctgtgaaaactcttaaggacaaagaaaaaaaacgtgttttttcttttttttttttggagacggagtgttgctctgtcccccaggttggagggcagtggtgcgatcttggctcactgcaacctccacctcctgcgttcaagcgattctcctgcctcagcctccctagtagctgggattacaggtacgagccaccacgcccagctaattttttgtatttttagagatgggatttcaccatcgtggccaggctggtctcgaactcctggcctcaagtgatccatctgcctcggcctcccaaagtgctgggattacacgcgtgaaccaccgtgcctggccaaaatgtgttttttcaaaagagaaagatattatttttatttgcgtatagagacttcacagtccagcattttctgatcaatctggcaatttagacaatatttggaaatttagaaagttgaaaagtttgagaggtttaaagtttagtactgtatgaggaattaaatgttagatatgtttcatttgctgaaaagcaagctttttaatagaaaccctaaccggaaagtgttggaacttctaagttggttggcagcattctctgttgacagtgtgtgctgcatgcagcctgttaaagcaccagttggcgggccctgtgctctgctttccctttcattgtgagggactgctttgggtaattctatacaggtgtaattaaggggccaggggaagagttctttttgtttctgctgtgaattagaggactatgtccttgctcttttggcgcaaagccaacctttcagatttctaaattttgaaggctgagcatggtggcatgtgcctgtagtcgcagctaaacgggaggctgaaatgggaggattgcttgagcccaggagttcaaggctgcagtgacctatgatcatgtttgtgaatagccactgcattccaacttgggcgaaatagtaagactgtctctaaaaaaaaaaaaacaaccgtactattttttttttccaggtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcggggtaagctggcctgtcttggccaacttctgtcttctgctcttcctctgtcttgctgggagcttggtcctcttccttccctgttctgctttcattaacagattgaagaagggctccatctcagaggggcgaccacagtggggccccaggcacttagattatgaaccacatggtcgggaaatatcagtgttctcagtccacgtccctcgttctcgtggagagggagccagagctctgggaacctcaggaagcacaggccaccctagactacgttgattttgtactcagaaactggcttctgtttgatggtgactccagtcaattgcttaaaatctgggatgttggccaggcatggtggctcatgcctgtaatcccagcactttgggaggccgaggtgggtggatcacgagggcaggagttcaagaccaccctggccaagatggtgaaaccccaactctactaaaaatacaaaaaaattagccaggtgtggtggcaggtgcctgtaatctggctactcaggaggctgaggtagagaattgcttgaacccgggagtcagaggttgcagtgagccgaatatattttgtggacgtcatcttggcagctggtcttgtcagtcagcctagctatgttctttctgcattcttggaaaggcagagggttctttcatagatgtagcacttgatttattgtctagtcctttgcttctctgagctggtagttcttagaaaatgtaagaagaaatcctgaaaaaagttcctttattctgcttatttttcatagatactcagcccccggatggaaagtcaaaagactgcatgctccagattgtttgtcgagatgggaaaacaattagtctttgtgcagaaagcacagatgattgcttgtaagttttgctttcttatgtgtttaatttaaaaagtattttctattttaacttctgattaccaaaaaatgaaaagaaagggcgtggagttttctttcaggcatcagaataagggactcagtggatgtatgagagaaatgcaagagtcgcttttccaattctagtttctgcctctctcagactgcctaggccgatcccattgtggtgaaaatggcagaaaggaatagcagtctcatcatgctgtctttcattattagattcacagtgggtaacgggcatagttgaaataaaatgaccagaaaagcaagaaagtaaagagtaaggaaactgtcagttcctagggctgctgtcacaaattgctgaacactgagtgacggaaatggcagaaattcattgtctcatagttctggaggctggaagtctggaatcagtgtgtcagcagatccttgctccctctgagatgctgggtaggatcctttcttgcctcttcctagcttctggtggttgctggtagtccttggtgttctttggctgacagccacatcactccggtctctgcctctgttgtcacatggccttcttcggctgtgtctgtgtccagaattctcttttcttataaaggacaccaatcataatggattaaggacccaccttaattcactatgaccttatcttaatttgattccatatgcaaatatcctatttccacataaggtcccatttgagggtactggggattaggatttatacatatctttttcatgaggacacaattgaacccataatagagacttttgagaaagatggtgaaatggattagagatcatcttccctgaggggaaaacatttcaatggtgcaaccaaataaagaagtttgatctcaagcacaaactacaaacagttaaagaaagaaatagatgattctactgagatgttcttcaatcctacccgaatcccagaagcagtgacaagatgagttaattaaatcttgcaaattttcagtattaccctgtaatctggagtgatgctgattaagtgtaagttactttttggaaaagctagggaaaaaatccttaagaatgtgatgtccttggggcctcagcagaggctggacggttctcccaggactcatcattgcagggcagtgaaaggcactgaagctcacaggagttgggtaattttctgtctggtgaagtgagccctagcatgggacattcaaaggaatatgctcagaagagagtgtaggacccagagttttcagaaaagacttactcggtctcagaagaaatgtccttctcttctagccctgtgccctcagattacagaatgttgattgtgagggtaacacctagccatcaaactgttgctgggctggactgaggtagaacagggtggaactaccagttgataccagattaggtaggaagcgtgtcaaggagaaataactcatactttatgagagcaaacagcagttttagatatcacttcccatgttaaacgtgagcaggatgtaaagaagtggcttggcaactatgcagatataccatgaaggaaaaataagaaaaggaaaatgcaagcctcaggaaaagctcctagagtggaggaaaataaaacccaagaaacaggagcagagtcttcaggaatgctttcctggccaccatatttaaaattgtatctccctgtccccatacacactcaccatctatcaactatttatcttgttcatcatctgctttcattagaatatatgctgtgtgagggcagagatttatgtttcttttctgctcttttgtgtctgtaacttagaaggtctgttgctgtcaagagggtgccattcacgttataatctgaagaaagtggtcttcccttcaatacaaccccaaatgaaaagtgaatcattggcatggaagaaaagactggagatactctcagtgacaggaaaaagatgaaaagatcagagatatgttagactaaaaaaagttcagaaagattattgatgtccataaagtgtacaacccaaaagagagaattacaaatctaaggcaagaaaaatgttctgaaataatcgaactgaattggcagaccaaagtccctactagactcttccacctgatatgacaacaaaatctatataagatatatgaataatccagtatgataccctttagcaaagtgaatgacaatggtatgccacatacaaaatcagttggggaattttgcaacttaactgcattccttagaaagctagaacacttgggctgggtgtggtggctcaagcttgtaatcccagcactttgggaggtcaaggcggatggatcacctgaggtcaggagttcgagaccagcctggccaacatggtgaaacctcgtctctactaaaaatacaaaaattagccaggcgtggtggcaggcacctgtaatcccagctacttgggaggctgaggcaggagaatggcgtgaacctgggaggtggaggttgcggtgagccaagatcacaccactgtactccagcctggacaacagagtgagactccatctcaaaaaaaaaaaaaaaaaaaaaaaaaaaagaaagccagaacacttgaaaataagtgaatgaatctttcaactcagggagatagtaaaatgagaataaaacataaaaggaattgatgaagataagagggatagggtcagtaagaaaagtaaggggtaaaggagtgagggagtgcacaagagaacactattttgttttttgagatggagtttcgctcttgttgcccaggctagagtgcaatggtataatctccgctcattgcaacctctgcctcccgggttcaagcacttctcctgcctcagcctctggagtagctgaaattacaggcatgtgccaccacgcccagctaattttgtgtttttagtagaagcttggttttaccatgttggccaggctggtctcgaactcctgacctcaggtgatcacctaccttgacctcccgaagtgctgggattacaggcgtgagagactgctttttgcctatgaattaagaaagctcttgtgatacttaaggttcagatatctagttttttttgacaatatagtgtaaagttggtaggtatagagattgttagaatcgttttgcagggcattttggcaatacctgctgaaataaattatgtttttatcctttgatgtggtattttcagtctttggaatttgccctgtggagatgtttacataagagtgtaagggtaatagggatgttaatagcattcttttcttcttttttttttcttgagatagagcccctctctctcatccaggctagagtgcagtggtgtgatcttggctcactacagcctcgacctcccaggcgcaagctattctcccacctcagcctcccaagtagcttggactgcaggcatgcgccaccatgcccggctaatgtttatattttttgtagagctaggatttcactatgttgcccaggctggtcttgaactcctgggctcaagtgatccccctgccttggcctcccatagtgctgggattacaggtatgaggcactacatccggtccccagcattctttttaatgttgaaaaattgctaatctaaattttttactcatatcgtggaatattatatagctggtaaaaaggaagtagatctgtgtgtatgccatgaactgacaaagcaagtggcagtacatttcacatttattaaaaagtaaagtaaaaagtatagtatagattatgttttaaatattacatatctattatgtatgtaatttttaaaaatatatattcctagtgcatgtctcaagtggtttggggcaaagcctgaagacttgttttttaaacagatcttttcaggaattctgatgccagcccaggtttcagaatcattgcaatgttggattgccttaaataaagtaccctttttcttttctccagggcctggaaatttacactccaagattctaggacaaacacagtaagttgctaatggcaatcaccaataattttttttttttttgacaaggtgtcactctcactcaggcttgagtgcagtggtgctgtctcacctcactgcagcctctacctctcgggctcaagtagtcctcccacctcagcctccccttcccagtagctgggactataggcccatgctaccacgcccagcttatttgaaaaaatttttttgtagagacgaagtctcactatattacccatgctggtatccaacttctgggctcaagtgatcctcccactttcgcctcccaaagtgctgggattacaggcatgagccaccacacccggccaccagtaatgttttcacatggtcttgtgtaacaattggagaatggggaaaacgggtttcttgaccatctggccacgaatgggcaggtagtgctgggcagggcgccttttgccaacagtgagcaagctgggtttgtcaaatgtttggcaggaggcaccctgctcttacaggcatgcttgttccagtgttgctttctagaaatgcttgtatttctcaaagttctgcaacactttgaattgtgctgtggtttgcagtaaaggcttagaaagaactgcaggatccttttcacgcatgggagctcagcctgtgaaacaaacatttttgtgacttgtacttgtctctcgtcctgtttctggccttaggaggtcactgagacagtgaacctcatttgtagagcctcgtaatgctgtctttatctgtcagtgatcaagggagtgtgttactctggtcagagttttcattctttagatgggatttttctctcctttattaatctgtaagaaaagaagaaggtggatcaagcttacagaagaatgtgtgcatgtgggagaagaaagtaaaaggcttaatatcctaatagcgtcagtgttctcttcctttgttagcacacaacaacttcattctaagcttactctacagccgcagttaccttttcttcatgaaaatccccctttttttttttttttttgggtaaaattagcattaacaatccatacagttaagggcaagctccccaaatgattctttgtgtggattttttttttttgagacagtctcactctgtcgcccaggccagagtgcagtggagcgatctcggctcactgcaacctctgcctcctgggttcaagcagttctcctgcctcagaatcctgaatagctgggattacaggcacgtgccaccacgcccagctaatttttgtatttttagtagagatggggtttcatcatgttggtcaggctggtctcaactcctgacctagtgatctgcctgccttggcctcccaaaatgctgtgattaaaggcatgagccattgcgcctggccactttttctttttttttaaagagctaacatgtttttctttaaattatactggggagtaatttaatgaagaattttgttttttaaggtaaaaaacagacttatgtataggacatatctcttgatacattttagattgtagagtttttatttgtgaataaaggactgttgagagtgctgtaacatctttatttttttggagacagtctcgccttgttgcctgggctggagtgcagtgacttgatcttggctcactgcagtctcgagctcctgggctcgagtgatccttgagacttagccttctgagtagctggggccataagcaccatgcccagttaatttcttgttttttgtagagatgagctctccctctgttgcctaggctggccttggaactcctgggctctagtgatcctctcacccagcctccccaaagtgttgggattataggtgtgagccattgcacctggcctgatgtaacatcttttaaaaggcattgggtaacagtggggcctctgagtgccttcctggctgtgagagctgtagtcctgttaggggccgagtgaggaccactttgctcttgcatttagaggataccagaataggggtgggggcccccactggactgggggagtttttcctgttttgcagagagctatgtatctttttgtttttttaaatttttaatttgctaaataaaagggacaatgcacagcatcgagcacacagctgctgggaagctgtcctgtcctcaccctctcctgtctcccgcaggcgtatgtgggctctgcagtcatgaccgatgagacatccgtggtttcctcacctccaccatacacggcctatgctgcaccggcccctgaggtagggagaaccctgagcctccaggtgagggaagtttggggtctctgctgctgtcctgctttgttttgtttttttaaatgaaattagaaatgtactctaaaccttttcttcttaaaacagatgatttcttatcaacgtttgttttcatgaaatgaagcaactattttatatagttcagcacattataatgtgctgtattaatgtgtaacacgtttttaagatagatctaaaaatgcatcatgttaatgatagttgccttgggtaatgagattttgatgatctgtagtttatatggaatgaattatttgaattctccttatagtcagaaaaaaatgctatattttagggaaaataaccttaaaaaatcatgtcaaatacattgggatgtcctcttgttggggtgctgactgagctagtggaacgtatgtaagtctgttgtgtggaacacgcagcttttaaaaaaattgaattttgaaataattatagattcacaagaagttgcaaagatagctttgagagtctcatgtgctttttatgtgttttccccatttgttaatattcgatcaaattaaacccaggaatttggaattggtgtggtatttaagagtaatcctgtgtcattttctcatacgtgtagattgtgtagctaccacctcaatcaagataaagaattcttcacaaaatcttcctgctgtgacaccctttaatagtcatgccatccctctgcttccctaaaccctgtcaatcactgaactgttctccagctctatagttttatcatttcaacaatgtcatataaatgaaatcatatagcacgtggtcttgggagtttaacgtttttcactcagtatttgcccttgagatctgtccaagttgctctttgtcaataatcctttttattgctgagtggttttttttttttttttgggatggagtcttgctctatcgcccaggctggagtgcagtggctcgatctcggctcactaaaagctccgcctcctgggttctcggcattctcctgcctcagcctcccgagtagctgggactacaggcgcccgccaccacgcccggctaattttttgtatttttagtagagacggggtttcactgtgttagccaggatggtctcaatctcctgacctcatgatccgcccacctcggcctcccaaagtgctgggattacaggtgtcagccactgcacccggcccttttgagatggagtttcgcttttgttgcctatactggagtgcagtggcacgatctcggctcaccacaacctccacctcccgggttcaagcggttctcctgcctcagcttcccaaagagctaggattacaggcatgagctgatttattggcttttccttttctcggttgtgcttttgctgtcaggttaaaacttaacatgacaaacctagcccaagtttcctaagattttctcctacattattttctgaaagttttatagtgaggttttataattattctgtattaattttgaattaattttttataagatagatgtctttttcagggctctgttgagtgtatctctttctgaggtctgtggtctgctccattgttctgtattgttaccttcctttgatcccacacagtcttaattattgcagctattataaaaagtcttggaactgggtggactgatcaacaccctctttgttcctttttggaaatgttttagctattctggttccattagctttccatatacattagaataaatttgtttatatctacaatgaaatcttgcaaggcttttgcaggaattgccttaaacctgtgtcatatttatttggagagtaatgacatctttattgaatgttgaatcttccagttataaacatggactgcatgtgtatttagatcctctttgatttttttcatcagcattttgaggttttcagtataaaaatcccatacatgttttgttagatttataagtgtttcagtttttttagtgattgcatatggtattacatttttagttttagtttcctttgtttactgccagtatagagaaatagaattgatttttgtaggttgatcttgcagcttgtaaactttctcttttttttttgagacagagtgtctctcttattgcccaggctggagtgcagtggcgcgatcttggctgactgcaccctccgcctcctgggttcaagcgattctcctgcctcagcctcctgagtagccgggattacaggcacgtgccaccacactaattttttgtatttttagtagagatggggtttcaccatgatggccaggctagtttcaaactcctgaccacaggtgatccacctgccttggccttcaaagtgctgggattacaggcatgagccatggtgcctggtcggcgcctgtaaactttctaagctcacttactctatttcctttttctgtagattctttgggatatactacataggcaatcatgtcatctacaaataggaatctgttttctttgtaacctttatgccttctgtttccttaccttgccttgttgccttggttagaccttcaaatattatgtagaatagcagtagtgagagaagacatccttgccttgttcctgattttaggggggatgtattcagtgtttttttttgagatggagtctcgctctgtcacccaggctctggagtgcagtggcgagatctcggctcactgcaagctccgcctcccgggttcacaccattctgcctcagcctctctagtagttgtgactacaggcacctgccaccatgcccggctaatttttttattttttttatttttagtagagacggggtttcaccatgttagccaggatggtctcgatctcctgaccttgtgatccacccaccttggcctaccagagtgctaggaatacaggcgtgagccaccgcgcccggccagtgtattcagttttaagtatgcattcatttattatgaatgtactgtttaattcagtatttaattagtactgaattcagtatttagttttacatatgcatatatttagtatttaatgcattcattaagtatgctgttagctggaggttttttatatttattctttatcaggtttagaaattccctttttctagtttccaggagtgtttatcatgactggttgtcagttgcttgcctgcctgtcttcctgcctcctccctccctccctccctccctctctcctttcccccgcccgtcccctctcctcctctcctctcctctctcccctgaccccctgagagatgaggtctcactctcttgcccaggatggagtgcagtggtactatcattagctcacttcagcctggaattcctgggctgaggcaatcctcttgcctcagcctcctgagccaccatggctgcaaaaaaattttttttttttgttgtagagacagggtcttgttctgttgcccagggtggtcttgaactcctggcctcaaacaatcctcctgcctgggcctcccaaagtgattttgttaaatactttttctacagtaattaatatgatcatgagatttttcttttctttttagcctgctaatatggtggattatagtgtttggttttcacatactgaaccagccttgcattccctggaataaagcctacttggtcatggtgtatgattctttttatttattgctgaattcagtttgctaatatttgttaaggatttttgcgtctatatttatgagggatattggtctatagttttctttttttgtactttgttttgttttatcaaggcaatactgaccttatagaataaattggaaagtgttttctgctcttttcttttctgggagaaattgtgtagaattggcattaattcttctttaaaatttggtagaaatctccagtgaaactgtcagggcttggagatttcttttttgggagattttaagtgacaacatcttttttctttttttctttcttttctttctttttttttttttttgagacggagtctcactcttgtcgcccaggctggagtgcagtggcgtgatctcggctcactgcaagctccgcctcccgtgttcacgccattcttctgcctcagcctcctgagtagcggggactacaggcgcctgccaccacacccggctaatttttttgtatttttagtagagacggggtttcactgtgttagccaggacggtctcgatctcctgacctcgtgatctgcccgcctcggcctcccagagtgctgggattacaggcgtgagccactgtgcccggcctctttttactttttttggcctaaccaacacacatctatttgtcacagttctggaggctgaaagcccaaggtcaaggtgttgggcagcattggttctcctgaggcccctcctgcgcttgcacatggcctcctcctccctgtatcctcacatgacctttcttctgggtccaccgcagatacagctttcttattagtgactggtctactcaaattctctagtttgtatggagtaggttttgacagtttgtagtttttgtggaattgttccttttcttataggttgtctgacttagatgtgtagagttctttatggtgttttcttattatccttgtgatgtctgcagagtctatagtaaaaatcctccagttcattcattcctgatactggtaatttgtctttgctctttttgatagtttactaaaggttttattaattttatgaatagtttcaaagaaatagcttttcgttttattcactttttctgtctctcaatttcattgattctattcttttatttctttccttctgcttgctctgtggactttggttttcaaaagtttgactataatgtgtatttgtgtggatttctttgggattatcctgtttggtattcattcagcttcttgaatatataggcttggggttttgctaaatttgggaaattttaaatcattattcttgagtgcttttccaacctcagccactttctactctccttctggcactctgataacatccctgttagtctcatgtgtcccagagatgctcatttttttttttttttttttttacttcaatctattgttcctctgttgtgctctgattgggtaatttctaccctttatattcatgtttatggattctttcctttgtcatctccattatgttgttgggcccattcattgaactatttaaattggttattgtatttattagttctgaaatttttatttggttattctttatatcttgatatataaaaaattgaatgtatgtctttatatactttttactgagatttttctgttttatggtagatactttaaattttttatttatttcaagtgtgttcataattgcttgttgaaaggtttttatgatagctgctttaaaaatctttgtcatctttgtgttagtgtgttttgttgttgtcttttctcatttagttgaggtcttcctggttcttggtataaatggcttttgatcaaaagctggacattttaagtactgtaagactctgaatcttatttaaatctcatgttttagcagacctccttctggggagctgctttattgctgccaggtagaggtggaagtccgggctcgccttgagcctcagttgacacccatgggccaggtttcttgtcactgcagagggggttgtgaatttaggttctgactagatctccactgagcccaccctgtctgagaagaggaaaggctctttcttattgcttcccccgtagcctccactgataccatgattgccactgagaggtcctgaaaggactcactttccacttggtctctgctgatcccatctcagtggaatagggaggacaccttatttctgctgggtgggagtggggttctggctccccacatggtcttcatggacaccacccagcaggatgggggtgttttgtttccatctggtggggaagaaattctcagccccccactcagtcttatttgacggtgttctgaaggcccggcagtgccttgctatttggcctgctgagcatggaaattcaggctcttcacacttggcgtttgctgatgtgaggctgaaggcttttatgtggtggttccctggagtagagaggttattgtctaaaaatgttctgtcttgctaggttgcccctttccttcttagattctttgttaaagagagcagctcttctcagggtctttttggtctgcactgatcggcacttccagcttgccaccttccccattatctagtttgggatgtgtgaagcaaaaaggaaacccaggtcctccctcaggtgctaaagttcctctcccgtctgtcttctctctcttcagtcttcttgtgtttgctttgtatataatgaccagagattgtagctgtacttagcaggaggactacaagaaagaatgtctactccatcttctagaagtgggagtcttgtctcctgcttttgtaagataacaggtttagatctacacacatgtttgcctggctacaactctgttctcccttatcagagcacttgtcacagaacgacattagttgtgcaagtatgtctgatctcctctcaacctgtgagtatgcaaggaaggccagtctttgatttcagtatttctcagcacacagtggtcattcactgccagtggaggtgggtctgctgcatgtttctcgccatgtcttttcataggtgtgtgcagccagaacaccatcagtcacctgcccaggtgccacacctcagggcaccctcatcttccatattgtgcctggaattgctgaatttgggccagagagggttccgcttctaggctggctttgcctgcagaatagtggttttggtgaatctcattatcacctggtccaaccttatcattttacagatgggcaaaggaaggcccaggtgacttactgaaggtcaggttaacagcacagctgaattgaaatccaaatctcatgcaagtccagttctcttcttttgttgtgtttttctgccttcttcattctgtagcctgaaagtggactccaattgtagcttttgtttgttttttagtaattttaaaacggggggcctaaccacactgtttcatgttttgttttgttttttttaattgactgttgaattttattgattgcaacctggagaccacaattttaatacattaccagaggtttcacaattgtatttctaatgggcctgtttcttttcagcaggcttatggctatgggccatacggtggtgcgtacccgccaggaactcaagttgtctacgctgcgaatgggcaggcgtatgccgtgccctaccagtacccatatgcaggtaactcacgccggcctttcattcctcatttctctccatttgctgagtagaccagagagacctgtaaacgtttttatttttcagtttaaggttacatgagctatattttctggttgtagactacaaatcactctgttactatgctttaagaaagcctttggtagtttcatactgctctgcaaagctaccgtaggcttgatttttagaacttggcttttgtgtgtagattagttctcagagaattttgtacttattgggattcacttacattaagaagcaaccaaagtaagaggcctattttaagggatgagaggtgacctttcagctgttctccttctggtgatgtccttggaaagttgtcactactgaggtgatgttctgtttcacagtggagtacaggcctggaagggcttgtatttattctgggcttggagtctgttctttctgttcttcacctcacatgaaacacttggcaggcatgagtaactggtgtagaggtatcatgtccaggtctcctgggcaagggggttggcagggtggaggtgtgggacaatgctggccactgctggaactgcagtgagggtggggagggcagagctgtggccgatggccactgtgaagtgaggctgggcaggcgcagtgggcacagcaccatagtgcaggatgcacaggtgggtgggctggagccagaggctgagctcaggagagacaggaatgtgggggtttgcaggaggaggagtagtcccgggctgtgagcaaaactagcatggtgtctcagcgcagaggcagtgggagacgagctggtaccagaaacgtgggtcactaatagtggtgcccagagaagtcaaggaggcctctgggttacaatcttagatggtgtccttgtagttgttggtggttgctttggcttttgatgcatttagcacttaaaatggattctggagtagaaatagagaaatctcatactcctgtgttctgggaatctgaggcacattcactcaactagcacggactttggaggatcctgctttgcttgactttttttcatgtcaagttgaaaaccattaaaatgataataagtagtccgggcacggtggctcacgcctgtaatcccagcactttgggaggctgaggcgggtggatcatgaggtcaggagatcgagaccatcctggctaacacagtgaaaccccatctctactaaaaatacaaaaaaattagctgggcatggtggcgggcacctatagttccagctactcgggaggctgaggctgcaggatggcatgaacccgggaggcggagcttgcagtgagccgacatcgtgtcactgaactccagcctgggcgacagaacgagactccgtctcaaaaaaaaaaaaaaaaaaaaagtaattatgacagattaaatatttgtccattgtcttgtgagcctagcacaaatacatttgtttgaattacagtaagtcctcacttaacatcaacagtagattcttggaaactgttactttccatgaaacaacatatgatgaaaccaattttatggtagactaattggtataaacaagagttaagtttctgttgcttatttctggtcacaaaaacatcaccacttctaatattaaccattgaaattaatgtgagccatacatacatgtaagattaataaagacaagtaaaataattacctagttatttcagttcatggcccatgggtggctggaccctctcccagcagctcagggcttaaggtgggaatccaccatggataggatgctatctcattgcagggcacactcacccacaccccctctcactctgggacagtttagatacgccgattcacctaaggggcacatctttgggatgggaaggaactgaactatcccaagaaaaccatgcaaacatggaaaaaaccttcacactccacacaggcggtgccccagaggggaatccattcttttcttcttatcaatgttataatgaaactacattaaatgaaacagtgttatttgaggacctcctgtacttcctccatataaaatattttctccttataatcatgcattgtatttctagtcttgtttttaaattatatgtattgaatcccaagtgctatgtaatactcctaagtatttttagtaattgcctattatcatattgggtgatgtattattaaaccttccagtattggctgtttttttcctctctttttttttgctattgtagatacttctttgaacatctttaatcattttcctttttgttcttattgaatatgcattagaatatgtttctttttttttcttttttttttttgagatggagtttcactcttgttgcccaggctgttgtgcaatgtcatgatcttggctcactgcaacctctgcctcctgggttcaagagattctcctgcttcagcctcccaagtagcatgtgccaccacacctggctaactttgtatttttagtagagatggtttcaccctgttggccaggctggtctcaaactcatgacctcaggtgatccatctgccttgacctcccaaagtgctgggattacaggtgtgagccaccgtgcctggcctagaatctagttctttttttctcccccccaactagactctatctctatatgcaggcaggccccaactcaggatggtttgacttaatgattttttgactttccgatggtgcgaaaacaatgtacatttagtagaaaccgtacttcaggtactcctacccccattctgtttttcactttcagtatagtactcattcagttacatgagatcttcaacacttgattataataggctttgtgttagttgattttcccagctgcagactaatgttagtgctctgagcagttgaaggtaggctatgctaagctatgatgttcggtaggttaggcgtattaaatgcattttgactatgatgttttcaacttatgatgggtttattgggaggtaaccccattgtaagttgaggagcatctctgttaacatgtcagaaggcatagacatttttgacggttttttgggatatgatttaaaaatgtaaacgttttcaaacataaaaaatagggatgatggtataatgaactatcatatgtccatcactggcttcagcagttaaccatatcatgtctaatcttttatctctacctcagcctcctttctctacctctggattagtttaagggacatcccagatttttaatcatttcatctgttaatattacattaaatctggatagcattttgccaagttgatcccagaatggtttaccaacttataatgccactagcagttactgatgcagtggtttatctgtgatcccataaagatggcctgttgtgctctaaaagttttgatagcttcagtaggtctcaagtggaatcatcgagttgctttagtttatatcaccttttatgaataattttcctttgcacatttttctgttgggatcccatgggatggagagttttaagccctagccttgccacatgagagccagcctctttctcagcttccagcccacagaatagggctgttgccgctgtttcttactgtatagagagcacagatattgcagacgtggttgtttagggcacttctggaaatgagtccatccttgcccttggctctcgtcagtagagtagaagtagcactctcacaggcagtactcggaatgcttgccgcccacataaggggctgagtcagtaggcattatggccagcctgcctcagagtggtgaccaggcagcccccagacttgcttgctgtggaagggtcaaatgggtttgtggtcgatacacagcagcttgtgttgacaaccagatgggtgctttgccacctccatgccatcctgtctgccagggtctcactgcctagagctagtccacaagaaccctcctagtcatgcacagagctggttaaggctctctcttcagtgtgattgggaccagtggttggtcagccaattgagaaagtacagagtactgtagacgtattgtaaacattgtgctgtgatttaacccgctagtgggtgttcgttcggctctcctataatgtggggttgaggtgtttgctttgagttggctcctttggttggagtcttctatttctgtcttgtagagaccatcctcatgacacgtcattgcactgcagtttccaggggtaagtccaagagcagacttctagatttggggactatagtcctcccatcctcccatcttttatagttttcttaattccctgatttgatggtaatttgtaaaagtaaccttcctttatttagtttttcctgtagtatcttagttgccatagaaactgtgtctgcctttttctcattcacattttgaccatttatgtaatattagttaaattaggcaattataataagtgtgacctggaagcatccacagctgactctggcaaggactgagctcaatgcaggagcagagctcagcaggagccacaagagagtggcctggtcctgcagccaggggacctcagcatgacttgcaggggcatcagaatgtagattttccatgggaccttttcattaggtcagctcacaagttctattgtgttacatttggctagttggagttaacattactgagcattttaaaatgtcagggctgtgaaagtaaatgccgtaattccctagttttgaaatttaaacattgcaaaaataatcacttgcttccagtactgttacctgtaccagatcagcccttagatttacgatggtttcattgtactactctgtgccttttgagttttgtcattcatcatcctctgttgtatttgaggcattagtgggtataaatgcatactgtagccagagtgcctgggtttgtgtgcccttactgtccttaactgctgtgtgcctcagtttgcccatctgcaaaatagggataaaagtgcactcagttgagtaagagcattccaatgtatgtagtgctgtaagtggctggaaatgttcacctttgttaccactgcgggtttcacttctgctcttcatccacatgtgcacatcactagtgactagttttttttcttttctttttttgtgtgtttgagacagagttgcactctgttgcccagactggattgcagtgacaggatctcaactcactgcagcccccgcctcccaggttcaagcaattttcatgcctcagtatgggattacaggcatgcgccactacccctggctaatttttttttggtaattttttaagagacagggtttcactgtgttggccaggctggtctaaaacttccggcctcaagtgatccacctgcctcagcctcccaaagtgctggcattacaggtgtgagccatcaagcctggccagccagcctttgaaccattaaaggaatagaggatcaaggaggaaagttaacgctattaatacctgagcagtttgaaagctacttagctactaggcattatagctgtgaagcatggaagagagcaaacagtatatttccagttgtaaattttaatcttgcaaattaaatactaaatttgtctgtggtttgtttttttgaagttttcacctctaacataaatatttattttttctctataaagacatgcagtaaaaaagagtaggccgggccgggcgtggtggctcatgcctgtaatctcagcactttgggaggccgacgcgggtggattacgaggtcaggagatcgagaccatcctggctaacacggtgaaaccccgtctctactaaaaatacaaaaaattagccaggcgtggtggtgggcgcctatagtcccagttactcaggaaactgaggtgggagaatagcttgaacctgggcggtggaagttgcagtgagctgagatcatgccactgcactccagcctggggacagagcaagactccttctcaaaaaaaaaaaaaagttatatgtgcagatttaaggcttaatttaaaaattggtttgcgtgcatactaagaagctcatttgctttaagtgagcatttcctttttgggcttttgttgggcactgtgtgtctcccatgttccccatttgtctgccacccaataagcatggtgtcgagggctgaagtagaaatcagaggctagaatctgaaagcttcattagggttctgctttttgcagattagggactttggcccttagtgagctgaggatcttggtttcctcccagtgtgcggtttcagggatgtcggccacatgatgtgcctgttgtggaggagggctgggtcgccagtgtgacaggagacagcagatcccttttgtgaaaggagaactggtactttgcgtgatgttaaacttcacaaaccgctgctcagaaatctgctattttccttctcttttaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttcattgtgacttctgttgtctttaaaaaattactttgtagtaacatactctcagctttttctgctgtcctggatcataagaatgccatttattgaggacctaccaaatgctagtatattgtcacattagagacaactcactgaattcttagtgactctgtaagggaggtattatccaagttccactggagggaccgaggctcagaagttaaataatttactcaggagcgtgcaggtagtaggtctccacatctgatgttaaaacgccttgttgttccctgtgccgtgtgcatatgagaatttgatttccacaaacagcagtggcccgtgcagtcacactcttgggatggctgtgagaaaacggacactatttttcccaaccagatccctctggcagtgtgtgtccaataacttctccagcatctttggatatatgacttttttgttttatttatttatttatttatttatttatttatttagagacggagtctcactctgttgcccatgctggagtgcagtggcgtcatctcggctcattgcaagctctgcctcctgggttcacgccattcttctgcctcagcctcccaagtagctgggattacaggtgcccgccaccacacctggctaattttttgtatttttagtagagatggggtttcaccatgttagccaggctggtctcaatctcccgacctcatgatccgcccgccttggcctcccaaagtattgggattacaggagtgagccaccacgctcgaccgaaaagctctatttcttgttcaagtcgcagtccattgtgggttcataagggatgagaggcttctgctccaggctgtcattcagggaccaaaactgcttttatctctttgccttggaatctgctgtgggaacttatacaacctgctggaagaaaagacagtgaagacacacccatcctcagctctggagtggcgctccccttccagtggtgagggctaatcatgtggcctgggctcagtgcttgaggtctgggaagtatcgtctgaacccaggaagaaatggccctcgcctcagctgctgataacaggccgtagttaatgacagatcatgatcatcaagtatcgccaattctcggtggaagttgggtttgtatttactttgtacagtttttactgattaataaagccagtggttgcaaattacaagcaaattgttagttcacacaacacaaatgtcatttggtcactgatattttcgttgctgttaaatcgtttctttccccacttaccaactgttgtggatgggcctagagaagatattcaccctttccagcaaggaatatagttcctccatccatttgtcctttattacattacagtcatgctgaggatgactgcgttattgcccctggttgtcctgctcccccttccctgtgagcggcctataagttcctgcctggtgctgagagcctgcccatgccatcttgcccaccggaggaacagagtccaagcctagcgggtggtgtgccatgcctgggggaagggggtgtgagtgtgtcatgtttgagcaggtgctgtaggaagcagagggggcttctccagccttctcatccttttcaccactgcaggagctgtccctcctctgtggtcccagataagactcatggggcagagccttcacagctgcccctcaggggctccatgtcacggaaggcagggggagcattgtttgccgtacagtaaagctgaccaggatgagctgccgctgggtgctgtgccaggtgagggggcacagcagtcagcgagaccatacttggggagggggacagtgctcccactgcccaggcctcaccagagcaaggggtccagataacaccacaccacgtggggtcccagggtcggggcttgcccttctgagccttttcatgtctgtgaatggctggagggaagggggtgataccaagcccacagggctggtagaggactaagtgacctgagtgtgcaggaaggccgagcacggtgctgggcacactgagtcctctgcagatttgaccctctgttcctcttttcctgagcttctcttctgttatttgtaaaactgggtgacagttcgtgtctccattgccctcaaaggtgagaccactcacttcttgttctcatggccaaggaaggccctgccacgcctgagctttgcaggtgggaagggcttcctctgcccctccagggaatgtaaacatggagtcttggcatttctgtgttccccggaccttttattagtctttgcataatcccccacttttactcttcttgcagaactttctcccttcaaccactaacctaagctggtggaggtgggggtaatgaggcatggtggcagtgatgcctggcctgagccatcaccgggcatttaccagctgcatgctctggggggcggctcgccgctgcgtttccccttttgtttacgacaggtacagtaggagcaccctgaaggactgtgatgtgcattcactgagtcagcacagatgggaggcatggagagtggtgctgggaacctttgtaactactgacaataaatgtttcttatgatgcaggcttacagatgagggacagatgtggtgtaccctgaggcacctgggtaggcctgaggtcctgcctggcttggtggctggctctgggacctgtgggaccccagcaggcagggaggaggcagtgtgggctgggctggggcagaggctactctgccaccttgctctcattttacctggtattgggggcacaagttggccaccttgccaaggtcttgggaatcctgaggtccaaactccagtggacaggagcaggttagaaatgcatattcctggtcgggcgcagtggctcacagctgtaatcccagcattttagaaggccgaggtgggcggatcacaaggtcaggagacagagaccatcctggctaacacagtgaaaccccgtctctactaaaactacaaaaaattagccgggcacggtggtgggcgcctgtagtcccagctactcaacgaggctgaggcaggagaatggcgtgaacctgggaggcggagtttgcagtgagctgagattgcgacactacagcctgggcgatagagcaagactccatctaaaaaaaaaaaaaaaaaaaaaaaaaaagaaatgcatattcctgggacttaaagccacaacgtcctgagggggtctcgggtggcccgagtctgcatttccacctgccctcaggtgattctgtgcagccttgactcccctggtcttggcctccaaggcctgccctttctgaggcctctgccttcctctctcctctccctccctgctcaactcactgatgtccactgagctgctggacaggcgtcccctcctctaggaggcctcctggccttccctccagctcagcacgatgctgaggagcgacactggacagtacggcctcctcccctcctgtggtgctgctgagtccagggacagtcactggccagtgggaggcaggaaggggcccagcactggctttgcatggctctctgggcgtgcccctgcctgggaagtgggaatcaggtgagaggcacctcctcctgggccccaggagagctggcagctccatcagaccctccactgctatgtcatcagaatgacatttctcaaacagggtcacctccaaagggcagtgagctaggtgctcctaggtagcaccccaggcaggccctgcccagttctttcactaacctgtcagaggccaggtgagcagcttgtgtgttcctggttcagtcccctggcaggcgtgctaggcagggcccattctcaggagccgtcttgcctacctggtgcagacacacccaggctatgacctgctcaacagatgtgcagcagggacccctagggaggactctggggctgcactgaattcaaatctttatcacttctgtgggcatggatgtggatagcgtgggaacgtggcctctctagcctcagtggcctcctttataaggaaggtatagtaataacagtaccacccagtaggcacccagtaggagcagagacatccctccattcctttcccagacccatggcttggtcccagaccagcagcacagcagcctctgggagcctcttagaaatgctgattttccagcagttctggatctcccaagtcagtgacagccctcagggtgatgccattacaggttcaaatttgaggaccactggtctagaatggactccctctctcccactccccctttctctctcccccttcctgcgctcactcctgctcaacggcacttcctctgtgcagctgctagttctgagggctgccaccaggtgtcagggcagcctcaggaatgttccggctgccacacctccctcgccagcctggcccctgctacatctcaggagaggtcctgagagggtaaagggcttctgagcttctcacaggatgaatgcttccctgtgcttttctgactgctcagggtgagtcatctgggcccgaaggtggcagatatgtcagcgtcctgtgtggtggggacagggacagccccacagcacctagtgggatgttgtgagatttgcggggcacgcccaactcctcctctactactgccgagtcctcactgtcttattctgccctaggaggcttctccaaccaccctgctctgtccccattgtgactcctggccacggcctctgaccctccacccagtcccgtcgtcacggtggggcctccgaaggcctgtcctgctgtgccaatgctgaggccgactttgggctattggtccaggccctgcccggccctgtaactacacgtccctaaccgccaccacaggcttggtggaccaaaagcctcctactgaacacagcccagcaggctttgcccacagtcccctcccagcttgcccactccagctcccctgagttcaaggccagcccacacccccggacgcactggacaccctcccgggcgccggtggaggaggctgagtagggcaggcaaggtctctgcctgcagccacaccaacccagccgctatcctcccagcggggctgggcagagcatcgggaggactgcccgggtcgcggaagggcgtgcgctggattccaggcgaggagctgctgtgcgaggcccgcaggcgggctcaggcgggagtggctatgggccgtgggctgcgagggcagagaactttggaaagcgatttggggatggcagctgtgtggccacaccgcgggagcccttgagatggctggctgcagggcggctatcgggtggggggaagtgatttctggcagagctcctgggccttgtgcgggggtgctcgtaggtgatgctgtggggcagagacttaggagtgtggttgtgaagggcgagatttctgctgaacatccgagtgggaatgtccggaggtcagttcagaggcctgggcacagtagcaacagagggcgcgggggcaaggcgggttgggcacgtggagggcatcggtgtccctgccacgtttcagtggaaagccgagtgaactggagttggggatgggggaggccgtgagtccagttccctgcaccttctggagcctccctccccagacccctcctgacaggggctgggcctctcccagggggcctcgcgcagctccggccctgagcataggcgcggtggaggctgagggtccagcccctcgaggtccgcgcccgctacttccgctctctgcggggctgtccttccctcatcggtgtccgctgcggccctgcggccggcccggcagcacgagggagccagggggcacggtcctgccctcaggaggctccacgtggacactgcgcagctggccttgaggcacgcgcgtgcgtgttcatgtgtgcgtgcgtgcatgtgcgtgcttgttcatgtgtgcgtgcgtgtgcgcgtgcgcgcgctctttgcccccacaccgtcactcctgcaccctgcatctaatgtccagagaggtgattatcatctccactcccaattcacacctggccctgagtcagctacatgagtggtccaggcctggctgtcctgggtcttgtgtgccacgtggcacaacaccgggtctgtaagagaagccgtgccaccagccttgggaggcagcgcctgctgggtggggtctccagaggagagctccagagagagaaaggccgagctgcctccacctcccccaaaatcctccctgaacctcagcaatcacgtctgtaaatgggacaatgacagcgtcagccttagagagttgctggagtgaggaacgaacacacacgggaccacttagaagactgttgggcgcagagctctcagggctgctctgaggaccacgtttacagatgaggactcagagcgggagatgccagtacagcaggggctctcagccaccctctcccagaggcaggtcccaacggaccttggtgccagcttggacgctacgctcagcagttgtggagttgattaataacattctgtcccacattcgcggattggaaagtaatgcctgattaagaccctaagcatgtcacttgtggcaaacactcaggctatcttcgagggggcagcattgacttcagggctgaagtcttggctggttttcctgggacacaccttgaaggcagcagaagccctgctaccatgaaacaggaaaggccaaggagtttgtgctggtcctcaggccctcagcccctaggaggctggaggtggagactggcccttaggcggtggcaccatgcctgagcatgaggggacacctggggcaccctgtgaggtgggggcagaagggtggaaggctgcggggaggtgggggtggaccggctgcagacagaagagctacactttcagtttctgtttcctccaaattactgatcaaaccccctggggtgctgtggccgcaccatgctccaagccctgtcctggagggtttccttcagtgggcctgggccatgggtttcagcagaatgtgaggatgagctgagctaggagtgggtgtgggcaccaggctggccttgttctgccatgtgcaccggccgttctctctcagcagccccaggccacacagcagggacggcaggagcggggttttctgaggccggtgtaactccagagcctgccctcctcacctcatgcagccggtggacatgaggccagccctctgctggccaggcccgggcctgctggatgggcacagcacccctggggaggttgggggtggggacattcattcactttagccatggaagggagacctgccttagcggtccttgtgttgtgtggaggctgtgaccaaaagtaaagtgagggcctctttgtgcagggtcttagggcattctgcattcattcattcccttagtccctcatcaaacatgccctgagcaactaactgctccacacctggtcctgggctgggcatggccaggctctaggagcttgtctggtagctgtgcatgagtcagaaaatggagccccttcctctagtgaatctccttgtgccgggtgatgggctggaagcagagtgcacctggactgaccccatccccgctggacctctgccaggcatttttgctccctaaacaacgccacagccacatgaggcaccgcgggcagtcgggcctcctatagccaggcccttggctgtggcctgtcatctaggggctgtcccatcccctagtaggatccacacttagggactctgctccatcgtgctcaggagctcccaccaccacgtggcccagccgcccacacctccacctgtgctccattctttccacctcctttatcaaccccctgcccacctattgcttgtggttaagccctgccctcttcctggccacatgatgtgcctgctcttggccaccccatgggctccttggtgactgtgccagttcagtgcccctcctggatctcctggcccaggaactccccattgaatgtgccttcacagctttccgtcagtccagccttgctctgctcagggattgtgaatgcagagatctgggccagttttgagggtgtagtgtggtggacacctcccacactgccatctatcgggagggcagcttgacagtatgtattgaaatccttaaaaatgtgcatactctgaccatgtccttatgggtatccatctcaaaaaagataaccccaaaagggaaaaatgtctcctacacaaagttgctcatcatgcatacctagctgaaaattgttaacatcttaaatgtccaataatgggaataaagtaaatcatggcacaaagaatcatttcagaactaatggaagtaaatgaagaccatgaagatcataacggctgagtgaaaaacaatcaggtgagtggtgctatgcatattagcataaggagctgaatgctccccggggaagctccaagaaggatgcggcactgctcacactgtgatcgctcacctccacagctgtaaatagtaaataaatgtgttgttttaaggcactacatttgtgataatttgccacagcagtaacagggaactaatgcattaggtaagagtcaatttattggcaggccaaggtggactgattgcttgagctcaagaattggagaccagcctgggaacatggcaaaaccccatctctacaacaaatacaaaaaattagccaggtgtggcggcgcatgcctgcggtcccaactactacagatggaggctgaggtgggaggattgcttgaacccaggaggcgcagcctgcagtgagctcagatcgcaccactgaactccagcctgggtgacagggtgagacccttccccctgctccaaaaaagtgttcaatttctttaatggttctaggaccattcagattgattattttatcatggtttgagtttggtcatttgtggttttagaggaattggtccatcccttttaagttgtcgaatttgtgagtgtaaagttgttccagatattcccttattagctgttcagtggcggcgggagcagcagtcatggctcggcttcattcctgacatgggtaatttgtgtcttttctcttttgtcagcttttaataaagatttgttaattgcttttttcttttttaacttttctttactagaacagtagaaacaaacacaaagcaagcatgggagggaaataatgaagaggagaaaatgggaaataatgaagaggagaaatcagtaagatgaaaatttctcctcttcattatttccctcccatgtttattttgttttccttttcctagtttcttgagtagggactttgattgttgactggacacctttcctctttaattaatgtaagcattcagtgacataaaaatctcaacactgcttttggtatatcccacatattttgatatgttctattttaattttcactcagctccatgtatttttaatttcctttgagatttccctttccacctatggattatttagaagtatgttgcttactttttacatgattagtttttctgttttctgtcatggatttatggttttactccattgtggtcagggaatgtactctgcagtactctgtactttaaattttgttgagacttgttttacggcacaggacaatgtcggccttggtggatgtttcatagatgtttgaaaataacttgtagcttgctattgttgcatgcagtggttctgttggttgattgtgttgctctgatgtcctctccttgctgattttctgcgtcagttgctgagaataggattaactcaaaatggatcaaagacctaaatttaagtgtaaatttcaatttattttaaagtgtagaattcagtggcattaagtacattcaaatgtggtgcacctatcaccactattcctggaactttttcataacctcaaacagtagctctgtattcattaagcactaaaccctattctatgctctccccatccctaggtagcctctattctactttctgtttctatgaatttgcctattctagatacctcatataaatggaatcatgcaatatttgtccttttgtgattggcttatttcacttaacctaatgccttcaagattcatccgtagcaatgtgtcagaatttcttcctttttatggctataccacatttcgtttacccattcatctgttgatagacatttgggttgtttctatctcttagctatcgtgaataatgctgctatgaacattggtgtacaagtatcttcttcagttttttctttttctttttttttttttttgagacggagtttcactcttgttgcccaggccggagtgcaatggcacgatctctgctcactacaacctccacctcccaggttcaagcgattctcctgcctcagcctccctagtagctgggattacaggcatgcaccaccacgcccggctattttgtatttttagtagagacagggtttctccatgttggtcaggctggtcttgaaccccctacctcaggtgatccgcccgcctgggcctcccaaagtgctgggattacaggcctgagtcactgcgcctggtcttttttctttttttttttttctttttttttttagagatagggtctcattatattgcccaggctggtctcaaactcctgggctcaagccatcctcctgtctcagcctcctgagtagctgagattacaggtatgtgtcaccacatccaacttagttcttttgagtacatacctagaggtgagatttctgggtcacagagtaattctatgttcagctttttaaggaatggccaaactattttccacagtggctgcaccattttaaacttctatcaacgttgcatgcaggttccaatttctccatgtcctcgccaacactgttatcttgttattttccttttcccattattttaatttttgtaatagccatcccagtgaatatgaagtggtaactcagtgtgatttaggtttgtatttccctagtgactgatgaggttgggcatcttttcatgtgcttgttgtctatttgtatatcttctttggagaaacgtctatgcaaatcccttgcccagtgttaatttggttgaatttttttgttcagctgtaggaatttttgtatattccagatattaatcacttatcagatacatgatttgaaactttctgccattctgtgaattatctttttactctgttgatactgtagtttccttttatgcataatgttttaattttgatggaatctgatttatctattttttcttttgctgccatgcttttgtggtcatgtttaagcaattattgccaaattcaagtcatggggattctttcctattttttcctaagaattttgtagttttagcttttacgtttaggtctttgatacattttgagttgatatttgtatgtgaggtaaggtaagggtccaatttcatttttttgcatatggatatctagttttctcagtaccatttgttagtaagactgttcccattgaatggtcttgacagtatagtagaaaatcaattgaaaatcaatgtgagggtttattgctgggctttgtattctatttcattggtctatatttctgtccttatgccagtaccacacttttgattactgtagttttgtagtaagttttgaaatcaagaaatgtggatcctccaagttttccaagattgttttagctaaatcagggtcctttgaaattccaaataaatttcagaatggatttttcttttctttttttttttttgagacggaggagtcttgctctgtcgcccaggctggagtgcagtggcaggatctcggcttactgcaagttctgccccctgggttcacgccattctcctgcctcagcctcctgagtagctgggactacaggcacccgccaccatgcctggctaattttttgtatttttagtagagacagggtttcactgtattagccaggatggtctcgatctcctgaccttgtgatccacccacctcagcctcccaaaatgctgggattacaggcgtgagccaccacgcccggcctagaatggatttttctaagctgcaaagaaatgccattaagatttggatagagattacacagaatttttagatcactttgggtagtattgtcatcttaactatatcgagttttcccatccgtgaacacagaatatctttccattcattcaagtcttctctcatttctttcagcactcttttgtacttttcagagtaccagtcttctgcctccttggtttaatttattcctattttaacttttgtggtgttactgtaaatgaaattgttttttaaatttccttttcagattgcttattgctagtgtgtagaaatacaactcatttatgggtgttggttttgctgatttagtttacttagccctgtgtgtgtgtgcgcgctcatgtgaaagtaattctagggttttctacatatgtcatctgtgaagagagatacttttacttcttccctgacaaattggttatcttttatttccctttttcccctaattgctctagccgtaactttcaggactatgttgaatagaagtggcgaaagtgggtttcattgtcctcatcctgattgtacagggaaattttttggtctttcaccattaagtatgatgttaactgttttttgtatgtggactttatgttgcggacattcctttctgttcctaatttaatgttttttttttatcacgaaagggagttggattttttttcaaatgctttttttctgcattctgttcatggtcctctgctttatcctgttaatatgggagtgattgcttgattttcacatactgggccgccttttcattccagggataaattccattttgtcatggtgtttaatccttttattatgctgctgaatttgctagcattttgttgaggatttttgcatcaaagttcctaaaagacattggtctgtagttttcatttcattcatgtctccacagtcagacagtatagtgtctctgtctgactgtggtattaagataatgctggcttcataagatgagtttggaaatgttccctccttttcattgttttgaaagattgtgagaaggactggtgttgattctcacataaatgtttggtataatttaaaagtaaagccatttctcctgggcttctctttattgggaggtttttgacttactgattcaacctccttactttttataggtctattcacattttctaactcttttcacattggttttggtagatttgtacatttctaggaatttgcctatttcactgggttatccagtgtgtaggcatgcagttgttcattatattctcttataatctatcaatttctgtataatcagtaacaatgtctcttctttcgtttatgatttcagtaatttatcctatttttttcttagtaaatatagctacagatttgccaattttgttgatcttttcaaataaccaacttttggcttcattaatttttttctattgtttttctattcactatttcattaatcttcactctaatctttttttttttttgcgacagagtctcgctctgttgcccaggttggaatgcagtggcaccatctcagctcactgcaagctccgcctcccgggttcacgccattctcctgcctctgcctcctgagtagctgggactacaggtgcccgccaccaagcctggctaattttttgtatttttagtggagacggggtttcaccatgttagccaggatggtctcgatctcctgaccttgtgatccacccgcctcggcctcccaaagtgctgggtgcgtgagccaccgcgcccggcccactctaatcttttttatttccttccttctgcttgggtttagtttgttttctttttttttaatttcttaaagtatataattagattactgatttgtaatccttcttctttcgtaatgtaggcatttacagctgtacatttccctcttagccctgctttcattacatcccagaagttttggtactttgtgttttctttttcattagtattgaggggttttctaatttctgtagtgactttttctttgacccattggttgtttaagaatatgttgtttaatttccacatatttgtgagttttccttctaagaatgagttctagtttcattccactgtgatcagactaaatactttatgatttcaatgttttaaaatttattatctttttgtggcttgttctgtagaattcacatgagaaaaaatgtatattctgctattgttgagtggcgtgttctgtctaatcgattagaatgttgtcaggcctctgtttctgtattgatcttctctctagttgtgctatccattattttaaatgaggtattgaagtctccaactattatagcattgtctttttttccttcaattctgttaatttttggttcatatattttggggctctgctgctaggtgtttatattttataactatatctttttggtgggttgaaacttttatcaaatgagtctttgtgtcttgtaacctttttgatttaaaatctattttttctgattacagtatggccacgcagctttttctttctagttgtgctatccattattttaaatgaggtattgaagtctccaactattatagcattgtctttttttccttcaattctgttaatttttggttcatatattttggggctctgctgctaggtgtttatattttatatctttttggtgggttgaaacttttatcaaatgagtctttgtgtcttgtaacctttttgatttaaaatctattttttctgattacagtatggccacgcagctttttctttcttttttgagactgagtctcgctctgtcacccaggttggagagcagtggcatgatctcagctcactgcaacctccgcctcccggattcaagcaattcccctgcctcagcctcctgagtagctgggattacaagtgtgtgccaccatgccctgctaagttttgtatttttagtagagatggggtttcttcatgttggccaggctggtcttgaactcctgacctcaggtgatccggccgcctcagcctcccaaagtgctgggattacaggaatgagccaccgcgcccggcctactcagctttttctatcagctctctttttccattgtttacctttgtattatctttttccatcattttactttgaatgtctttgtatctaaatgttttataggcagcatatagatggatcatgtttttatttatttattttgaggtggagtcttgctctgttgcccaggctggagtgcagtggcacaatcttggctcaatgcaacttctgccttctgggttcaagcaattgtcctgcctcagcctcctgagtagctgggattacaggtgcccaccactactcctggctaattttttctatatttttagcagaggtggggtttcaccatgttggcaaggccggtcttgaactcatgacctcaagtgatctgcctgcaacgatttcccaaagtgctgggattacaggcatgacccaccgtctgcatcatgtttttttaaaaaaatcgaatctgggctgggtgcagtggcttacgtttgtaataccagcactttgggaggctggggcgggccgatcatgaggtcaggagttcgagagcagcctggccaacacattgaaaccccgtctctactaaaaaaacaaaaattagctgggcgcagtggcaggcgcctgtaatcccagcttctaaggaggctgaggcagaagaatcgcttgaaccagggaggtggaggttgcagtgagctacgattgcaccactgcactccagcctgggtgacagaactagagtctgtccaaaaaaaataaaaaatctaatctgtcaatttttgtcttctaataggagagtttaatctacctacacttaaagtaattatttaaccttctttcatttagctatgtgttttcagtatgtcttatatattttttgtttctcagttcttccattactgctttatttatttatttatttatttatttatttatttattttgagacagagtctcactctgtcacccagactggagtgcaatggcaccatctcggctcactgcaacctccacctcccgggctcaagcgattctcctgcctcaacctcccgagtagctgggattacaggcatctgccaccacacctggctaatgtttcgtggttttagtagagacggggtttcaccatgttggccaggctggtcttgaactcctgactttgggatctgcctgcctcagcctcccaaagtgctgggactacaggcgcctgccaccatgcccagctaattttttttttttttttttttgtatttttagtagagacgggatttcactgcattagccaggatggtctcaatatcctgaccttgtgatctgcccgcctcagactcccaaagtgctgggattacaggcatgagccaccgcgcccggccgagtttagtcttataatattttttttcagttattttttccagtggttactttggaaattgcaattagcatcttacatttacatcttgtatgtgaataataccaacgtagtgttgatcatacaaacactgctgtgtagtttccatccctcaccctttgtgttgttattgtcacggatgcatccttataccttgtttccccacagacacacatttagaattattgctttacgtaatttccttttaaatcataggaaagaaagcaaagttacaaacctgaagtacaataatactgacttttatattcaccagcatgcttacctttgccagagttgtgtatttcttcccatgccttggagttgctacccagtggcttttcacttcagcctgaaagcctgccttagcaatttttgtgggcaggtctgctggtaatcaactccttcagcttttgcttacctggaaatattgtaatttctctttcatcccccactccagctttattgaggtatcactgacagataaacattttccatacaaacacacttcattttattctacttcacattactgcactttacagcttttttttttttttttttaacaaatcgaaggtttacgggaatcctacatccaagtcgtctcttggtgccattttctttttaaacaatttttggcagccacatttattagataaaattatctgaacatattttgacatagaatacctaaaatattatcatttcaacatgtagtcaacataagaaattattaaggagcttctttttaaacatttttatagtgtctttggaattcagtatgcattttactttttttggtctcactgcaatttaattatttatttttatttatgtattttttattttaccttaagttctgggatacatgtgcagaatgtgcaggtttgttacataggtatacatgtgccatggtggtttgctgcacccatcgacctgtcatctcggttttaagccccgcgtgcattagatatttgtcctaatgctctccctccacttgccccccaccccgacaggccccggtatgggatgttcccccccgtgtccatgtgttctcactgttcaactcccacttatgagtgagagcatgcggtgtttggttttctgcttttgtgttagtctgctgagaatgacggcttccagcttcatccatgtccctgcaaaggacataaaatcattcttttttatggcagcatagtattccatggtgtatatgtgcccatgtttcttttttgagacggagtctcgctctgttgcccaggctggagtgcagtgatgcgatctgggctcactgcaacctccacctcccgggttcaagtgattctcctgccttagcctcctgagtagctgcgattacaggcgcctgccaccatggctggctaatttttgtatttttagtagagatggggtttcaccatgttggccaggctggtcttgaactcctgacctcgagtgatctggcctcccaaagtgttgggattacagtcgtgagccactgcgcccagcgagtgccacattttctttatccagtctatcactgatgggcatttgggttggttccaagtctttgctattgtaaacagtgcttcttggtgccatatttttaacggcacatactcactttgtgtcacattttggtaattctcacaatatttcaaactttttcagtatcatcatgtctgttgtggtatctgtgatcagtgatgttactactcgaattgctttggggtgccacaaaccacacccatataagacagtgaacacagtaagtgtgtctgttctgactgctctacccaccagctatttccccatctctctttccctgagacacagcgatgtggaaagtaagtcagttagtaaccctacagtggctctcagtgttcaagtgaaaggaagagtttcgcctctctcactttaaataaaaaaggtagaaataattaagcttagtgagcaaagcatttcaaaagccaagcttggccaaaaactagacattttattccaaatggccaagttgtgaatgcaaagggaaagttcttttcttttctttctttccctccctccttccctccccccgcccttccctctttttcgttttttgacagggtcttagtctgtcacccaggctggattgcagtggcgtggtcatgacttactgtagcctcaacctctcagactcaagtgatcctcccacctcagccttccaagtagctgggactacaggcacacaccaccatgcccagttaactttttattttttgtagagacagaatcttgctatgttgcccatgctggtttcaaactcctagacacaagcgatccttctgcctcagcctcctaaagtgctaggattacaggcgcatgccatctcatctggcccaaaggaaaacttcttgaaggaaactaaggtgctactccagtaaacacacaaacgataagaaagtgaaacagccttattgctgatatggagtaagttttagtggcctggataaaagatcaaaccagctatagcattcccttaagtcaaagattaatccagtgtgaggtcctacgtaactctttaattctatgaaggctgagccaggtgaggaagctgcagaagaaaagtctgaagccagcggaggttagtcagcagaggttagttcatgaagtttaatgaaagaagtcatctcttaacataagatggcaaggagaagctgcagtaatttgtttagaagatctagctaagataattgatgcaggaggctacactgaacaacatttttttttttttggggggggacagagtctggctgttaccaggctgtagtacagtggcgcgatctcagctcactgcaacctctgactcctgggttcaagcaattctcatacctcagcctcccaggtagctgggattacaggcatgcaccaccacatgcagctagtttttgtatttttagtagagacggggtttcaccatgttgtccaggaaggtctcgatctcctgacctcatgatccgcctgccttggccttccaagtgccgggattacaggcgtgagccactgtgcccggcctgaacaacagatttgtaatgtagataaaatagttttatattggaagaaaatgccatctaggacttatggagagaagtcaatccctggctccaaagcttcaaaggacaggctgactcttattaggggttaaagcaactggtaactttaagttgaagccaatgttcatttgccattccaaaaatcctagggcccttaggaattatgcgaaatatactctgcctgtgctgtataaatggaacaacaaagcctggatgacagcacatgtgtttatagcatggattatggaatatctaaaacccactgttaagacctactgcacagataagatttctttcaaaatattgctgcttattgacaatgcacctgctcacccaagtgctctggtggagatgtacgaggaagttactgttgtttttgtgcttactaacacaacttccattctgcagcccatggatcaaagagtaattttgaatttcaagtcttattatttaagaaatacatttcatgagactatagctaccatagatagtgattcttttgatggatctgggcaaagtaagttgaaaaccttctggaaagcattcgccattctagatgtcattaagaacatctgtgattcatgggaggtggtaaaaacatcaacagtaactggaggttggaggaagttgattccaacgctcacagaagactttgagggattaaagacttcagtgaaggaagtacctgcaagtgtggtgggaacagcaagaggactagaattagaagtggagcctgaagatgagactgaattgctgtaatttcatgatgaacctgaatggatgagatgttgcttctcatggatgagcaaataaagtggttttttgagatggaccctactcctggtgaagatgctgtgaacgctgttgagatgataacaaagtatttagactatttcataaacttagttgataaatcatggcagggtttgacaagattgactccaattttacaagttctactgtgggcaaaatgctattaaacaacattgtattgccatggagaaatctttcaagaaaggcagagtcactcgatggggcaaacttcattgttgtctcattttaagaaattaccatagccaccccaaccttcagcacaaccaccctgatcagccagcagccatcaacatccaggcaagatcctttaccagcagaaagattacaactctctgagggctcagatactccatcctgttttccagaatggaaacttacattcctaccagcagtgtgtaagggtttccttttctccacattctccccaacacttacctttcatctttttgacaactgccattccaacaggtgtgaggtgatatctcattgtggttttgatttgcatttccctgatgattataatgttgatcaccttttcttttctttccttccttccttccttccctccctctctccctccttcctttctttcttttttgagacagagtcttgctcagctgctcaggatggagtgcagtggtgtgatctcagctcactgcgaccagtgtctcccgggttcgagtgattctcctgtctcagccccctgagtagctgggattacaggcacccactatcatgcccagctaatttttgtattttagtagagacggggtttcaccatgttggccagtggctggccagcctcaggtgatctgcctgacttgacttcccaaagtgctaggattacaggtgtgagccactgtgcccggcctgagcatcttttcatacacctgttggccatttgtatgttagcattttttatttttatttatttatttatttatttttttgagacggagtctcactctgtcacccaggctggagtgcagtggcgcaatctcagctcactgcaagctccacctcccgggttcatgccattctcctgcctcagcctcctgagtagctgggactacaggcacccgccaccacgcccggcgaattttttttgtatttttagtggagttggggtttcaccgtgtaagccaggatagtcttgatctcctgacctcgtgatctgcccgcctcggcctctgaaagtgctgggattacaggcgtgagccaatgcgcctggcccagtatttttagaaataaagtattttttaaaaattaagctatatacattgtgcttttagacaacatgctctttcatacttactagtctatagtatagtgtatatatacactttctttttaaaatttttttagggacatcatctcactctgttgcccaggctggagtacaacagaacaattatagttctctgcagcctcaaattcttggcctcaagtggtcttggcctcaagcctccaccttggcctccctaaatgctgggattataggtacatgccaccatgtcccaccatgtatacataacttttatatgcattaggaaaccaaacaatttttgtgactctctttattgcaattctagcttgattgtagtggtagaatagaacctgtaatatctccaaggtatgcctgtatttaaggcaccattgattaccacaatcaagctaattatgatatccatcacctcacacacttacctttatttttggtgtgtgtgtgtggtgagaatacttaagatgtactctcttaacaaatctcaaatatacgaaatatatatatatatatgtatatatatatatatatgtatatactatatatacatacaggcacccaccaccacgcccggctaattttttgtattttttctagtagagatggggtttcaccgcattagccaggatggtctcgatctcctgacctcgtgatctgccccgcctcggcctcccaaagtgctgggattacaggcgtgagccaccgcacccggccccccttttttttttttgagaggatgtctcgctctgttgcccaggctggagtgcagcagtgcaatcttggctcactgcaagctctgcccccaggttcacgctattctcctgcctcagcctcccgagtagctgggactacagacacctgccaccacgcccagctattttttttttttttttgtatttttagtagagacggggttttactgtgttagccaggatggtctcgatctcctgaccttgtgatccgcccacctcagcctcccaaagtggtgggatgtatacgatatatttttattaactatagtcatttgctctaccttagatctctagaacttatagctgaaagtttctacccttagactaacaacttcccacttcccccactccctgccctctggtaaccacccttccactctgtttctatgaattctactttttcagattccacagagaagtgagatcacatgatatttgtctttctgtgtctgatttatttcacttagcaaatgtcctccaggttcatccacattgtcataaatggcaggatttccttcttttgaaagttgaatagtattccattgcatatatataccacattttattcatccatctgtagacagtttgcttccatatatgtatttttttttttgagacagagtttcgcttttgttgcctaggctggagtgcaatgatgccatctcggctcactgcaacctccgcctcccaggttcaagctattctcctgcctcagcctcccaagtagctgggattacaggcatgcgccaccacaccaggctaattttgtatttttagtagagatggcattttctccatgttggtcaggctggtctcgaactcccgatctcaggtgatctgcccgcctcggcctcccaaagggctgggattacaggcgtgagccactgcgcctggcactcatgaatattcttaatggaatctagaatggtgactcctttccacaaggctttctttccatttactttgcacaggtccatcagaagaatcactatctatggcaactttagccttataaaatgtatttcttaactaataagacttgaaagtcaaaatcactccttgaaccgcgggcttcagaacggatattgtattggcaggcatgaaaacaatattcctctgcttgtacacctccattagagctcttgaggaactaggtgcgttgtcaaaaagaaataataattttgaaagaattctttttttttctgagcagtgtgtctccacagtgggcttaaaatattcagcaaaacacactgtaaacagatgtcttccaggctttgttgttaaattgacagagcacaggcagagtagactgaacgtaattcttaagggctctagcatttctgggatgataaacaaacaacagctttaatttaaagtcaccagctgtgttagcccctaagaagagagtcagttgtcctttgaagctttgaagccaggcagtgacttctctctaggaggaacgtcctaaatggcatcttcttccaccaaaaagctgtttcttctacattgaacgtctgttgcttagtggagccatctttatcaatgatcttagctagatcttctggataacttgttgcaacttctacatcagcacttgctgcttcaccttgcacttttttgtttgtttgtttgtttgttttgagacgaagtctcactctgtcgcccaagctggagtgcagtggtgtgatctcaaatcactgcacctccgccacccagattccggtgattctcctgcctcagcctcccgagtagctaggattacaggcatgccactacgcccagtttacttacttaattaattaattattattattttttgagacagagtcttgctctgttgcccaggctggagtgcaatggtacaatctcagctcactgcaacctctgcttcccaagttcaagcgattcaactgtcttggcctcctgagtagctgggattatatgcacgtgccactgtgcccagctaatttttgtatttttagtagagacagggtttcaccatggtgcccaggctggtcttgaactcctgacctcagcctcccaaagtgatccacctgcctcagcctcccaaagtgctgggattacaggcgtgagccaccgtgcctggcccaatttttgtatttttagtagggatggggtttcaccatgttggccaggctggtcttgagctctcaactttgtgatccacccgcctcggcctcctaaagtgctgggattacaggcgtgagccactgcgcccggccaaccttgcattttcatattatagagatgacttctttccttaaaccccatgaactaactaacctctgttagcttcaaacttttcttcagcagcagtttcctcacctccctcagctttcacagaactgaagcaagctaggggcttgccctggattaggctttgccttaaggggatgttgtgggtgatttgatgttctaaccagcactaaaactttttccatatcagcaacaaggctgttttgcattcttatcatttgtgtattcactggagaagcacttttaatttccttcaagaacttttcctttgctttcacaacttggctaatgggcacaagaggcctagctttcagcttaggtcggctttcggtacgctttctgcactaaaggtagtcgcttctgccttttgattgaaagtgagattcatgcagttcttctttccacttgaacatgtacagggcactgcacggttattaattagcctaatttcaatactgttgtgtatcaggtaatagagaggcctgagaagaaggagagagctgggaatggatggtggacagagcagtcagaacacatgtaactggcagggtgcggtggctcatgcctataatccagcactttgggaggccgaggtgggaggattgcttgagtccaggagttggagactagcttggacaatataatgagacctcatctctacaaaaaatttacaaattagctgagtgtggtggcacatgcctgctgtagttatttgggaggctgaggtgggaggatcgcttgagcccagaaggtgaagtttgcagtgagctgagatcatgccaccgcactccagcccgggtgaaagagaaagactctgtctcaaaacaaaacaaaacgacacatacacaacattgattaagttcaccctctcatatcaatgagtttgtaaacaattacaatagcaacattaaagatcactgatcaccataacaaacatgataatgaaaacatctgaaatattgtgagaatcagcgaaacgtaacacagatacagaaagtgagcatatgctgttagaaacacggcaccgcaagacttgcttgacacagggttgccgcaaacattcaataggtaaaaaacagtatctgcaaagtgcaataaagcaaaaacactataaaacttagtgggcccgtacatgagacttctctgcattatttcttttttttctttgtggagatggggtctctctgtcatccaggctggaatgcagtggcaccatcacagctcactgcatctttcaactcctgggcttcaagggatcctcctgcctcagcctcccaagtaactggaatcacagcatgggccaccacactgcgcccagcctgtcttttcattcttaacagtgtctctggcacagcagacatgtttcactttaatgaagtccatcttgtccattttttcttttgtagatggtgtttttgtgttgcatctagaaactcattgccaaacccaaggtcacctagattttctcctgtgttattaaacttacagaagtttgctagttttgtgttacatttaggtctatgatctgtattgtgttaattgttgggaaaggtgtaaggtcagtggctatattcattattccacatgtggatgtctagttgtttccagcaccatttgttgtaaagacaatcttttctccattaagttgcatttgctcctctgtcaaagatgagcggactctatttgtatgggtctatttctggggtgcttattctgttccactgatctatttacctattctttttccaatacttcactgtcttaatacatacagaagacaacatatacaaagtaggaagtcaactacaaatgagaacaaagttcttgtatttttcccccaaagtattttaaccaaacattttgcaaaaaatcaaaatgcagaaatgtaagaatgtcaacaaatttgctcaactataacagaaaaagaaagcttacaagagaatgtagagctcagagtttctatttactgttcgttagataaatggtttaaatgaactgaaaatcctgaaaaactgctcaaattataaagaatctatgaaatactacggaagcattttctaacctgtttctgaaacctctgaaaaaaactcatcatgtatcaatacaagctaacttgctttacagaaataaaaggaaaactatatatttcattacctgtgtacatgtgtctttcacatacttgtaactcagaaaaccatgctttcacaaatataataatagaaatacgataatattagcaatcataacattcgtgaaactataaagaacaaactggccagatgctctctcttacaccctagaacccaggttctggtcagggcttctcttggttgtatgaactcacctcatggaactgtcgtaagactcaaaagagatagtgtaaacaaaagcatcttgaaaactgtattagcctgtagatatgtggttcatgtacatccaggcactttaacggctgacagctgccctggcagaaccgcttctctcgatttttttttttttttttttacagggaaactaaagaattcttttattctgttaaacagaataaaaaggaaaaaagaatacagacatcacagtgatgaactttcacaaagctaatagatttgaactacagagcaatggaatatttataagcaagttgtcatggtattaatgaccaaatggcatccaactaggttttctaagctcaaaaacatttaaaatctcagacttaaaatttaaatctagacacgacaattgtaagcacaccactcagtcatttaaaactattcagtgagtgctactcctgcgtaaatatttttttcttctcattttttttctcccaagatttagaatgtcacatctcatgttcctactagtaatcgcacacaggattaaaagcccaaccaaccaagaaagtattctttttataatgtgttcttaaaagaagaaagaaaaattaaatgtgaacattttgtacaacagttgctgaagaagagcaacaccaattctgaaatatcatgtggactatacaaaaaggcatggctcatggaaccaagtatataacgctacagcatttgaacatcagtctctaaaagttggtgatattacatcctgtacacagctctgtgtctctctacccggctagcgcatgcccaggatctggctgctttttagttgataatttttctcaatatctgacagggcttgagcccgcagctgggcagcatgaagcatgaagcaaggaccttcaggtccttgcacttggacttagatgtgagctgactctcagaattctcactcctcatgacattctctttactttccccactgaaatgacctttcttcttaattactgaggatggaagactaagaagttctggactacttgccagagacaggaacttctttagcaagctgtaattcttcaacagattttctgctctagccagtctgtcctctgctagtctctcacggacacaaaactcctgttctttctgctccaatctttcttctcttgctttgagagctcgctctcgctcctctaactgaatttcctttagtttcagctcactcaatacagggctggaatcctgcaatttttctggctctcctaattgtcgccctcttctctcaagatttcttcttcgttcttctgcaaccaaatctgctattaaagggttctcgagaatttcttcaacagaaggtcgatggtaatcctttaacatcctcataataatttcattcaattcgtcagagtcacggtatagaatttgcctgaatttgccttctctgattttcccagcaagttctttctggctaaaagctgtaaatggaggcattaatgcacctaactcatacagcaaacggcccaatgaccagatatctggtttctcattgtaggacatgtgattcgtttgttcaggagacatgtaataaggtgtgccaacaaatgtttttgcaaaactcgtgtcgtggtttaatattctggctagccccaaatctccaagcttgacgttttgcttgccatccaggaaaacactggctggtttcagatcccgacgcactacagtatgatcaccatcacttcgtctgtggcattacttcagggccagagtcaactgagtcgtcactcgaagaacaaactcttcatctaagtattgcctttccttggttccctttgtaattacactagccaggtctccttcttcacaatattccattacaatgtacagtgttgtgttggtccggtcaataatacgatcatagtaatgaacgatgtttggatttttcagttcacaaagcaaattcacttcagaaacaagcatctgtttctcagcttctgtcatggagccataatgaagttctttccaaactagtatcttgccgtcactcttcctctggatcttctggcagcggccacaggagcctgtgccaatggtgtacaacacttcatagttctcagcccgggacggcatggccagccagtcgccagagtcgcgctgcctcatgcaagttgtgcccccaagtgcagagctccagggaccgggagctccagggacctggacggagaagcccccgagcagcactgacctgccacccctgccttcggccctgtttctctctcgattcttaacttatatttccaagtccagttcaaaagttgtattcttggaagcctccgcatcccacctgtccatccaggcagaactaatccatctacactctagcattatgctctcataactcttggctcttcaccaattcattcaagggtgtaatgagcatttaaaatatgtcaggcatcaggctatgcactggagaaaaaaatcctaaatgtgtaaaacttccaaagttttctcacacacattatctcatttcatactttaaaaaaatatcccataggatgataattttttgttaacaatttctccaaccagaatgaattcccagggggtagaaactaagtgtgattcatccttgactccccagagtctagtgcagtgcctagcacaccgaagacactcattaaatgcttgataaaggagtaacagacacttgtttaattactaaaatatcaatcagggttaacactgaaataatctttccacaaagtttccataggggaaaggggaaaatacattatatgaacacatctgtggagcgaaaattcctccctatgacagagcatctccaactcaagtttaactgtttaacaaagccatgtagcaactgaagatggatttgatttcactattagagtaataagctctaactgaaaaacagtgagttctgcacaaaagctcctatgcagatcattctgcttggcaaaactggacgttattgcacaaacattaaaataaacatttaaacttggccgggcgtaggtggctcacgcctataatcacagcactttgggaagctgaggcgggtggatcacaaggtcaggagatctagaccatcctggcaaacacggtgaaaccctgtctctactaaaaatacaaagaattagttggaagtggtggcacgtgcctgtagtcccagctacttgggaggctgaggcaggagaatcgcttgaacccgggaggcagaggttgcagtgagccgagatcgtgccactgcactccagcctggtgacagaacgagactctgtctcaaaaaaaaaaaaaaaaaaattaaaaatagttaaattgacagactatataaacgggtttaccatccttttctcctttagtatttacttttcttaatctcacgtcaagttctgctttacataaaaaagcctcacagtttacaaagctctttcccatatatggtcttagaaatcctgtagataccatcaaaagcatcttggagaggtagtgcagtactggagaagcaacacaatgagaagacctgggcttgaatcctagcttttactagctgtatgaccttagggatatgtagctaaaactgcagaagaaataaaaatgaatatgtgtctaaaattatagaagaaataaaaaatgaaaatatttttaatgtttttaaaatgcctacaactttggatcacacaaatgaccaagctgataaaccttaaaaattcaaaatatcggctgggtgtggtggctcttgcctgtaatcccaggactttgggattcacctggctaacgtggtgaaaccccatttctactaaaaatacaaaaaattagccaggcgtggtggcacatgcctgtaatctcagttacttgggaggctgagacaggagaatctattgaacctggcaggtggaggttgcagtgacctgagatcgcgccactgcactctggcttgggcaacaacattttttctggcagccgtaatcccatgcctcagcttcttgagtggctgagattatagatgtgcgcccccacgccctactattttgtatttttagtagagatggggttttgccatgttccaggctggtctcgaactcctgatctcaagtgatccacccgctttggcctcccaaagtgctgggagccaccatgcctggctgatcccactttctgactttggccactgcactgagggggatattctggcagtgtcgttatcactggggaaacgaaggccagggagcattgccttatgggctgtgactgtttcttcagctgctttcacataagctttgacagcctgccccctgagcaggaaggacagggatggctgtcaccggcaggcccaggcccagcccctcagccaggtagggtggccggaggatgccaggcagcactggctccccagcctggggctcaccgctctcgtccaggtcctccaggcgcactgtctggtggggcacggggccatccacaactcgctccaggatgccttggaccagggctggctggttgcctgggcaaaccctgaggtgctccccaccgcaggtagttcaggccttggctgtcctcacaggagagttccaccaggatggtgatgcggcttgggaaggaaaaagaagcctcaggtgggctgggcactgtggctcacacctataatccgagcactttgggaggctgaggtgagcggatcacctgaggtcaggagttcaagaccattctggccaacatggtgaaaccccgtctctgctaaaaattacaaaaaattagctgggtgtggtggtggctgtaatcccagctacttggcaggctgaggcacatactggtcatagggacaccagaaatcaactggctggccagcacctaacattaaaggtcctgccaagcagagatattttttagctgaatcatattttctttctggaattttagacatgcaagtactgagataacgaaggggttactatctggggcaaaagctgaaaggatacagaaagatgaaaatcatgaggaagagctgaacacaaaaccaagagacagtcaaagagcgtagccagttccagaacccacagccatctagttctgggtaggctctgctctaattcacgcttttcctaagatccttgagaaaatacaaatgactgctttgcaataaaagcctaactaaaacaacttaaattgattgcccaggctctcacaggtaaaaccaagatttggtgactaacaatgaggaagataaaagaaataagaggaggggggaggagggagggatagcattaggagatatacctaatgctaaatgatgagttaatgggtgcagcacagcaacatgacacatgtatgcatatgtaacaaatctgcacgttgtgcacatgtaccctaaaacttaaagtatactaataataaaattaaagaaaaaaagagactcccacaccacttgtgcaccccaatcagaagcctgatacccatccccacatggacagctgcacaggcccttgggctccacatgcttgtgaacacacatgtactctcaagtaaggacacgggttcttgggcatcaagtggtatgtggacaggctcctttgcccatgactgggtatttctggcagtttcctgttgttattctctttgatcttgtaatggcttttgggacccccacttctccagtcccagggctcagaagcccaccaggctttccgatgctctcactaagtgttggcttcttgagcaagaagggctaggtcagggggtggggtctggttttactcatctctgagtctagcctctaacccactgcttgacgcagaaaaggtacctggtgaaaatctattaaaatcaatgactgatttcgcccaatttggagtgagacatgcctgtacagtctcaatgtctggagagctttacaaaccccaggggacaccaggaaaaaaaaaaaagaagaggaaacaatttaaaatgattagggtttctagatggggaactagaagagatgatgatgctactgaggaagagaaatatggtgtgaagaggaggttgatttgaagagatactgaattaagttttggacatttcaagtctgaaacgtctgcgtactatctatgaggagattggaaaatccgcaattcaaaaagcatcacttaatacatggtagtctaagccgcagaaacacaggagtatcaaaagacaagtcaaacccaagtgctctttgacaaagctgatggcatatagacagacaagaccttcataatggagtaaatggacgctctgccctgatgtactgtgtactcatctgtcctggagctaggcttcccaccaggcgaaaatgaaggccaggaagaactccagtaggtctaagtaagaaactaaaaggattgaaaatctgaaactgacagtgccatatcccccagaaagagaacgaaagaaaaaaagaaaatctcagatttactccttacacaactttataggtcacaaaacattttataggagaggtagacagttttcataagcacacaccccagctttaacatatgaagcaacagatttggaaaaataaacttatctaagattatgcagctaaagccaggtgtcgtggctcacacctgtaatcccagcactttgagaagctgaggcaggcagatcacctgaggtcaggagttcgagaccagcctggccaacatggtgaaaccctgtctctactaataatgtaaaattagctggatgtggtggtgcatgcctgtaatcccagctactcaggaggctgaggcaggagaatcacctgaatccaggaggtggaggttgcagtgagccaagatcgtgccactgcactccagcctgggcgacaagagtgaaactccatctcaaaaaaaaaaaaaagaaaagaaaaaaaagaatatgcagctaataagcagcagagctgagaatccttagcactctcaagccacaagactcaacaggtttcatggaaaccaaactgattgcatctcactgaagtatctacagcaggtccaatctgctttcctttagctttttctagatcaccacagagaaggaatacaaatataacagtttctgatcctgaaaaaaaaccaacccaactttgttttccagaaatctttgctatttgtaaactagtcagattttagactgggcatggtggctcatgcctgtaatcccagcactttgggaggccgaggcaggtggatcacgaggtcaggagatagagaccaacctggcaaacacagtgaaaccctgtctctattaaaaatacaaaaaattagctgggtatggtagtgtgcacctgtagtcccagctgctagggaggctgaggcaggagaatggcgtgaacccgggaggcggagcttgtagttagccaagattgagccactgcactccagcctggacgatagagcgagactctgtctcaaaaaaaaaaaaaaatttaaagaggaggggacacacatcttctaccttcctcaccaatgtttgctttttacttacacaaaaaagggaaagtaaaaacatcctggttgtattaaaggttggggttagaatgcaaatatggttcatctcaagtacaaaagaaaattaaaaaatacaaactaccatcagagaatactataaacacctttatgcagataaactagaaaatctagaagaaatggataaattcctcgacacatacaccctccgaagactaaaccaggaagaatttgaatctctgaatagacaaataacaggctccgaaattgaggcaataatcaatagcttaccaaccaaaaaaagcccaggaccagatggattcacagccgaattctaccagaggtacaaggaggagctggtaccattccttctgaaactattccaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaacagatgcagaaaaggcctttgacaaaattcaacaacacttcatgctaaaaactctcaataaattaggtattgatgggacgtatctcaaaatactaagagctatctatgacaaacccacagccaatatcatactgaatgggcaaaaactggtagcattctctttgaaaactggcacgagacagggatgccctctctcaccactcctattcaacatagtgttggaagttctggccagggcaatcaggcaggagaaggaaataaagggtattcaattaggaaaagaggaagtcaagttgtccctgtttacagatgacatgattgtatatctagaaaaccccatcatctcagcccaaaatctccttaagatgataagcaacttcagcaaagtctcaggatataaaatcaatgtgcaaaaatcacaagcattcttatacaccaataacagacaaacagagagccaaatcatgagtgaactcccattcacaactgcttcaaagagaataaaatacctaggaatccaacttagaagggacgtgaaggacctcttcaaggagaactacaaaccactgctcaatgaaataaaagaggatacaaacaaatggaagaacattccatactcatgggtaggaagaatcaatatcgtgaaaatggccatactgcccaaggtaatttatagattcagtgccatccccatcaagctaccagtgactttcttcacagaattggaaaaaactactttaaagttcatatggaaccaaaaaagagcccgcattgccaagtcaatcctgagccaaaagaacaaagctggaggcatcacactacctgacttcaaactatactacaaggcaacagtaaccaaaacagcatggtactggtaccaaaacagaaatatagaccaatggaacagaacagagccctcagaaataatgccacatatctacaactatctgatctttgacaaacctgacaaaatcaagcaatggggaaaggattccctatttaataaatggtgctgggaaaactggctagccatatgtagaaagctgaaactggatcccttccttacacctaatacaaaaattaattcaagatggattaaatacttaaatgttagacttataactgtaaaaaccccagaagaaaacctaggcaataccattcaggacataggcatgggcaaggacttcatgtctaaaacaccaaaagcaacggcaacaaaagccaaaattgacaaatgggatctaattaaactaaagagcttctgctcagcaaaagaaactactatcagagtgaacaggcaacctacagaatggaagaaaatttttgcaatctactcatctgacaaagggctaatatccagaatctacaatgaactcaaacaaatttccaagaaaaaaaacaaacaaccccatcgacaagtgggcgaaggacatgaacagacacttctcaaaagaagacatttatgcagccagaagacacatgaaaaaatgctcatcctcactggccatcagagaaatgcaaatcacaaccacaatgaggtagcatctcacaccagttagaatggtgagcattaaaaagtcaggaaagaacaggtgctggagaggatgtggagaaataggaacacttttacactgttagtgggactgtaaactagttcaaccattgtggaagtcaatgtggcgattcctcagggatctagaactagaaataccatttgacccagccatcccattactgggtatgtacccaaaggattataaaacatgttgctataaagacacatgcacacgtatatttattgcggcactattcacaatagcagagacttggaaccaacccaaatgtccaacaatgatagactggattaagaaaatgtggcacatagacaccatggaatactatgcagccataaaaatgatgagttcatgtcctttgtaaggacatggatgaatctggaaaccatcattctcagcaaactatcacaagaacaaaaaatccaaacactgcatgttctcactcataggtgggaattgaacaatgagaacacatggacacaggaaggggaacatcacacaccggggcctgttgtggggtggaggcagggggtagggatagcattaggagatacacctaatgttaaatgacgagttaatggatgcagcacaccaacatggcacatgtatacatatgtaacaaacctgcacgttgtgcacatgtaccctaaaacttaaagtataataataaaaaaaattagaatgctaaaatcccaaaaaaaaaaaagaaaattaaaattatcttaggcaatttagaaatagcaactgagatgagagctggagagaggcctttcatgggaaggtgagaaggggttacttagaattgctaaagggcgggggaaggggaggttcaacacaattttcttattttcttgattccctaatgctccagtcctttggacttcttggtcttaaggctatctgaaggacctaattagacaagtttcccatcttccactgattcttcaccgcctctccactatttctcaacctcagtttgtttcctacacactgccacctgtggccagcaaattgactaacaatgtatgtctactaacttaatggtcatggatgttaaacactgttaaatccaggaaactggtaaagattaagtctatagctaatgagtggcagaactaagtctaaacatgatccttgagattccaaaatcagtggtctctatacgtatcatgttgtctctaaggctcaatgaccatgaatgtatgttatggtaaatgggaccaaataatgtcacagaagagttttcaaaaggaaggtaaaatgaggcaagaaaaaaagacaatgatagggaaggcaatgcaagcatcatatctattattaaggaagagctcacaacatttccagaaaggctttctaggaaccagcctcgactgagggcagcacgaacaagcaccattttccaggccaccccttgcaccatcttcatgatttcccaccacccctttgaattattttctaaatcaccctgatgctgtcttacacagcatatttttaaaagttctcagaaacaggctcttacagttttatttcttcttttaaaaaaagttcccgcttatcatgttgtactatttaatcagaatatacttgaaaacaaaagatgctttgtggttttttgactcttggtaattaatccattgtaggcagtatttaaaaaaatgatgtaggacagggaaacccctatgaaatgggtagtctgaaaagcagttactagatactgaccatcattttaggaaaggcaggctatttaaacccactgtatgctcccaggtaaacttgtcttcaattcttgttaagtcaaatatgaaaaaccaaacttgccgtctctataattgctatcattgaaaaaattctgttgagaggagacaccaaacatagtatttcttaccccgtgcagcataataaaaaataggattcccagctttggaagccccagcttggtagaaaatacttaacgttttcaaagccttgatgtcttctttttcatgtacctgatgcctaaaagaaaaagaacagagtacctctgaggctttatgttgtctactgagtatgtaaaatagtctataattggataaacaataaaatactaaaataaaaaatattttaaaagcaacaggcattctaaagggtaatctgacaacatgcaccaaaaatttcaaggtattgctctttgagccacaaaagcacttctatgactattctaagagaactattggatgaggatattaaccataggattgtttttactcatgacatttttgtcccagacagaagtttatgatttttgaatgaattcattttatcaatcttttcctttctagcttatggattttgaatggatgaaaaaggccttgctttgccatgctgttttgattgatgggagtttatcctcacaaatggtatgaagatatttttccagatcattactcagttttatcaacaccatttattgaaagtccaacctaatctccttgatttcaaatactcaacatgtacagatttttctttgttgttattccttaaacaatatggtataacaactatttatataacatttatattgtattagatattataagtaatctaaaaatatttaaaatatatgggaggatgtgcatagtttatatgcaaatactatgacattttgtatcagggacttgagtctgtggattttagtgttcatgggagtgagatgtgggcaggagtttggggggtggttcctggaaccaatccctgacagatactgagagacgaccgtattataaagctcggctttgtcaaagaaacatatgtaaatgcttattatacagtccatagtgtttaatcactttctgatatgtgtcaataagtatttatcattaaagtagacttaattacttcctttttttgtctatctctggtgtttgaatcaggaaatcaattgtttcttagactcaacacaatgagtttctcaaataatacctttatctatctaatcataacataaatgcaatctgaggctttatgtatcttatttcccaataactgtagactattcttcataaactgacagcaataacttcccaaacataccgctctcgcacatttatttttcctgaaagtctatcggtcaagaaaaagtagtaataaagattagtgtctttacatattttgaacacaaaagttttacatctaaaaagtttaaatacacataaaatacaagtataaagctgtaatgaagtagttacaattctcacagtaaaacccactaatattggaaagtcatttttttttaccttgtaagacattttacatcatcatctgctgcttggtttgatgttcccataacccagtctgtcaggtattccaccatcttattcctatagaatggtggagaaaagagaaacagcaaacaatttttttgaagtcacacctcacccccacacacacacctttagtcatgtaagattacttacagtgcaaataatttggcagataacccaggtgacatgacgactttataaaagagatactgctatcatagatgtaaaagccagaaggaacaagcaacgtggatatttatcctccatcatggcccttagttatgctatcagattggaaacagaatcaaattcttagctcaagtacagcagagttttagaaaaagggaggcttgccacaggcacaaagcttagggaaatctgaggagagacatagagaaaaacaaacatgtaaactgctctctttttatgtcttcctttctaccagtaaccagatatctactctatttctgtacttcattgaacaaactaagatttacaagaccctacattgctcttttgagaactcacctaaattttatctcttggcaaaatgagaggtcatctctcggcaaaatgagaggtcatctctccttgccatcgttacttcaaccaactgacacagtttcgtttttatttgaattgcatggaccatattcccaagcacacaaacgtacctatacagacatagagacaataaaaaaattatcagatacagacataagataaggcattcaaaatactttaatcatcaaataaaacgaactaaatgtaagtttgaaaacagtaagatatttatttgtaggagagcatacacaatttctggttaccttattttcacaccgtttgtgtgcagtaaagaatggcaaattattttatcaattactatcaatatcaatgtgtgagaggtttttcttgtctcttaaatcttaaagtatgtttctgctacatttcagtagaaggcttacctgaccagatttaacatcattgtttcaatgctagcttgctctagatgttcagggctgccttcagtatgattatctagcaagttcttcattatatctagggtttgctctacaaattgagtattggtatcagtcaataaaacctatagagagaacaaatatattaatgatttgccatcaatgcccagaagacagatccctagagagatgaaactgactgatctaaacacacaaatagagacatgcacccacaggcacgcagtcaaacaggcacacagatatacacagacactcatacccatatacaaggcacgtataccctcaggcacacatacacatcagagttcctagaagcaagctgaccattcattgagatgattcttctttctacaattttttgacaatttttaaaaactgtgagtacctaatttaaatactctgaaagaaacagccttcattatttcaaacaagtcactctattcatagggaaaggtgaaaaataaaaaagagcacactttacctgtccttaggagtcaaaaaacttgctgatgggtcttcttcaatttgttaaatagcatcagataaagagcaggactcaattctagacccaccaggtccttatcattggtcggtatttgaagtcccactttctcaaggttacacaccattaacgacaagagctgatccatatatttgctgacaggtgtatctgcgtttccctctgaggacatcactgaaatcatggaacccttatgttcactgaccggacccacgggtgggctataggttggcaggccagaattacttctctgctggaggcacactcccccaagggcacaaaggaagccagtcatgttgatccatgcctgtagggagtctgtgtcagacagatctatgggtcctcctccactcacatgggacattcgcctcttaacaatggtcttgtgaagctttcaacagcctaaacacaaaatttttgtgcaaagcatgaattaaacctaaattagttgagacttgacaaattactcgttatccaacatttcgtccgtgacaaaagtacaaaaaaatgtaaaaaatacattaaaatcaaccccctaaattaccatatacatttttaaagagccactgatttatttttgtcatacagtaatataattgcccaagtatcaaatttcttttaaaaagctttgatttcacatggatgaaccttgggaacattatgctaagtgaaagaagctaatcataaaagcccacatattctaaaactccatttacagaaaatatccagaataggcaaatctatagagacaaagtagactcctggttgcccagggttggagaggcggggggaagtgagacaagaaagtgggggagttgttagaggcagagatagctaaaggatacagagttttttttctcaattgatgaaattgttctgaaactgatggtggtgatggttgcacaactctgtgaatatgctaacaacagtcactgaattggacactttgaatgggtgaattgtatggtatgtaattatatattatagtaacagttatcccccaaaagctttcattctaaagctacatgtcccctccaaataaaggtattaggtacacaattttgcttcactaaaatataacttttttcttattgtaattaagcatgacagaaaaataacatgggggaagagccagtttttataaatctcctaataatgagagcaatatgagcattataaatcatatacacacaaacaccaactcatcaatttccaaagcaacagataatacagtcaatagtaatagttgaatgaactgtccacattttaaaatttcatttaatctatgggctcaatcttctgcccaagacattccttaattagaatacctaacaaaatggcaaaatgaattgttcccatgttaatttttctctacctctgttgctccttttctgaaaattctgtgaaacaccctgatgaagggagaaagagcaagaaaagataaagaaatggtctctgcaacaaacagtctctagcagtgctgcccagtatttctgtgatgatggaaatactttctctctctgctgtctaacagagtaagtaattgtcatatgtggctaccgggtacttgcaatgtggctactatatgactgaggaactaaattgtatttaattttaattatgttaaaatttaagttaaatagtcacacgtagctagtggctatcatattacaaagtacaggtctagacaaaccacaactaaataacagtcttcagacaactatatgcttattttactgagtgactcgtgaaagattaccaaagtgaagtacatatatttagatcagttaatagacaaaaggcaactttacaaacttacctggccatcttccacttgggcttttggatagctaaggattagttttgttgcttgttcccattttgcatgtgtatcttcccaagcctaaaatgaagacagttatcacttgaaagcaactttaagtctagagctaaacatcaatcagcaacagccaagcttgaaacttgatatatattaagtactcagatattgtacttgcgatatgcacatatcttggatttacttcaaaagctattcctcatcacacatatgtaacaagaggcttccaaaattgagggtgggcgcctgagaggggtgtttctgttgctaagggcacacctcagtgtttcctgcagtgggatgctcagtgcgcctcagcagtgccatcactctttctgaagtgctgctgttcctaagcaactacaacagccaatcaagtcactgcacttagagccctgcctgccaatggagaacctgataagccccacccaaaaggcagagtaggaggagcagagcaaatgcctcaagtgataaagccaaaaacttcgttcactaacctcacaggaaaggtacttatcttagactctacaatgtccacagcacaaaatagccattcccacctataatttactcatggagttatccataactccatatgtaaattacatagtcataactgatagtaacatatactgccagttagttttaaaatgtatagcatattaaaaactcagtgggagactcacaatttatttcaaatgctttttattttcatcctactttgttcagaaaaggatttcaagtaagctacttgaatttcccctgtaaacttacagaatagtaaccttaaatacattctcacaatcagatgccatgtgcttcaggcaggttgagtaaaaaaaccactattcccatttacctgttgacatcacattgctgacaggcaaactccatgaatgtgttagagttgggcaagaggttatgcactgacacttcatccaccccacactgggtatctgcttcctcacagaggtggcagaaacaggacatggcaaccagaacagcttcagtgtcagggttctgcagaaacatgtacagggccacttctagactggtctgcgcttgtcggcaagtcggggggctccgctgcatcctgctgcactatcctgagagtcaagggtggtagacgtatatttgcaacttgggtagtttcatgtaaaaaacccaatgacgcaataaactgtgtatgcgtgtgtgtgtgtgtgtgtgtccatatatatctcagcatacaataactcgcaagagctttctcctttaatcattataggaatttttcaaaccccaaaatatcttgtccaaatgagaaatgagattttctggaccaacataaagctactatctgtccaatttcaaatcaaataggtatgatcctattccagattccagaaatataaactgattctaacatggatgggtaaaacaccataacataaatctactgcagtaatgatataatgtacttcccagtcaattacaaatgacaaaaacagaggaagtaacaggaaattctatctacttgctataggaaagtaataaaataagtacactgcggcactcattgaaacaagggcataaacaagaactaaatattgctgtagaagatagacttgattctgaattacctattccccaaacatgaaatggagaaaataattgacaaaataaatgcaaattctacaagtaaaacagacaataataaatagcatactgcttagatgtttttttctttaacaaggttatattaaaaattagggatgaaaaacattttggtttggaaaataaactcttctctaatgatctgatattttcacttgaaatatgatttatatttaaaggaaataatacacactaacgcaaatcacagaaacacttatctttaacatgaagcaaaatactttgtttttatccttttacatctgtacctttgttagctggtacaaattctatacttctatggtatgaatgggttttcatgaggtggaggttatcagatacagcttttaagtgtcaagtgctatatatacctttttttttttttttttttttgagacggagtctcgctctttcacccaggctggagtgcagtggcactatctcggctcactgcaagctctgcctcccgggttcactccattctcctgcctcagcctcctgagtagctgggactatgggcgcctgccaccgcgcccggctaattagacatttttttatttaacccttacaacaactctggagcaggaattattattgtccccattttaaaactgaggaattgaggaacaagggtgttaagaatttgcccaaagttccataaagagcagtgatagaactagagtctaagcagtttttcactattacactatattacctggatgaaatttaccaaagttcattcagaaaacaaatagagcacacgagatgatacaggaaaattacaaaagaagctgaccatagaggagttcccttttcccttctggagagaggctcaggagtatgcagtgacacttcaagacccacggacatttgactggtatttccactagaaggagtatcacatcctactccataaaaaaggagaaagtgacaggaatttctatctgcctgctagaaaaaagaaagaaataagctttactgatgcactgacaaccaagaggaataaacacttatatgggtggtcttcctgtttgagactctcctagaaaacctctcccctcaatctctatgccccatcttgaaggaaattcactagaaacccattagaacaaataatgttcacttaatgtctttaaaatttctttcagtttcaatcattctctaaataatcagaaacagtagattctacaaatataaattaagtctaacataaacataagtaaaacatcaacaatgtaaatccactgtatgaaaactataatttgatctcaatgacaaagattttttttccacaagattttatcctgtgccatgttggcataactagaaattgactctgagattaagttcttctggaccagtaattaaccctggtatatacaccaagtatgtcacaagagtgactgtgctgaccagggcactacgaattcattactggattcctcatactcatattctggagattataccataggcaagggcacgaaagtctgaagtctaatctctttccatatgtttggaataatgccaaattctgctatattaacacatcaaataagccagatgtgaataaatccacttcaccattagtctatttctaaacagagacaatttattaataacaagctgtataatattgaaaaggatatgagtttcatacatttaaggtttttcacagctatgcttctagtaccagataaaaactcattaaatcaagtattcctaaaactaggccataatagaattcctaaattgtttaactatagaaactatacgttaaaagaaatgtaagactcttttctatcctccacaacctcaccatgtttcaatagttcagaatcaaaaaatttcactccaccccaagaagtgttgtgaaattttcaagatgtgaaactcttattggaggaatagaaataaacctagattgaggaccctcaaccttttcccttttgcttcttgatagataattctctggactagtctagccacaacatctaggcctttacgatttctcagagctatgattctagaactggacaaaaaactcattaaatcaagtactcccaaatctatgccataatagaattcttagattaattatagaagctatatgttaaaataaattttatgtatgaattatatctatgtgtgaacttgagagtaaagatagaatatgctcctcaagctactttggttacggcagtcaccacttttcctaggcctgtcccatagacacctatttactcaactagaactagaattcatcaacagtgtggttttaaggccaaagtttcagaataatttttaaagtgctaatttgccagcccttgtcctctgcacatatgtatccttttgagaaccttggggggaaggaggagctgaaatagaaactaatttggctataaaacactttcttaatctctccccatcaccattccaaatattctcccattttttaaagatgtcattttgcttaccttattttaaagaagaaatttattcctgcaggtcaaaatttcctgcaaccacttgagaatttctgtgctactaagcatttgacgactagttaatttcttgcagatgtaaaaatacatttgtgagctgcagtaacataaagttcattgttactagcatcaataataacctaatgcagatataaccagacataagaatggcattctcccataatgaatacaagtttggagaagcttagttatgttaagcatgttagttgaatgacagggaaattaagaagaaagagaaatgttaagaaatggtaagggcaattaagaatctgatctaattatatcagtattcattatacattaggattcttagagacgtcttagttttcagttatgatcagaaaggatcagtaagtgctcttgagctaaaaattaccctcaaggtcttggtgtttcagtcaaaccaaatgaacttagtgtggtaattttgagacatttcataaaaaaacacttacacaaagcaagagctttggatctgcatgaattagtttcaccatggacaagagaagatacttacagctcctggtctccaggtctgtaggtttttctttaaatttaaggcttgttactttttctttaaatgtaagagtctaaaaaccaaacaaaaacatggtatcagacataagactcaggataatagctatccaaccttttaaaagaaatttattatgaaaaaactttgaaaaaagctattcttatactaccaaatgtgtggtataggtagaaacactcaatagtaagcataaggtcagtattattaagcttaaaaaaatggaaattgtttttgcatcatttatattactttttaatcaatctaataaaacaatgaaaatctattacaatactaaaagcttaatatcaggttgtaaaaaacctcctgtgtaaaaaacgattttccaaaatgtaaaaatataagggaaaagacatttggtctctagttctcacaaatctccacactgggtaactcattaacaaacattccccacacacatacacacaagtatttcacagactctacagtattgtccgttgtaagatgcagcattatttgatgtcccaaaaggaatgaaaacccgctgtcaattgtaagacaccatctaaaataagatacactcccaatttcagagaagagtaaaaataagtgcttcttagaattaatgaaatatattatctaggcaatctctgtatttactagtttaattgtaaaatttgctttttccttcgatggcactccatctctttcaagttacagaatgcacgcattttgcctgaagaacattcataaaacaggaagaattctgagaaaggtaaacttatggaaaacatgttttcattacagagacataggatgaattaaaataatcatagatgtttttcaaccaaaaatccaacaattatattctagatctagtatcacctattattataacatattttccttttcttctttaaaagaacacaaaactatctgattttgacatgaatgcctttatgtaaacatatatataacatagaaatagtagactgtgtaccaactctggacccataatacaaatgtccaagtaaacaggctgcctttcaaagttaaaaagcggacatgcatatctacaacacaaatgaaccgtcttcagtgtttaagtgaaacatgcatttgttattatacccaagaatactgaagggctgtagtcctcagaagggaagaatagctatttaaatgcacacgcttatactcaagaatgtcactacagaagagaaatagcaaaacttactaatagtttgcttttatatttataactgccccttaacccctaggcaaatgttttactaaatgatttaacaaattctggttttactgtttggtctctttcaactgtattttttcctcactctaagttgaggtgtttcaccttagatcaagctgaaactttggttaaacagatgtatttactttgacgtaactaagtgtaactatcaaacgactcttctctgatgcagccattgcacagaaacataagatcagggaacaagtagtaaatggcagaatttttccttatttaagaataatttccaaaaaagtaaatagagtcttatgccacataacaacatttcagtcaatgatagacaatatgtaacacagctgaaaaactcctatcgcctagtgacatagccatcataatgtccaagcacaatgcattactttttgtttgcagcgatgctggtgtaaacaaactttcacttctagtcatataaaacaagtatagcacattcaattatgtataatatacagtacttgataatgagaataaataactgttactggtttatgtatttactataatacactttttttctaagatggagtctcactctgttgcccaggctggagtgcagtggcgtgatctcggctcactgcaacctccgcctcctgggttcaagcaattctcctgcctcagcctcccgagtagctgggactacagctgcaagccactacgcctgacttatttttttgtatttttagtagagaagggcttttgccatgttggccaggctggtctcaactcctgacctcaggtgatccactcgccttggcctcccaaagtgctgagactacaggcgtcagccaccaggcccagtctactatggtatacattttattgttattttagagtatactcctacttaaagataaaaagttaactatgaaacacagcctcagaaggtccttcaggaggtactccagaaaaaggcattgttaccacaagagatgacagctggatccacacgttatttcccctaaaaaccttccaatgggagcagatgtggaggtggaagacagtaacactgatgatcttgaccccatgtaggcctaggctaatgtatatgtttgtgtcagtttttaacagagttttcaaactgaaaattaaaatagaacatttctgaaataaaaaaaaacttacaggctataaagaaatatttttatacagctagctgtacaatgtgttttaagctgttattacaagagtcaaaaagttaaaaaatttaaaagttcataaattttaaaagctacagaaaagttaattatcgaagaaaaaatattttttataaatttggtgtagcttaagggtacagtgtttataaagtctacagtatagatcctgagtatgagaaaaaaacaagtattaaaagaggcagcctgtgccctgcactcaggggcttccctagggggtgccccacttgcccaaagcagcgcagcctgaacccaaaactgtgagcagagaatcccatgtgtgtttgaagggtttcctatgtcctctgtgttctcctatagaaagcagcaggagcgtgtcgagcacacaccgatgctctaacaacaccctgagcacaccctcatgctgctgagactcacccagaccctggacaggccgtggtgagagcagcccaaggatcgtggctggggaccatgtctggcttcgtggaggaagtcacatggagtgccttctccaagaagacggccaacgccctgcaggcagcccgctccactttgcccgtatcagtctgtacaagtgcgggatttcatttggcagatccccaaggcaggagagaaaaggaggaaagctaacctaactccaggctctccatggacaccaacacctagaagtgtctgacaggaggcatgcgtccttggccccgatgaggctgcgggccatccctgcagtcctggctatgcagctgagaggcaggccttgtggatgctccgggcacaggtgttgagcaaggtggtaaccgagtgcttgtctgggagctgtggccgcttggaggtcacacagcggtgcactgacctgaggaaggggttggtgcctgcaacagaacagtgggcatgagcctggggcagccggcgctgcacccacgccctgcacacccgacagtgctctgggaagtggcagacccaggactggctgaagcaccaggaggagccctgcacgctgcctgcctggccatcggcctctcctcccagagcctcgtcagtgaagaactgaatctgaacgggatttggagcccaaggctttgcctctgacaaccttggggacccaaccctgtctctgctgtgtgccagctctgggctcagggacactgacccctgtcaacatgactctctttggagccacatcacccagatggggtcttgtgtgcccaagctactggtaggacctgtcagccccgctgagctccctagtggcctctgggagaagtggggtctgtccttgagccgtaggctttctcacccctcagccactgaacacagccaccctggacaactgacctgacacaagatgaaggggcaaagggacacagaagaagagcagagacccctatctctcaggtgaccactggaaaacccactgctgcccgcgtagggggagtcagaagaggggagggacgggcctgagctgggaggggctggagtgcacagaggctgtccctgcagcactggaagcctggtgttccagaatgaccactgcctgccctgggcccccagacagctcctctgggtctgcccactgtatagccactgccggtccatccacagtggactctgggtagggtagtgggtgggcacatggtggcacacttgggaggtccttgtcgtttgcaacacacaaggctgtacccgtgacccagacaagccctggcctgccccgcctcacagccctgctcccaaacaggactcttcacaccccgggaggttctggtgaggcttgcggcaaagcctggatgtctctctgactcttggatttccaaacctgaagccagagtgacctgcatagatgggtgcccagaggtcctgcctgccacctccctaaggccccaggcaagcagagccgcatctgtgttggggaggtgagggtgagtgggctccgggggtgggggcagaggcatggccagtctgtcctgggcccagtgtatgtgaagacagagcagacagcctgctggcacgtaaacacaggatggggtctgggcactgtaccctctggcttggacagcagagacctggggctgcggtcgggggttgctttcctgcaccagcctggccctcctggacactcgcccagcttgcagatcaggcagacagtgccattgttgctgcagtgagaagggtccaggtttatcatgcacttgggctccagcctggccaccaggccctggagcacgctggggatgctctgctgctcatcgtcctcaagcctgtgcttcagggtgcataccactggggccttggggaggcaccatggtgaccacactgggcacacatggcccagggccaggcagccaccctccgcgaagcccagcccagctggatgtacgtgatgggtgggctgtggatggcagtcatggttggaatgattgtgcggtacagggaatggttgaagagggtgagcggatgttggccaggatggcatccaggagcagctggcataggtactgctgtttggtcggtggcaccgggggcagtgggggagtgggctggagcaggatgggcacggtcagcagcccggaacctgagggttccccatgtagggggctttcccaccccaggcccgtcctcacagccagattcccgaggcctctctctcagcctccacccttgtgcagacaatgttggccgatcctgggtataatcaccacccccacagccttgtccgccccagagtccctgccccctctgggccgggtggcagaggcactgatgggggccgcagatagagagtgacttctcccacgttcccacccagcacagcaaacctggcctggaagaggcctggtgggcagggtctcaggtcaggcccagcccctacccggccaccctaaccttgaaggcccctcccagcagtggtcccaggagctcttgggggagccccaattctcccagggatgcccaggatcccacactcaccactgccatgtcagttttgagtttttttttttttttttgagatggagtctcattctgtcacccaggctggagtgcagtggcgccatctcggctcactgcaagctccacctcctgggttcacgccatcctcctacctcagcctcccaagtagctgggactacaggcacccgccaccacgcccggctaatttttttttttttgtatttttagtagagacggggtttcactgtgttagccaggatggtctcgatctcctgacctcgtgatccgcccgcctcggcctcccatcgtgctaggattacaggcatgagccaccacgcccagccaatatttttaaataaaaaattacaaagctgtttttcttaaaatgttacaataaaattgtatctgtgtgtaaaatatatctattttatgtgtacgtgtgtgtgtgtgtgtgtgtgagtgtgtgtgagagagagagagacagagagagacagagagagagagagttatgaattaggaagcatatgtaccaaaacattaggagtagttgagtaatgagattatgaatgatttgcactttcttctttataccttatcatcatctcaaaatttacaatcagaattcattataagctattgtttgtttatttatttatttatattcgcagtggtgtgatctcaactcactgtaaccttggcctcccagggtcaagcaatcctcccacctgagcctccggagtagctgggacaaatcaaagttaagttttcttcagtttaaaataacttgttataattatgttgtttagcctcatggtaactggaaaacaaaaatcaataatagacaccctaaaaatgaaaagcaagcaattaaaacacactaccagaaaaaattacctcactacaaatagacaggaaggaagggaaggaggaaagaaaagaaagaaagagatcagagagaagagaaagaggaaggaagggagaaagaacaaaagaaaaaagagggaatagcaaaaccaccagaaaacaagtaaaaaatggcagtagtatgtttttacccgttaataataaccttgaatataaatgaataaaattctccaattaagacagagtggctgaatggattaaaagacaagacccaattatatactgcctacaagaaactcagttcacctataaacatacatagactgaaagtgaagacatgataaatgatatcccataccagtggaaacaaaaaaagcaggagtagctctacttagattatatagactttcagtcaaaaaaagaaaaatatgaagataattatataatgagaaagaagtaaacagcagaacaattacaagtgcatatgcaaccagcactcaagcaactaaatacagtagcaaatattaacagatcttaaagcgtagactgcaatacagtaacagaatgcctcaatgctccgctataatcaacaccccactatcttcaacggacagatcatccagacaacaaaacatcatcagttaaactgtactctataccgaatagacctaacatttacacagctttccattccacaactgcgcaatgcacattccactgaatagcatacggattattctccacaacagactatgcgttaggccaaaaaacaagtcacaacacatttttaaaaactgaaatcatggccaggcgcggtggctcatgcctgtaatcccagcactttgagaggctggggtggggggcggatcacaaggtcaggagacagagatcatcctggctaacacagtgaaaccctgtctctactaaaaatacaaaaattagctgggcgtggcggtgtgcgcctgtagtcctagctgctggggaggctgaggcagtagaatgccgtgaacccgggaggtggagcttgcagtgagccaagatcgcgccactgcactccagcctgggcgacagagcaaggctctgtctcaaaaaaaaaacaaaaaaaaaaacaaaacctgaaatcatatcaagtatcttttctgaccacagtggaatagtactagaaatcaataacaggaggaaaaactgtacaaatatatggaaattaaaatacatgctcatgaacaaccaataaataaatgaaaaaaaagaaaattaaaaatttattgaaaaaataatagaaacacaacataacaaatcctgtgggatgcagcaaaagcagttgtaagaggaaaagggcatagctataaacacctacatcagagaagtagaaagatctcaaatagccaacctgacagtacacctgaagtagtgagaaaaatgagaaaaataaaatgctaaaattagtacaaaaatatcataaagattagagaagaaattttaaaaatagaaacaaaaaatacaaaaagtcaatggaacaaagagctggattttttagaaaaaaatcaaaactgacaagctttaactagactaaggaaaagaaaaagaaaaaatcatagatgaaaaatgagacattgcaagtgataacacagaaatatgaaggattgtaagagattactaaaaacacctatataaaaacaagttggaaaatctaggagaagtgataaatttctggacacataacaaattcccaagatagaatgataaacaaaaaaccggaacagatcaataatgagtaatataattaaagcagtaataaaaagtcttccgtcaaacaaaaacacaagaatcatggttttactgctgaattctaccaaacatttttaaaagagctaataccaattttactcaaaatattccccaaaaagtgaagagaaaggaagtcttcgaaacttgttctatgaggacagcatgatcctggtacaaaaaccagaccaggaaacaacacaaaaagaaagccacaggcattttaaatatccctgataaacacagatgcaaaaaaatcctcagcaaaatacttgaaaattgcacttgacaacacaataaaaagatgatctgccatgatcaagtgggattcatcccaggaatatgaggatgattcaataaaacacaaataaataaatgtacgacatcacattcagcgaatcaggaacaaaaaccatataatcatttcagtagatgctgaaaaaaataaaaatcaacattccttcatggcaaaaactgaacaacatgagtacagaaggaacatagcgcaataaaggccatatatgataaacccacagctaacatcataatcaatggggaaaggttaaaactcttcctctaaggcctggaacgagtgtggctacttttacaccacttttattcatcatagtactggaagtcctaggtagcgcaattagacaagagaatgcaataaaaggcatccaaattggaaaaaaggaagtcaaactgtctctgtttgcaggtgacatgatcatatatatatacatagagaaagagagaaccctaaagattccacaaaatcacctacaggaaataatttagtcaagttgcaagatacaatatcagcacacccatgcaccaatagtgaaatacctaagaaggaaatcaagaaagctatttcattaccaaaaaaattatatctagggataaacttaaccaaaaagacaaaagatcccacaatggaaactctaaaacacagatgaaagctattaaagcagacacaagtaaatggaaagatatcccatgtccatgcactagaagaatattgttaaaatgtctatatcacccaatgtgatctagagagtcaatgcaatccatgttaaattacaaaagacattcttcatagaaataggaaaaaaaaatcctaaaattcacatggaaacgcaaaatacctcagatagacaaaagaatctggaataaaaagaaaagctggaggcatcacacctgacttcaaaacatactacaaatctgtagtaagcatggtaataccaaaacagcataatactatcaaaaaaaggggcgggggagaaacagaaacgaaggaatgacagacatagacaagtgaaacagaatagagaaatcagaaataaattcacacatttatggcgtactcatttttaacaaaggcaccaagaacacacattcgggaaggacaatctcttcaataaactgctaggataactcaacacccacatgtgcaggaatacatctaggccgttatcttaccatatacaaaaatctgctcaaaataaagatttaaatgtaggacctgaaactataaaactactagagaagaaaacataggataaatgcttcatgaaactggttaggacaaggaattttcaaatagacatcaaaagcacaagcaacaaaagcaaagatgtaattacattaaacttgtcaaaagcacaagcaacaaaagcaaagatgtaattacataaaacttaaaagcttctgcaaagcacaggaagaaatcagtagaacgaagaaacaacccagagaatggaagaaagtatttgcaaactatgcatcagccaaggggctaatacacaaaatatataaataactactcaaaagcaaaaatacaaataatttgattaaaaaaaaatctaccccaaatctttgtctcccaccattattttcccaccttcttttcccgaccgcctttggcctcctccccctcgccacccgttttcttcctccatctaccccaaaactttttccccaccatttttccctaccgtcatttcgcaaagccttctctgctctctcactcaccacccttttccccatccacttacccactttccccactgttttttcccaccgtcttttccctttctccctggccaccttcttttcccccatcccactctcatcaccctcttttgctccttcatctaagcaaaaacattttctcccgtcttttcccaaacccttctcctcactcctgctgctcaccactttttcgcccttcatctacccgaaaactgttttcctcatcgtcttttcccccgctcctccttgccaccctctttcccttctctacccaaaaacatttccccatagtcttttcgcaaagccttctccccactcctgctcacctccccttttccccctccatccaccccccagaatattccctactgtcttttcacagtcttccccccttcccactcgtcctcttctttgccctatcctgcttgccactctcttttttgccttccatctaccccaaactattttcccattttttccccaactctctttccctgctccctctcgtcaccctctttcctcctcctcgttaccctctttccccccaccatctacccaaacactttttacccactgtcttttctttctccaccgtctttctttcctgcccactatctttttgcaaaaccttgtcttcctcccgctggctacccttttcccttcccccacctgttaccctcttttccccctctatctacccaaaaccttttctccccactgtcttttcacaaaaccttctctctctactgctcaacgctgtttctcccccccaccaccctctctttcctcctcccttgccaccctcttttcctcctccatctacccataaacattttacccaccatctttctgcaaaaccttccctccctgccgctccccaccccgtttttctccctccatctacccaaaaactttttttcccactatcttttccccaccgcctttttgcaacgcgctctcctgctcactatcctctcttccctttggcactaaccaccctctttaccccctccatctatcccaaaactcttttcctcctcttaccgcttccgccgcactgccgtctcggtcgcggttaccaccagtcgcagcgaggcgagccacggtgtagcggctccagcctccagcgtacggctggtgattacccattcctggtcctctaagccgggcactgagcagctccacaggaaaatacgggaacgtggaagagcctgacttcccttcagcagcaggcgtataccgcggttatatacaggaggattcctgactgcatgttctgattggatgagaaaaaccctccagggttacttggattggactttattatcatgttctgattggatgagagccagtcttaagacaaccaatcacagcatgaaaataaagtccaatcagagtaggcctagaggtttttctctcatccaatcagaacatgtagtctgggaaccacatgtgcgtaacctcagtacgtaaagcatgcggaggtggcgtcaggtcatttcaggctcttaagtgtgggcgtttggtaaccggcatggctgctacctgtttctggctggagcctcggacactggctcactgcagttggtggtgtccacagagcggtaggagggcaactagtagcgggagcttctcctgccaggcaggaagacgagtagaagggagcagcaccgacgcatgctggaggctggagcctgagcccctggggctcgccttgctgtgtttggtggtgacgtgggacactgcagctcggccagagtggtagaaatgtcctggtgtaggtgagttatccggggatgtactgcccgcctgtgggggcaggggttgggtgtcctattggggctcactgcccgaggctgcactgcctgtgtcagggggctggttgggggcactctccgaggttgcattgctggcggtggaggggggcggttttggctggctgtccggggctacactgcccgtggtggcgggggtggtgggggggaggcaggttgtgtgcactaacgtgtactgccggtggcgggggaggggttaggggcactattttctgctgcactgcccggggcagggagtggtttgggtggttatttggagctacaatgctggcagcggggggtggtttaggagtgttgtcgggtgctgcactgcccttactcagggtgcgctatcaggagctgcgctacctgtggtggggtgggggcggcgattttggggcactgtcttgtgcagcaacacctgtggctgggtcaggttgtgggcactatcgggtgctacactgcctgtggaaggggtggttgggggggggtattggggttacactgcctgcaactggcacagggtgtgttgggtgtgctgtccgggggctacactgccggcggcaggggtcaggttagggttgctatgggggctatactgccagtggtgttggtcggctgcagaggtggtggggacagcaacagccatggtctccttgctccttcgggtaactcttctcttttccagactccagagttcctgctcgtgcaatcttgagcagggcagggcccccacacccactgcggttctccggcctgcacctcccgcccacaccccatgctctgtgttggggagaccacctgggactaccgggtggggattagtgggcatcgcgggggactgtgggaacagggcactgtgggtggaggtgtcaggaacgggaaccagcagttgagtggggagggctggctgggtctgagtttctcctactcctgctccccaaggagtgcagccctggtgggcccagcaatttctggccagttgcacctggatgggggtggtttcagcataggcactcacacccgccccagttcctggccaccttttgccagaaagagaggctggacttcggtgggtgggtgtgagtgccttagctgaagctggtccctgccacccagtggccagcatgacaaggtgaggctctaacgttaccactccctgcatcccattctaggcttttctggctttgccggtctagctgctccaagccaggctggaggaggaggagaaggaatcacctgtggtacgctggagcctgcatgtggcgtgactctgcagctcgcctcgtgtgactgatggcagccacggagactgcagctcgacaggagtggtaggagggtgcccgcgggggcaaggtggtaggaaccttgtagggtgggctgctgcattgacggcgacagcaactgtattggcattggtgctagtggtggtagtggcagaaagtctggggactgggaagggggagtaggagcactgcagggcccagtccgacctggggtggggaggaacctgctggtgctgtaccatgggcctcggtggcagtggtggaggtgcacttagggaaaggagtcctcccccttctcttgcaatctctggagggtggcctccttctgagccaggcatgagtggcagcattgtctcattcttaacaaaatttagggggtgactgtgtgtgtgtgtgtgtgtggcttttttttttttttttttttttttttttgagacagagtctcgctcttttgcccaggctggagtgcagtggtgcgatctcggctcactgcaagctctgcttcctgggttcaccccatcctcctgcctcagcctccctagtagctgggactacaggcgcctgccaccacgcccagccaattttatttttgtatttttagtagagatggggtttcacagtgttggccaggatggtctagatcacctgacctcatgatccgcccaccttggcctcccaaagtgctaggattataggcgtgagccaccactcccggtcattttttccttcttttttgttgtgatggtcttggactttttcaaattttgtgaattggggaggggataaaaggtgtcataataggccttctaattcctgcacctgttctttttgctttttctagtctgtgtattcttctcatcttcttgttcctcttcattttcttttgctgctgcttctatttcatgtttctattcttgtttctcctcctctttttgttttctttatgccaagcaatggccttaacaaacaacaagccaaaattgtcactgtgttgtatttttaaaataactggtcctttactatgttttagggatgaggaaaaaaatcagttgtataattagttacttgaatagctatgctttcatgattgtgttaaaccacttatgcctagtgttccattattggaatggtaagcatgagggagttaattacatcctactgctcaaggtcattagaaggtttgatttttcactcgtgcaaaaattcaaaaaattgcagcctctggcataaatgggctaatgcgttataagtagttattcagagaatcaaaaaatgaagcatcacataaaaatattggtggcaaacagccatttcatctctctcacatatttggagctatgcaggagtcacggggtaagttctaatttatgagattattaagtgaactgtattgccttcattttctctgccaccatttcctttgttttctttctttttttttttgagatggagttttgctcttgttgcccaggctggagtgcaatggggcgatctcggctcactgcaacctccgcttcctgggttcaagcaagtctcctgcctcagcctcccgagtaactgggattgcaggcatgtgccaccatgcccagctaactttgtgtttttaatagagatgggttttctctatgttggtcaggctggtcttgaactcccgacttcaagtgatccacctgtctcagcttcccaaagtgctgggattggaggtgtgagccaccacgcctggctctctgccaccattttcaagagtattgccatctgcctgagcaaacctggttcatcaccacctctttgcaagagaaaaaggaagtcgggagaattgtgtgtaatttttttttttttgagatgaagtctcgctcttgtcccccaggctgtagtacgatggcccgatcttggctcactgcaacccctgcctcctgggtgaaagcagttctcctgccttggccccctgagtagctgggattataggtgcctgccaccacgcccggctaatttttgtatttttagtagagatggggtttcaccatgttggccaggctggcctagaacacctgacctcaggtgatccacccacctcggtcggctgtgtgtattttaaggcaaagattcacaaccaaaaacaaggctttattaacttttgtatctaagaacctgcagtgtcgagccctcttttattcctagtattactactttaggtgtgaactttttatctttattttactgattcctctagaagtttatgcattttcttgactgctttaaagacaatctatattgtatcatttttcaagcccgtagaaatgtgtaaggcctataatttgaacacttgttatttttaaggttatgagcatgtaatataccattgatacatggaagaatatgtataaataccactagataggttatattgaagagataatatctaaatttttgtccagagttgatggggtgcagttttgtaggtgtgtttctcaatacattgtgtccatgttttaaagcatatagaaatttgaatactgtttaacctcatatagtccttgtttataggtttaatatttctaaagactaaagacgtcacagctccctttaagattcagtaatactaataaaatttgagatatacagggttagagtccaacaaattcaaaggaaaattgttgaattatatagccgtagagcaggaatgaaacccaggttctaagttccaagggggccatgagctaccatacaggtgcatcagtgactgggcatagagttggcaaaattatttaagagagtgagctgtggatcctaattatgtgaacatgaatttttgaactgcatggtgcctcagtttatccatcattacagtggggacagtagtaagtttttctttttctgctcagttgtctgaattattaccccagtctctcttgttgccactcttgatgcccacatgagaggatctaaggtaatttctgacaacctgggactccttaaggaaaaacagaaggttccacaaaccccattttaggagaaacctctgttttcctcatggaaccccaagaactttaagcagacaggtccctctcaaaaatctaaggctctcctctgttttgccttgcgttgtctgacctttttggtttggatgggcatcagaaattagtaggggagagagatctaaagaaaattgtggatatgaagatgtatttattataagaaatgttatgaaggaaagaaatgttatatgagagaggatcttatatggcaaattgttgtcctaaagtagaatgactaattacaaaagagggaaatacaggacaggtcagataaatttaatcatgtcgtagatagtctgtggaagttgtgttatggttcataaagtgggaaagaaaaactgaacaactgctagatcttttcttgtctagaagtgttgtgtatgtgatgtatatataatggctcggcttaaaagaaaatgaaagctcttaaatattttgtaagaaaaatagaagctctaatgccttttatttcatgtgacttcagtaatctttgggaaataaagatggtgttaaagtcagtggtaaaataaaaatatcttcaaaatttatccatttggtctaatttaagtcagaggttaagttttagaagtgctttaatgtcataaattgatgctttgactttggaaaatagttttgtttacctggtttggagccgttagatttctaggtaaggtctccggacaggtggagttagccatgtctcctagctatgctggaaggagtcagattttatctgcagttctgtcttgtatcctagactctgcacctggtatgcaattaaaacttactgctgctgctaatctctgggttccatttaaaatccttccatcacatgaatactatcccctgtactaaatttttccacaattaaatacttagaatcatttttgctgacttgacccaaccattagtgatatattttaaaaatgcttataatgtgtcacaatatatttagcaaatgtagggaatgacatttttactttcttcagcatttacatagcatttatgtagcaatgctatctcaagtatttttaatcatttaaacgttagataatagatatgtttttgattccttttttctatgtaaataaatataattatgagatatttagtaaatagtatcaattgcatatgtcacttacagaatatacaatgcaattaggattatttttatacactacatcatatttacttgttggctttacaataacttagaaatagtattctggattaactgtgtgactcatgagagagggagtttgtgcaattatagtctttacaaatttttactagatttttcaagacttacgctagaactttgagaacaaggtaataaataagcatatctgttaatatcacctttggtcaactcttggctagacccaatgataatgtaggaattaacataatttttctactaaaggtgttggatttgttccgagagaccacagttcaaagtcattgacaaagaaagtttaaaaattgttagattaaaaccttttagtgtgtttgaaattgttttgtagaaaaatatcctggtttgcattgataggtttttttttaaataacaactagaccaagagaaagggagagtagtgataaatgtccatgttttcgagttgaaaagtaacaatcagtgtattacaacagatggatttgatgtcaaattacaaatgctgagaacgttatatgtaactgacttgccagagtaattatacaaggcaaagaaaggaaaggcatctaaataggaagggaaggggtgagattgtctgtgttttagactccacaaaaaacccattacagctgataaacactatattcaataaagttgagagttacaaaattaacattggtttccatacaccaatgacaaactgttatctgaaaaataaggtaattccatttataatagcaacaaaacaaatatataagtaaatcaaagagcaaggagtaattttaatgaaggatgtgaacgatttgtatactgaaaattatagcacattgatgaaagaaattgaaagtgacaaatagaaaaagtcctatatttgtcaactgaaaaaattaatattgtcaaaatttcaatgctactcaaagcattctacagattaaatgcaaccgctgtcaaattccaatgtcattcttcacagaaatagaaaaattagtcctaaaatctgaatggaaccacaaaagatgctgaaaaaccaaagcaatctttagcaaaaagaacaaacctggaggcatcagactacctaatctttgacaaagcaaacaagaaaatgggaaaggacaccctattcaacatatgctgctggtataattggcaagccacatgcagaaaaatgaagccgttcttcaaaggttaaatacagaattaccacatgactcagtaaattcactcctatgtatacaccaaaaataaattaaaacaaatgccttacacataaaggtatttatagcaacaaaaagtaggaaacaacagaaatgtccatgaattttggagtggattaataaaatgtggtctgtccataaaataaaatattacttggcaatgaaaaagaaaaacatattaatacatgctccaaaaaggatgaacattgaaaacatgataaatgaaagtagtaagtcacacgtaactatattattatgattccacttacatgaaatgtccagaataggcaaatccttccagaataggcaaattcttaggaagtagatggatgattgcctagggctgggagaggtttaaaggaagaatggggaaaatagggaaagattgctaatgggtgcaaagtttcttttaaggagcataaaaatgttctaaaatcgtggtgattgtttaactagttaatacacttaaaaaactgaattttatactttaaatgagtgaattaaataatatataaattgtatctcaatgaacctgtgaaaaaagttaaaaaatatgtggtatgcataaacaaaaagttcttcattttatttcctagggttttggggaaaaggtggtgtttgattatatgagtaagttctttagaggtgattcaggagattttggtgcacccaacacctgtgcagtatacactgtatacactgcaccggggcaggagctggctgcaatcctgtggccccaaatgcccccttgctgatggcctcgtgttctgggtgcggagcaaagaggagcaggtgttgaaggcacctcaggcaggccctgggctcggtgggcgtcttgtgctccgcgattttgaggccatttgcagccagctccgtcagcccgagctcccagctgcagctgctgccatgcacaacagcaccgccaggagtgtcctgggggcttttttcaaaggaggctgtcagcatcctcaagttccagacgcttagccccagtcctcctttaagaggcttttttttttttcaccagaggcttctcagtggcttgaaagctcagctgactcccacgaagtttgccggaactcaaggctgtcagtgacattcgtggcgccaagacttaagcaggcgcgttgcatgcatcggccagtgtctgtgccacgtgccctgacgccacctgagataagcacgccgcacgccgcacgccgcacgcgcacgccgcacgcgcacgcgcacgcccggcagcagcttgctggcttgtaacggcttgcacgcgcacgccgcacgcgcataacggtttggccggcctgtaacggcttgcacgcgcacgccgcacgcgcgtaacggcttggctggcctgtaatggcttgcacgcgcatgctgcacgcgctttaacggcttggctggcctgtagcggcttggcttggctttgcgttcttggcttggcttggcgttggtagcttggattgacgtttcctgcttggattgacgttttctctctcgtgttcctttgctgggcttgaccttttctctgctgggtttggcattcccttgggtgggctgggtgttttcttgggggcgggggttggccctttctggggttggccctttctggggtgggcgtggggtcgcccagggggggcgtgggctttcctcgggtgggtgtgggttttccctgggtggggtgggctgggctggaatcccctgctggggttggcaggttttggctgggattgacatttctcttcaaacagattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggtaaccaggcctgggctgggaggaggtgggacgtggggggatgatggggacataccctcctggcgggggaggagggggacctggctttctcgcctccgcaggcctcacaccaccctggatgtggaaacctcagagaggtcagggtacagggccctttatgaacagcaacacaaaaacaaaactttagctgatttccaatcataatttccctcatagaacactaatagactgttttaaagtgatttaacttgcaaaattaattaagtcaatgcagcagattatttttaatctacagattttaaaacaatgttctatacattatagaaaagtgtatattgagaactaagaacaaagccccataacacatcaacttcagggctaaatattcttcaaataaaatccagtatggattttatatcaatgtacagtatgtaaatatgttctttactgaggaaccttagaaggaaactgaaatgggaagatggttcctgtgcttgaacaggaagattgaattttcttaagatgtgagctttttggctgggcgcggtggctcacgcctgtaatcccagcactttgggaggcgggcggatcacgaggtcaggagatcgagaccatcctggctaacacggtgaaaccccgtctctactaaaaaatataaaaaaaattagctgggtgcggtcgtagacgcctgtagtcccagctactcaggaggctgaggcaggagaatggcgtgaacccgggaggtggagcttgcagtgagcagagatagtgccaccgcactccagcctgggcgacagagcgagactccctttcaaaaaaaaaaaaaaaagatgggagctttttctatttatcacttttacctaagccaaataaaaatagcaaagttttagcgtttttaaattacacatgctgtcttttattattgtgataaattaattttttgtaacagaatggaaaaagtctgcttttccagatatcaaaatgtgcatgttatttatttccacaaattgtttactaacagctgaaaagacatcaatgaatacaacagaataggaaatttagaaatacccaaatatatgttaagaatttagcgcttgataatggtggtgttttttattatttgaaaaagatggattgttcataattcatgtttggagaaaactagctagatttttatgtcacaaaaataagagtatagattaaaaattttaaatatacaaaaagagaaacataccagaagagaaacatacaaatgcctatttatatatgcagatatatatttatatatatacttttttttggatggagtctgactctgctgccccggctggagtgcagtagtgcgatctcggctcactgcaacctctgcctcctaggttcaagcaattctctgcttcagcctactgagtagctgggattacaggcgcctgccaccacgcctggctaattgctttgtatttttagtagagatggggtttcaccatcttggccaggcaggtcttgaactcctgtcctcgtgatccacccaccttggcttccccaagtgctggggttacaggcgtgagccactgtgcctggcctatatttgcagacataataaaataagctcattttaaaattgggcaaagtactttttttgcatatctaccagtgacctatgcacataggaaaagatagcgttcctggtagaagaaggaatgtaagttagaagaggaatgaaatactgttttctatttaagttagaagaggaatgaaaggccgggtacagtggcttacgcccgttaccccagcactttaggaggctgaggcaggtggatcatgaagtcaggagtttgagaccagcctggccagtgtggtgaaatcccatctctactaaaaatacaaaaaattagttgggcatggtggcacacacctgtaatcccagctactcaggaggctgaagcaagagaattgcttgaaccagggaggtggaggttgcagtgagccgagatcgcgccactacattccagcctgggtgatagagtgagactccatctcaaaaaaaaaaaaagaaaaaaaaaaaggaatgaaatactgttttctgtccacaaagtttgtgaggatgaagaacagtggtacttacgtagtcatttaaagtttaaattgctacagcttttcaaacaaacactttagtggtaagaaccacattttaaaaatgttatgctttttactcatcaattccattatactgaaatatctttaccaaatagatgtctgtttttcttagtattgattaaaatagcagtgtatttagaagaacccatataaagatttcatggacaaatttcagtgcatccataggatggactaatatgtaactattgaggttgtcagtagatacagagatatgtcgacatgcaaagatgtactttgctataacaagtgagaaaaaaatcagttggttacacatatacacgaacagaatctgctcgtgttagctgaaaacatgtagaaaatataatcaaacttgtttctggggatttgtaagtgaagtttttccctttctcttatctgtgatttctgcaatgaacatctgaagttttagttaaagttcattagtaatgcaataatccttgggaagagaaggaatatgcttcttgcatagatgcaaataatttgtcacattctattatttatttttctatctgtggttggctatcttctgtgaacttttaccctcttcagaagtagagggattgtgtttacctgttcctgtagattttattgtatatacattttattacataattatcttttcattagatatagattaacatgtaaaaagtatgaattaatcattttagttgagttgtatgtttatgaaaattaaaatagcaaatgtaagtgattattactattgcaaatgtattgcattactcgacaggagttttctttgaaaatactgaactcccaagctgtgttcatccattctttcaatccatttagtcatcagacataagccagacacctattatgtggcaggcatattctactatctctcaggatccttccacctttgaaaacttcatgtttatctgctgggcttgagcaagctgagagatttaaaattggtgcattaggacttaatctcaattgaagcttttcctccctcctttcaaacagaagcatttctgaaggtagaaaatagtaaaagacaacccttaactgcccttttgaaaatttataagtcttggagaaagactgttttagttgttttaagaactaaaatgtggtacataaacagcatggaatactatgcagccataaaagaaggaacgagagcatgtcctttgcagggacatggatggtgttgaaagccattatccttagcaaactaacaaaggaagagaaaaccaaatactgcatgttcttacttataggtgggagctaaatggtgagaacacacagatacctagagggaagcagcacacactggggcctattacagggtgaagggtgggaggagggaaggaagcaggaaatagaatgaatgggtactgggcttaacacctgagtaatgaaataatctgtacaaccaacccccttggtgcacgtgtttacctgtgtaacaaacctgcacatctggcacgtgtacccctgaatgtaacagttgaaaaaagctccacaaatcgtttcataaatccgttttaaaaggagaaaatttataacagtcttaaatcctaatatgaatgattggaaatatctgatgtagatatattgtataaatctaagtattgaaaaaaatgagcccatgctattcatttgaattccaggttttctttggcttaaagtttattgaaaaccaaagtaagaattggtttattttagaaatttgtttttgttttcacctcagctttcttattccatagttcttttaagaactaaaatttatctaaatgctggtcatctgactggaaccgccccggacctgttataacatattctacttcatgtaagacaccagggattgtgtgatgccccattattttatgcctcaataagagaattatttaaatgccgcaaattatagtaaatcatgaattgtaagtggtatttcagtggagacaacatggagacaatgatcatctcagaatcactaaaatacaatgttagctgtaatatttaaaacacacctgaaagtgtaggtataattgtatcatctcagttcaaatgttgtctttagtggtattagtaaaaattaaaatatctaacaattattgagctgttatttgtgttaggaactattctatatctttggtgcagagtctcatttaagcattagagtggtttcctgtgagaaagctactattttcattcctattttattgatgaggaaactgagaccccaaaaggctaagcaacagccaggaagtgacagagcttcaagtaggattccagcccacgttgaatgtcatccaagggctatgctctttatatttatataggctgccctttcattaatacagcgagcaatgagagataataaatagtgtgcttttttcatgggaaagttaaatgtttgttttgaaggcagagtaatagcaggctattcagtgtttgcagttacatgaatcattgctatggctgtagctagtgcactacaatttcctaaaaagtcttgtcactctcataggactgctctacatctggcctctgccaatgggaattcagaagtagtaaaactcctgctggacagacgatgtcaacttaatgtccttgacaacaaaaagaggacagctctgataaaggtatgcagtagccaactatatcagcatgaggtgggtttgatttcaatacatagcataaaaatgagttttctcctttaaatataactagttggtgaaagctgtggaatgttattttgaattcctaagatttgtaatttgtttttggtctaatactgacaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaaggtatagatctaccaattttatcttcaaaatactgaaatgcattcattttaacattgacctgtgtaagggccagtcttccatatttggaagctcaagcataacctgaatgaaaatattttgaaatgacctaattatctaagacttcattttaaatattgttactttcaaagaagcattagagggtacagttttttttttttaatgcacttgtggtaaatactttttttgaaaacactgaatttgtaaaagataatacttactatttttcaatttttccctcctaggatgttttttccctattgaatgtaaaatggcaaaatttgccctgaaataggttttacatgaaaactccaagaaaagttaaacatgtttcagtgaatagagatcctgctcctttggcaagttcctaaaaaacagtaatagatacgaggtgatgcgcctctcactggcaaggcttaagatatttctgattgctcatgagccagaagtggaaagcaaaaaagagagcaatcagaaatatcaaggccaatttggaaattagataatggagggaaaagaccatgaagaggttgtgtgtgtgtgtgttgttgttgttgactgatttgtttcctttgcatggtgagacaaggttctcttcaattttagagaatgacagttttcagtttgggagagggagttagtgggttgtaaactacctagagatcaattttaggaggcctctgaggaaccagattggcagtgaataggtggtaatgtaagaggaaacccttgagcagagggaatatcaagtaattaactgacttagtatcctattctggtagaaatggccaattagagtctcagctctgctttcaaatctagagtgtctggatgggaagggggaagataaacaagtaacaagatcaagttggattttgagttgactagaccctgttcttctcttaccggggaaaatcatgtggtgttttcagcaaatgggcctctctcctactccttactctttttggccaaatcttcaaatgagaaagggaattggtcatgtgggtgagaaatgagactgaagtaattgtctgttgcactagctttcagctagaattgtgcatcccagtaacctgaggaaaatgtttaaataatcaacaagtctaggctttttctgaatattttgatacagtaagtctaataaagcctggatatgtatatttgaaaatgtttccttgaagccaggcatggtggtacatggctgtagtcccagctgctagggaggctgaggtgggaggattgcttgagctcaggagttcgagtctagcctggtcaacataatgagaccctgtctctaacaacaacaacaacaacgacaacaacaacaattttctcaaaatctggatacactcctgcttaagaaccactcaatacttaaatgtaatatgtaaattcttatgtctcagaaacttaaggtatctctagaagagttggggttggatatgtgctgatttctttaaatctttccaataacattaatctgactttttttttttttttttgagatggggtctcactctgtttcccaggctggaatgcagtggtgtgatcacagctcactgcagcctcgacctctccaagctcagatggtcctccaacctcagtttttttttttttttttcagtagagatgaggtttttgccatgtttctcaggctggtcttgaactcctgggctcaagcgattcacccacctcagcctccccaaatgctaggattacaggtgtgagccaccattcctgacctagtctgacttttatctgtgactgagacattaaaatgaatattattggtagtatgtatcagcttacagaataagaccttttccttcctaccatcagttattcactgctgttcagaaggtctttagaaatttgctgtgagtagtctttcaataagtagaggatggccctctcaggattttgtgtctctttgttcagtcattcaagtgcttaggtcagtaagtcgttaagagcagagttttctcaattagaattgtagcaaattctaaaccactttttgtcaattgacgctgtattatggactatccagtgtgtctcttaagtatgtagagctttggcataatcagcatggcagttttaaacactaaaaaccatggagttattaagaatacagataggaattctgttaatttagtttcagtagtcctatgaactgatggtttagttaacaatctgggaaaattaaatacaaatagattttaaataaataaatgttggaaaattttttcaaatgggcagtatgagttttaatagcaatttttgttgcatgttggaggttgaacttttggtaaaacatgaaactaaagaaatattttacatgcagattcttgctttatacacaatttgtcttagggttgaggatatagagacaaaagatacagcccctgccctcaagaagctttttgtttagatgggaaaaatattatcatccaataacaccatgccaaatgctggtttagaagcaaagagccttggaagcagtaaatgtttaaagtgagtttttgagatgattagagttactgtggtgaggcagagaaggggtgtttccaagggaaggagcagcgtgtgggaaagcacagaagagtgagaaggaagcgagtacattttatttactttctatgcgtgtaagtccataagatcttacataaagtttccactttggttgaggaatatgtacttttttgaattacataggtttttgctttatattgttttacagcatggcctcacaccactgttacttggtgtacatgagcaaaaacagcaagtcgtgaaatttttaatcaagaaaaaagcgaatttaaatgcactggatagatatggaaggtatagttctttcttttaatctgtgtgttctagatggacagcagtcactcaagtcataaatattaaattaataagattaatgtatacttactgggatgtagtgatcagtatcaacacaaatcagttaggtagaaaaacaattacttgggctgggcaacataaagaacagttttagtaggattcatcttctcttattatattgactgatgttatttgttatgtgacatttttggttacatgatcttatgttagcttaaaggatttcatattaattttatgaagtttgaactttaacttttagtttactttatgactcagtattgaacttcttaaccctttctaatagtttttaacctgtgtcttacatgcttttccattaaatctgctgtattaaacataaataggggttgaaaatccttttgtctttttaatgactttgctttaagttgctttctttgaagaatattagtgttagcttatccctacatgacaattaattgctgttcccacatactgtgggttcaacagcttttttccttttgtttttccagtgtgttttgatgtttttatttttaattggtatggagagagggagtgaagatagttttaagtggatacacttttcctttaatgaagacaagccgtacgtgggtgataaagagaaaagagctaggctttggattcacacaagactgggtttaattagtaactttcttacttgctaggtgtgtgaccttggggacgttatttaccaccaaatatgttgtcatatatgaaaagtaggagaatatatccttcaaagttggctgtgcataagtaagaaagatacatgtggcatttaattcagtgcctagcacatggttattggcaccattaactgaaactcctatgactactattcttaccattattattactgctttgagcatgcagagagctcttatttctcttaccccctagctgattttctattacagcatgtcagtctagggaagctgtgacaaaatcttcacttaaatctttgtccacctcagataagtggccctaacattgtttcttgcccatcaaaggactttaaattagtagcttctgctatgcaataccccactgagataagagggttttttttggtcccttccttttaaccttggtggcattttacaaagatgaacacttgagcactcaagatgcttatgtcttttagtgcatgtaaatgtttgattctgcacagacaggcaagatgttacattggtaaagtatatcaaattagctttaaaaataactttattacagttcctatctctgtcattttaggactgctctcatacttgctgtatgttgtggatcagcaagtatagtcagccttctacttgagcaaaatattgatgtatcttctcaagatctatctggacagacggccagagagtatgctgtttctagtcatcatcatgtgtaagtgtttacattaaaaggctagttaatgctgaattgaggtttaaaataattataacagttgcatctcacatatcaggtgagatgtcatagtttggttcaggtagttttcgcgtggcagtgagttagtcccctgcatcagccagaaatcagacaaaaagcaagacaagttagaagtaccaatgggtgcgggattctttatctcaggacttttaagatctttatccttagagatcccagcattgttcatttgatccaagtgtaacacctatgcagggataaaaaatagtgtcacatctttaatttttctgattagttatttgggtcttgaaatgtctagtttagcggaaagtcttgtactgtcttctggggactatgtcctacatactccttgaatttttcaagaaccgaaggagttcactaaatccaaggaagacagtcccttttatcaagtcagaaggaggaggaaaaaagacattgcaatcattctgttgtttccgttgattttgttgctgctttgtggccactcaaactggtcctgctgccttaagatgaatcagtagattcagatccctcaagtcttcatggcgattcatacagtgactttgatgttttttaattcccatacctatgcttatatgctcagccattgttcccagagcaccagccccctgctctggccgctgggcatcttgactttatccgcacacaaagtgaccaaattgacccttccccacatattcagaacctaatgtggaacccacatcttagccaggaattagctgagaccttcatggtaagagatcctttgaggctgttgttggtcttttctctggcagatgttaggtgggcttgttctaaagggtgagaggggttcaaataatgtggcagaaagaggtcagtgtttgtttcctctttgctaccagatctgtactgtgaggcacctttatatcctgtatagaacccagtagaaagtcccatatgaaccttgccctgagcagtggctcccagctgtggttggccccttgagtgatctgatttacatgataatgaaaattgtcggagctacttccatctctagctcaagattttaagatattttcaaactctagctcacaggaagccattgaagagaattctcagaatctcaagtaggttagttggacttcacagagccaagccttgtccatgacgcatcactaatcatgtgtaaaagtagggctttgtgcttgcttcggcggcacatatcctaaaattggaacaatacggggaaagttagcatggcttctgcataaggaggcagcacagatctttgaagcattccatattttgtgcagtcactggaaggtcatttgactatttgctgactagctctgaggaaatagtgtgaatcaaagcaaaatgggtgccacccaaatattgaaattgtgatttgtgctgcaaaaatagtcatgtaagatggtctatgagatgacttagacctgaataacatgttcggtgcaaaatatattgttagtatgtatgtcgaaaattacagaatgtcagcttgctacttctctgtggaaactaaaaaaaaataaaagtagacttttggtctcccatgtcagctggaattgaacatcaatataaagcattatcctaacagacatctactggctgagagtttgagtctgtagagaaggatcgttggtccaagtcaggtcttaacatccattggtttttctgcccttggtgtgattgatcaactccgtaatagtggacaatcacattatctactttaatgagatatttatgaataaatttagttacaaactatgacatagttgagatgccctgaattataagccataaagagtaggacaactaagaagcaaaattaggacttaataacattttctgaaaactacaacatttgtatattagaacctatgaacaaaatatgcattgggttttatttgggattccaagataattttagtcataaagtttaggaacagattattccattgctttactatttctctgagcatttaaaaaatgttatctcgttaaacctttataacaacctagtgaaataaggcagcaaagtcctcactttgttgaagaagacattgagcctaagagaagcaagttgtccaagaacaaatagctgttcattatggagctaggacttatttagagttgggacactttctattatgtcatgctaatgctagctaatttactgggtcacagtgccctcgatttatgactatttcaccttacatttttttcttctttaattagaagcttaaagagaagtttgtagaatgtattcataagtggatgggataatactattaagttctgttattctgatattgtttgaaatactcttaataattctacatttggtaagttttttttatatcagtattaaaatagtaatttggtttattacatttttatacatagaatttgccagttactttctgactacaaagaaaaacagatgctaaaaatctcttctgaaaacagcaatccaggtaagacttgtgatagtgaattactttagtcagttgtccccaacctttttgacaccagggaccggttttgtggaagacaatttttccatgggctgggggagggtggggatggtttcaggattattcaatcatgttacatttattgtgctactttatattattatcacattgtaatatataatgaaataattatacaacttaccataatgtagaatccgtggaagctctgaacttatttttctgcaactggatggtctcatctgggggcaaagtgagacagtgacagatcatcaggcattagattctcatacgaagcacacaacctagatccctcagatgggcagttcacaacagggttcatgctccaatgagtatctagtgctatcactgatctgactggaggcagagtacaggcggtaatatgagccataaggagtggctgtaaatacagatgaagcttccctggcttgcctgctgctcacctcctcctgtgtggtgtggttcataatagtccatggactggtatgagtctgtggcctgggagttgaggacccctgctttgcgtggtcctaccatagataaaaaagtaaaagtaaggaatttttgatcacaaaagaacactgaagcacaagtcatgttacatatgcttgtcccaataaggtctcactattactgacttcattcctcctcatttgaagttggaaagagatatatttactttgttggaacaagatgtgttcttctacctgctggttaattgtcatcataacagtaattttgttagaacaagatgctctgctaccatttgccaaaagattgtcataataaatatacaaattgcccaactctaggctcagcagattataataaaagcagaaaaacgtttcacactaacaaaaacgctagtatgctacctggttgtggacacctaatacatttatagtccaaactgtatgaggacacctttaatttagccatctatttatcaaagagcttttgtaagttaggttttataagttgcaggagacaaagatggaatagatgtagttttgatctttaaggtgctcataatagagctgtctccatttcatttctgtggtttttcaacagaatttacaaagaaaacatttctatttatgttttcacttgtccacttaacatataactatcaaatgtcttttagatagtaaccatttttctaatgctatagaccacaaacaattaaaaatacagacaggagctttttgttatcattgtcattttcattattttactactttattcagtgcttactgtgtgctagatgcccactggaagcttataattatgatttattatatattgattatgtgccagacatatgtgatgaggaatgaaagttttgggaaaaagtaggtatgatttaaggtaagcatgcagagagagaagaatttttctaggtaaagaagcagaagaagaatgtttggcagaaggaacatgcagcgaggtcgtgtgtttgccagaaggaacatctaatgagattgcctgtttgggaggaagagcagcaagtgcaaaagacaagatgcttgagtgaacatggcagggtttctgagcagttcacttttgctagtaccaaaagtgtgtgatacgagaggttgggaatgaggtgaatacttagctaaggcaagtttatgatagactttttaatactatagaaatgagtaggtcttatcctgtgtgccatgggaaatttaccgggtagaatgctttggactgcaaatactagatgaacagtggctaaaacagtaggaaccagagttgttttggttgttcattgatatcctaggatcccacttttccctctttcagctgtgctgttgacagtgttttattcacgtctcccttcatggttggctaatccgcagcagctccaaacatcttgttctcacaacacaacatcgcaagggctgcttttcttcacatgtgtcttttaaacagggagaaaacttagaagcatgcaaagggcttcctgtaacatttcactggctgggtcacaccacatgctcattcccaaaccaggcactgggaaggtaaatacctgattagcttagaataatcatttctgtttctgaggctgaggagggggattgggataataaatatcccaatagacttggatttcttcttcaagaaagaataaggaatggctattgatagggagccaacaatgtgtgctgcaggggctcattggagaaatttgagcaggggagtcataagattaaatctgagtattaaggcattctggttatggtgtaaaacgggttagcaagctttttctgtaaatggccagttgggcaatattttagactatgtggtctctgtcatatctacttaaccctgctgttgtctgctgttgtagtgtgaaagccaccatgattatatgtaagcaaacaggcatgactgagctcctataaaactttatttacaaaaccataatgcagattggatttggcctgtggcctatagtttgctgggattgatggaaggttctttaccctgtaaagaaaccaggagacaaaggaagttttcgcagtagtcagttatagtttccttgtcatacatccttggagtagcatcaatgtattacaaggttttcacccgtccttagtgaaatacataaagttaggaatctcaactacttgttttaatatgttggccttttttttttggtgttatgcttttttcatttgttttgcttaatttttttcatgtaagaaataacattaatagttggcaggcttttttttaaataaaagccattttgtaaatgtttgtgttcccagtggcagtgggaatataaagcagaggcagaagagcggtatcgtcaatatgatttagtgataattgaatgagaaaggcttgggggacagagagaaatgtcagataatttccaggtttccaggttgtacagtagtatttaacctggatgtgaggacgaaggaggaaattttctggtgaatacagaagagcaaagagcagcaggtcagcaggaatgactaatgtttttctatgcacgtttaatggaaaattcatgtaggatattttgagtaggtaattggataaccagcatttataactcgcatcctactagtttgactctcactaataagacttgtcaaagatccaagaatctgaaagttgatgataaatgtccatgtgtatcaccatcaatgatcaaaagttagcatccacaacatagaatgggacagatgaacttaatggataaagatgaatatcggagttgttccttttagggaatgatactctccatgacctgtgtgagtcacagctgccagaaaagagcgagcaaggagcatatgaaggcagcacagcaaattcagtcctagagtgccctgcttgacttcatgtcatagttctgacttctaaaaaatcattttctgcaaaatacactttgattttttccccgcttgcagcctgcaaccaaacagaatccctttagcagggcatttttgtgttcttcctttaaacaaagcaatatataaataacaaaatgaaaaaagagaaagagtgttttttgtataggctagtatttaacataaacttgagagtgagtaccaggattatagttagaatttacggactgggtaggaagactggatagaaatctaaagattgctgactcaaacacaatgtggtttctttgctttattgtcacagctctgaattcacaattattagttaaattcataggcactataactttagaaagcaccttcccaaaccaagtattaagtgatttattataatttctctgacttcttatagaattgactttccaagtgttcatgagaattattgagaatttgctacatagtatcatctcagctgtgtccacatgagctatctgtcaccttgtcttaatgaataattgttcagtaggaatattggttttggcatttaaagtgatctatatctaaatgcagataggatcagggaccactcttgaacattaatgtccaggcatcttaaaattacacataaggctttcataatctgacttctgccccactctccatctttaggccttttccctgtgtgccctttctctggcattactgagctgctggcaatgccctactcactcatcctcctattgtaggcaaatactttcactctttcaggcctcgctcccgctcttgctgctgcgtggcatgccgtcaccctttcctgccctctaccccttttaatctggctagtctcaatatttaagtctctgcttgggcatgttttctagaaaagccatccctgacatgctttattttaattgtttttaaaccctaatgcctagcatgtatttagcaggactcaataagaaatttctgagtaaaatgtgagtaagatgatgctcaagactgtcctctgcagtcttggagcagacgggacagacatgtggaggaataatgtagagttcaggtggtaaagatgcagtagaaaaatcagtgaagtactaaggcagcctcaaggaaggaggtacctgtttatctggggaaagacatgcagaatcaaggaagacgttctcatagcattgttttaaaagataaaaataaggacaagtgtggtggctcacacctctaatcccagcattttgggaggctggagcaggcagatcacaaggtcaaaagatcaggaccatcatggccaatggtgaaaccccgtctctactaaaaacatgaaaattagctgggcatgatggtacatgcctgtaatcccagcttctccggagactgagacaggagaatcgcttgaaccagggagtgtcagaggttgcagtgagctgagattgcgccactgcactccagcctggtgacagagcaagaccctggctcaaaaaaaaaaaaaaaaaaaaagaaagaaaaaagaaaataaatgtgtcagaatagtggagggaaacattttagatattgggaagacattgtacactaataaaggtgtcagtagtaatttttgaaatcatttgtaaggtactattgttgcagaaaacaggaggcaggagagaccaagtgggtgaaacaggaggatttcatttaggttcgcaacagctcagcagatttgcatccgaaagctgagccctgaacaaagacacggcttggcttgtgtaggcaagcttacagaagcagaacaaaggcagttaatcatatagtgacagttttgcaacctcagcatagcttatgaccttgcagctgcattgaaggacaacaggaacttgcaaatagtatgcatttgtaaaaacagctcggagtgaatgctgaggggaaggggagacagtaaaggattttgttttcttaaccttgctctgggatgtctggagcccatacctgtgggctctagcttctcaggcagggtcaccacgacctttcctgggccctgcttgttactatccttagagtcagactagctaagtgcgggaaaacttgtttctctttaaaactaaatttccttttctttacatttactgcttcactattaggaagtggagaacaacatactgtgttaccttacatgcttctactgtattttaaagttgtgtttctggtggttttgttcatttatgttgggtggatgaatttgtgagtgaatgacatcaggtgtctccccaagtggtttgttgaagtttgggagaattatttcctaaataactatttcgtgaaaaactaaacactcaatttatgaaataaaatgttgtcttaaatctatttttataaaggcaatagtttttaactgttctaagtggttcattttaactgaatatatggatttctcaacagaacaagagttaaagctgacatcagaggaagagtcacaaaggttcaaaggcagtgaaaatagccagccagaggcatgggaaattttaaatttaaatttttgatttaatgttgttttctttgctttaataatattagatagtccaaatgaaattacctttcagactaggttttgagaatcaatagattttttaaagaattttttaatagattgttaaaatttattttaataaattcagtaatctcattaacagaagaatggattctaatttaacatttgatatttaacttaaaaaacataaccactataaaatttaaaatactcttataatatttttatttaaaatactctcatctgcctttttgattagcttatagctaatctttccttttggaatagaggcaaaaacaaatttcagaactttgttcttttatttttacaacacccgaacatgatgaagaaggtacatcaattattggattatgttattaagcaatagaattatgaacaatgtaactctgatggtccctgagctggattcatggttaaggagtaatcatggccagtgattgaaaatctgcagttttatattgtcagtcactgtgataccaaggttaaaaatatattctgccttatggtctctcgttgacctcagcgtttctgttcagggagggaaccaggtcataaaagcaacacagctgcctattacaagaatcatatcttgcagaatggaacctttggtgttagtgcacaaacacaataacattctaatttatttcagttgcagaaaattagtacatattattaaaaaatctttatccactgtaattagtacacattagaatatattagaactggacttacgcagataatctggatacataacactatcatatgacagtatataatctcaattaaaatttgagaatttgcatctctttctgtttggtgttgatttcggctcctaataatttaaatggtgcctacaatccagttaggaatcttttagaaaagcacttcagtgcactgtaggggctcactagttagggtttcatgaggtaaactcttttcaagtgaggaaggttttggaacactacaaatcatctgctgattcatttttggtagatttaacacataacaaattaagtttagtccaaacaaatggtgaccaaattaagtttgctggttcacgttttttttcttccttgggctaaggtgaattatttttcacatgttagtcagaagccagtaatgtggcagtagctaaacatagattaaaaagttaattcttaattttaattattatttatttaacagttaaattttaattttaattattttctaatttttcattgtccatacttgattagttaagaataaaatttttttaaaacatgcgctccaaaagaggagacatcacagaaacacaacaagcaaattaaccttctgtttttgcctctgcagaaaatgtctcaagaactagaaataaataaggatggtgatagagaggtataccttcatattcaaatgtttctgttgaattagatttttacattatgttgtttaacaaaatgtagtaagtgtaggcatacatgatcctatcatgtaagtagcataaatcatcagtgaaaaagttaatatttaactcagaaagaattctgtacattgagttttcaagagatacaaagcctagagatattctttgattattatggaacaatcctgaatggtgctataaaatgctaggtaatgccactttaggagctttggaccaatcattttatctttcttggttttagtctgattatcaatagataatgtggctaaagaagatagctttttattctgtgtatcttccagctagaaaattgtatggctattcaatgtgaaatttggggagcatctcattttctggaattccatgcttgcacgtcagcagtttcactctgcttcttgtgttgtggcaaactttggctcccattttcagtgagcaccatcatgtttttgatatcccagcaaccaaatgaaaaaagaatgctcaaaggcagtggggtagaagaatatcttagcgcagaaaagggcaaacttcctttctattcctgaagccgcacagtgtgtcatcctctaaatctgactgtttaatgtaaaatctaggtggtaaagacggaagaggacacattttgcatctttgtctttttatttgtgtgttcccatgaatcaaatggggtaaatacatacataagattctgaagagtgattgagaataaaagcacaaaatgaaggagggccctttttgaattttggaaaattctgtttcattcattgaaacagaaatgaagcaaactttacaaaaatttctgtgatatattaatgagatgataattacatcttaaagttatatggtaatatttctatatatatgatcaaatttaagtgtgaaatatttttaatgactaaaataatgacaaactgagtcaattgatagaatcaattaaaaaggttctttttattcaataaagtgataactatccttaatatcccactcaaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacaggtaagcctatggcaacattgaatagaagataactatgtgctgtcaaactaaccctaatttgggctaatattcatgatgaacaaattttatagttttactaggatattcagccttgcccgttaatcagaaaaatgaaaatcagcgaacaatgagttaccatttttccaggcattaatttatttgaaaaataaccagtattggcaaatgtgagggaaaaggcattttcttttctttttagtgaacttttcttttagtttcaggggtacatgtgcagggttattatataggtaaagtgtatcatggagatttggactgcagattatttcatcagccacataataagcaaaacaccaaaagttagttttttggtcgtctccctcccgcgacgctccaccttcaagtagaccctggtgcctgttattctcctctttgtgtccatgagttctcattatttagttcccactaatgagtaagaatatgtggcatttgatcttctgttcctgcattagtttgcttaggataatggcctccagctccatctgtgttgctgcaaaagaaatggtttcattgtaaaagacatttcatacactgctggtaaatacattttgaacattaatttagtagcatattcacaaacacatgtataacaataaggatatataatatatgtaaaggatatttgtgtagatttgttacatatatacttatgtataaggacatttattacagcattattatatcaaaaagatggatccttatcaataggaaattatcattatcaaaagtaaatcattaccaattggaaatagctcaattttcatacccagaaattaatgtagtatgcaaccattttttacaagtgaggttagatctagagtatactgattatttcacaattaaagtgtatttaaagcatcagtgatgacatcttaagagttcttgttaaaattcttgtaatatttcctgtgttgcaaatggaagctacatgctatattgacgctgtaccttgttagcaacaagattgctagtcattaaatttttattgtcagtgcctgagtgctgaaatattggaccctcaatctgaatattgccaagggattgtacatggggatctgtatttaatataaacgtttcagtatattgggtaaaacttttattaaaatatatcaaaggatctttcatctgctaaaccaggagttggccagctttttctgcaaagagccagttagtaaatattttaggctttgtggactatataaattaatttatttttgagacagggtctcactctgtttcccaggctggagtgcagttgtgtgatcatggctcactgaagtcttgactttctgagctctagtgatcttcccacctcagcctctctactagttgggaccacaggtgtgcaacatcacacccagctaattgacactgtggactgtaaagtgaataagcatggctgtgttccaaaatacttgacttacaaaaacaggcagtgggctggatttggcccaaggtgctaatttgctgacccttgtgctaaaaggaaggtgctgcaagtgaagtgactcctatttgtaaaagtgccctgcgtgtgtgaaattatccttcctttgagaaaaggatatatttcagtattcacctcaccatatttttccacagtgacttcatataattttaaaaatttcatttataaaataagattattttctgcatttctcccactttattcctgttaatagaacccagtattttgctgtgatgaattattttgtatatttgatgagtatcagttttcctagaattggctgattttatcaagcaagaaatactctccttgaaacttttagtatttcttggtctttatgtataagcatgaataaaatgataatcagcttatgtgtaatctagaaatgttcaaggcgacttttagttctatagttttaagaatttaacacctcagtctggcatttttaatgccacatgtgtataatttttataacctttaaaatatataattgttatataaaatttgaaaactacacctgttatataaaacttgaaactatttgtctattacttttccatgactgtggaagaaaattacaacattctcagtcatgactcctaagcatgatgtccttaaaagaactgtccacactcacgaactcaaattttcttttcattcactcttaatctcacaccggcgtcttcaatttcagcagtcctccaacattgtttttcctcaagattatcacaatttttttctgtaaattatgcatttttcttacacctcattttatttaatctgtcagcaatatttgagccagtggagggcgtctcctccctaacggcgtcttcacttggctttcaggtcctcactccctcaagcttttcctcctgcatttctagtccattcatcatggtctgttttgcttgctcctcctcatctttctccttttggacattgttgtttcccagggctcagtcctcagtcttctttctcctgactttttctttttctttttttgagacggagtttgactctgtcccccaggctggagttcagtggtgtgatctcagctcactacaacttctgcctcttgggtttaagtgattctcctgcctcagcctcctgagtagctggcattacaggtgtgtgccaccatgcctggctaatttttgtatttttagtagagacagcatttccccatgttggccagcctggtctcaaactcctgacctcaggtgatctgtctgccttggcctcacaaagtgttgggattacaggtgtgagccactgcacccggcccctcatgactttttctgttgtgtatatgctagtgatttccaaatgtatgtctccagctcagatctctctccttaattccagattttttatatcagcctgcctacttgacgtctctatttggttagttattgggtatcacacacttgtcagatccaaaattgggctactgatgtccttcctgaaatctacacctcatgtagtctttcctactttggttaagggcaactcttccaattgctctgccaaaaatgtcattgtcattcttgactcatctgtccctctgacacctcatatctaatctttcagtaaatcttgtcaggtctacctgaagaatatgaccagaagccagtcatatcttgtacatctgagccactgtcatctgcagtcatgagtgtcatagactgggaattgatcgtcctggcttttaaaaacttcccttttcatcaattcttaactcagtggatgtatttaaaacataagtcaaattgtgtcattcctcttccccagcacttctgattgcctccttttcactctgagtatgggtcaaagttcctcctgattatctcccttgctctgcttcagccacactgaattcttgccatcccgtatctacccctagtgcttaaagactccagacacacctctgtgcttggcagttccctgtgtctgggatgcttttcccccagatatcctcctagcttaactctttccattccttcagttctttatttaaaaccgcctttctaagaagaagaagacaaagggtaaaaagaaacacattaaggaacatccactttctgaggaagaaccgtgtactacccagacgcatcatgcttaagatgcaattggcagcatacaaggaatgctctctaaggtaatcaaggcaaggttcaatgaaacaaagtgatttatcatctctaacttcaaacctatttgtatcttgacatcaacgctgttaaccttatgtcatcgtttcttagagtctttgatatacaaataaaaggttttttgtattagaaaaaaaaaaccctttctcagcagggactcttctggccatctcaactttcccaccaccctccccatcaaacacataaacatttcattttcctgctttagtttttctcctctaacataccgtatattttgccttatctgtctgttgttattgtgtgtttttctcactgtcatgaatagggtttttatttttcactaccatatcttcactgcttagaaaaaggcttagcatattggatgtagctacctaataaatacttattaaataagtgaatggagtttatcctgtgtatattgtttgattgattctcactttaaaaatgtttgacatgggtcgggcatggtggctgacacctgtaatcaaagcactttgggaggccgaggcaggtggatcatgaggtcaggaggtggagaccagtgaaaccccgtctctactaaaaatacaaaaaaattaaccgggtgtggcagcatgcgcctgtagtcccagctgctatggaggctgaggcaggagaatggcatgaacccgggaggcggagcttgcagtgagccaagatcgtgccactgcactccagcctgggtgacagagcaagactccgtctcaaaaaaaaaaaaaaaaaaaagtttgacatggttcttagtcctaacagttttgcctggtaattgtctgcatttttaaaatcgttttggctctttgtaataagctacattctttatattaatttttttatttagggagaaaagcccaatattgtggttattcactatttattctttaatagtaatcataattgtcattatggtaaactgagtcagaggaattgcaaactttactattttattttattttattttatttttttgagatggagtctcgctgtatcgcccaggctggagtgcagtggcgcgatctcagttcattgcaacgtgggttcatgcatttctcctgcctcagcctcccaaggagctggcccttgcataaggcggccacacaaatttttgaagcattctatattttgcgcagtcactggaaggtcatttgactgtttgctgagtagctttaaggaaatggtgtgaatcaaagcagaatgggtgccacaaaaacattgaaattgtgatttgcgcaataaaaatagtcatgtaaggtggtctgtgagatgacaccagagccaaataacgtgtggggtgttgtgtaccaaatatattgttagtatgtatgttaaaaattagagaatggcaacttacaacttcttcgtggaacctaaaaaaaaataaaagtagggttttcgtctcccatgtcagctggagatgaacatgtatataaagcatcatcgtaacaaacatctggctgagagtttgagtctgtagagaaggatcattggtccaagtcaggtcttgacatccattggtttttctgcccttggcgtgattgatcaactccgtaatagtggacaatcacattatctactttaatgagatatttatgaaaaaatttagttacaaactatgacatagttgagatgccctgaattagaagccataaagagtaggacaactaagaagcaaaattaggacttaataacatttcctgaaaactacaacatttgcatattagaacctatgaacaaaattcgcactgggttttatttgggattccaagataatttcagtcataaagtttaggaacaaattattccattgttttactatttctttgagcatttaaaaaaatgttatcgtgttaaatcattataacaacctagtaaaataaggcagcatagtcctcactttgtagaagacattgagcctaagagaagcagcttgttcaagagcaaatagctgttcattatggagctaggacttatttagagttgggacactttctattatgtcaggctaatgcaagttaatttactgggtcacagtgccctcgatttatgagtatttcatcttacttttttttcttctttaattagaagcttcatgagaagtttgtagaacgtacgcataagtggatgggataatactgttaagttctgatattctgatattgtttgaaatactctaagaattttacatttggtaagtttccagatcagtattttaaaacagtaattttatttgttatatttttatacatagaatttgtgaattactttctgactacaaagaaaagcagatgccaaaatactcttctgaaaacagcaacccaggtaagacttgtgatagtgaattactttaggtcagttgtccacaatctttttggcaccagggaccggttttgtggaagacaatctttccatgggctgggggaaggtggggatggtttcaggattgttcagtcacattacacttattgtgctactttatattattattacattgtaatatataataaaataattatacaacttaccataatgtagaatcagtggaagctctgagctgatttttctgcaactagatggtcccttctgggggcaaagtgagacagtgacagatcatcaggcattagattctcataggaagcacacaacctagatccctcagatgggcagttcacaacagggttcatgctcctatgagtatctaatgctatcactgatctgactggagacagagtagaggctgtaatatgaatcataaggagtggctgtaaatacagatgaagcttccctggcttgcctgctgcgcacctactcctgtgtggcgtggttcctaacagaccgtggactggtaccagtctgtggccggggagttgtggagccctgctctgggaggtcctaccatagatttaaaaagtaaaagtaaggaatttttgttcacaaaagaacagtgaagcacaggtcatgttacatatgcttgtgccaacaaggtctcactgttactgacttcattcctcctattttgaagttgaaagagatgcatttactttgttggaacaagatgtgttcttccaccggctggttaattgtcatgataacagtaattttgttagaagaaggtgctctgctaccatttgccaaaagattgtcataatgtacaattttcccaatgcaagggtcagcagattataataaaaatataaaaatgtttcacagtaacaaaaatgctagtatgctacctggatgtggacacctaatacatggtacaatccaaactgtatgaggacacctttaatttagctacctatttgtcaaagagcttctgtaagttaggttttataagttgcaggagacaaagatggaatagatgtagttttaatctttaaggtgctcacaacagaagtgtttctatttcatttctgtggtttttcaacagaatttacaaagaaaacatttttatttatgttttcacttgtccacttaacaaataactgtcaaatgtcttttagatactaagcagtttttctaaggctacagaacacaaaaacagacaggagcttgttattattatcattgtcatttttattattttgctgctttattcagtgcttactgtgtgctagatgcccactggaatcttataattatgatttattatatgtgatattgattgtgtgccagacatatgtgatgaggagtgaaagctttagaaagaaaggaggcaggatttaatgtaagcatgcagagtgagaagaatttttcagggaaagaagcagaggaatgacatttggcagaaggaacatggagtgagatagtgtgtttgccagaaggaacatctaatgagattgcccgtttgggaggaagagcagcaagtgcagaagacaagatgcttgagtgaacatggcagggtttctgagcagttcacttttgctagtaccaaaagtgtgagataccagaggttgggagtgaggtgaatacttagctaaggcaagtttacgatagactttttaatactatagaaatgagtaggtcttttcctgtgggccatgggaaatttaccaggtagaatgctttggactgcaaatactagatgagcagtgcctaaaacactaggaaccagagttgtttttttgttcattgatatcctagggatcccacttgtccctctttcagctgtgctgttgacagtgttttattcacgtctccttttgtggttggctaatctgcagcagctccaaacatcttgttttcacaacacaacatcgaaagggctgcttttcttcacatgtgtcttttaaacagggagaaaacttagaagcatgcaaggggcttcctgtaacatttcattggctgggtcataccacatgctcattcccaaaccaggcactgggaaggtaaatatctgattagcttagaataaacatttctttctgaggctgaggagggggattgggatattaaatatcccaatagacttatgttttttctgccagaaagaatgaggaatggctattgatagggagccaacaatgtgtgctggagggggctcattggagaaatttgagcaggggagccacaagattaaatttgagtattaaggcattctggttatggtgtaaaatgggttagcaagctttttctttaaaggaccaggtgggaaatattttggactatgtggtctctgtcatatctacttaaccgtgctgttgtctgctgttgtagtgtgaaagccaccatgattatatgtaagcaaacaggcatgactgagctcctataaaactttatttacaaaaccataatgcagattggatttggcctgtggcctatagtttcctgggattgatgggagataatcatgcaaagaaaccaggagacaaaggaagcttttgcagtagtcagctatagtttccatgtcacacatccttggagtagcatcaatgtattacaaggttttcacccgtccatggtgaaataaataacgttagaaatctcagttactcattttactatgttggccttcgttatgcccttttcacttgttttgcttaattttttttcctgtaagaaataacattaatagttggcagttttcttttaaatagaagtcattttgtaaatgtttgtgttcccagtggcagtgggaatataaaacagaggcagaagagaggtatagtcaatatgatttagtgataattgaatgagaaaggcttgggggacagagagaaatctcagatgatgtacaggtttccagattgcacactagtatttaacctggacatgaggaaggagtaggaaattttctggtgaatacagaagagcaaagagcagcaggtcagcaggaatgactaatgtttttcgatgcatgtttaatggaatattcgtgtagggtattttgagtaggtaattggataatcagcatttataactcgcatcctactagtttgactctaagtaataagacttgtcaaagatccaagaatctgaaagtcagtaataaatgtccatgtgcatcatcgtccgtgacagaaagtcagcatccacagaacacagaattgggacagatgaacttaatagataaagatgaatatcggagttgttcctcttagggaatgatactctccatgacctgtgtgagtcacagctgccagaaaagaaagagcaaggagcgtatgaaggcagcacagcaaattcggtcctagagtgccctgcttggcttcatgtcatagttctgacttctaaataatcattttctgcaaaatgtgctttgtgtttttccctcttgccgcctgcagccaatcagaatctttttagcaggacataatgaaaagaagtaagagaaagagtgtttttttgtaatgggatagtatttaacgtaaacttgagagtgagtaccaggattatacttagaatttatggactggatgggaagactggatagaaatctaaagattgctgactcaaacacaatgtggtttctttgatttattttcacagctctgaattcacgactgttaattgtattcatatgcattataactttacaaagcatcttccgaaaccaaatatttactgatttattataatttgtatgactttattatagaactgactttccaagtgttcatgagaattgtttagaatttgctacattgtatcatctcagctgtgtccacatgagctatctgtcaccttgtcttaatgaataattgttcactaggaatattggttttggcattgaaatgatctatatctaaatgcagataggacccgggaccacttttgaacattaatgttcaagcatcttaaaattacacataatgctttcataatctgacttctgccccactctccatctttagcccttttccctgtgtgccctgtctctggcattactgaactgctggcagtgccctactcactcatccttctattgtaggcaaatactttcactctttcaggagtcgctcccgctcttgctgctgcgtggcatgccgtcaccctttcctgccctctacaccttttaatctggctagtctcaatatttaagtctctgcttgggcatgtgttctagaaaagccatctctgacatgctttattttaattctttttaaaccctaatgcctagcatgtatttagcaggactcaataaaatatttctgagtaaaacaaagactgtttttacaaagatgatgtgcaagactctcccctgcagtcttggagcagaggggacagacgtggaggaataatgtacagtttaggtggtcaagatgcagtagaaaaatcagtaaagtactaaggcagcctcaaggaaggaggtacctgtttatttggggaaagacatgcagaatcaaggaaaacttcatatagcattgtttcaaaagatgaaaataaggccaggtgtggtggctcacacctgtaatcccagcactttcagagggaatcacgaggtcaggagatcgagaccatcctgtccaatggtgaaaccccatctctactaaaaatacaaaaatcagctgggtgtggtggtgcttgcctgtaatcacagttactcaggagactgaagcaggagaatcacttgaaccagggtcgcggaggttgcagtgagctgatcacaccactgcattccagcctggtgacagaggaagactctagctcataaaaaaaaaaaaagaaaaaagaaaaaaagaaaataaatttgtcagaatagtggagagaaacattttagatattaggaagatgttgtacactaataaaggtgtcagcagtgattttggaaatcatttataaggtactattaggaagtggagaacagtacactgtgtcaccttatatgtttctactgtattttaaagctgtgtttctggtggttttgttcatggatgttgggtggatgaatttgtgagggaatttttgacatgtttgtttgtcttcaatctggtgacatctgctatctccccaagtgggtttttgaagtttttgagaattatttcttaaatgacaatttcacaaaagatgaaacactcaatttatgaaataaaatgaaatgtctcaaatctgtttttaaaaggcaatagtttttaactgttttaagtggttgattttaactgaatgtatggatttttcaacagaacaagacttaaagctgacatcagaggaagagtcacaaaggcttaaaggcagtgaaaatggccagccagaggcatggaaacttttaaatttaaacttttgtttaatgttgtgttttttttgccttaataatattagatagtccaaatgaaattacctttcagactaggctttgagaatcagtagattgtttttttaagaatcttttggccaggcaaggtggctcacgcctgtaatcccagcactttgagaggctgaggcaggtggatcacgaggtctggagatcgagaccatcctggctaacatggtgaaaccccgtctctagtaaaaatacaaaaacttagctgggcgtggtggtgggtgcctgtagtcccagctactcgggaggctgaggcaggagaatggcatgaacccaggagagggagcttgcagtgagccgacatccaccactacactccagcctgggtgacagagcgagactccatgtgaaaaaaaaaaaaaaaaattttaatagattcttaaaatttattgtaataaaatcagcaaccttattaacagaagaatcaatagattctaatttaatatttgatatttaacttcaacataacccactataaaatttaaaatactcttattttaaaatattcttatctgccttcttgattagcttatagctaatctctccttttggaatagaggcaaaaacaaatttcagaactttgtttgttcttttatttttacaacaccctaacatgataaagaaagtaacatcaatgattgaatcatattattaagcaataggaattatgaacaatgtaacactgattccctgagctggattcatggttaaagagtaatcatggcctgtgattgaaaatccacagttttatattgtcagtcactgataccaaggttaaggacatatcctgccttgtggtctctcgttgacctcagtgtttctgttcagggagggaaccaggtcataaaagcaacccaactgcctattacaagaaccatatcttgcagaatgggacctttggtgttagtgcacaaacacaataacattctaatttatttcagttgcagaaaatcagtagagattaaaaaattttatctgctgtcattagtacacattagaatatattagaactggacttacgcagataatctggatacataacactatcatatgacagtatataatttcaattaaaatgtgagaatttgcatttctttctgtttggtgttgatttcggctcctaatagtttaaagggtgcctacaatccagttaggaatcttttaaaaaagcacttcagtgcactgtaggtgctcactagttagggtttcatgaggtaaactcttttcaagtgaggaagattttggaacactacaaatcatctgctgattcatttttggtagatttaacacataacaaattaaatttagtccaaacaaatagtgagaaagttaagtttgctggttcatgtttttcttctccctttgtctaaggtgaattatttttcacatgttagaagccagtgatgtggcagtagctaaacatagattaaaaagttaattcttaattttaattattatttattttaacagtttaattttaattactttctaatttttattgtccatacttgattacttcagaataaaattattttaaaaacatgcactccaaaagaggaaatgtcacagaaatacagcaagcaaattaaccttctgtttttacatctgcagaaaagatctcaagaaccagaaataaataaggatggtgatagagaggtatacctttatattcaaacgtttgtgttgaattagatttttacattatgttgtttaacaaagtgtagtaaatgtaggcatacatgatcctatcatgtaagtagcataaatcatcagtgaaaaattaaatagttaactcagaattctgtacattgaattttgaagaggtgcaaaccctagagctattctttcattattatggaataatcccgaatggtgccataaaatgctaggtaatgccactttaggagctttagaccaattattttatctttcttggttttagtctgattatcaatagataatgtgcctaaagtagataatttcttattctctgtattttccagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacaggtaagcctatggcaacattgaacaggaggtaactttgtgctgccaaactaatcctaatttgagctaatattcatgatgaacaaattttatacttttattaggatattgagccttgcctgttaatcagaaaaatgaaaatcagcaaacaatcagttaccgttttttttccagtcattaatttatttgaaaaataaccagtattggcaaatgtgagggaaaaggcattttcttctcttttcagtgaacttttattttagcttcggggtacgtgtgcaggtttattatataggtaaactgtatcatggaggcttggggtacagattatttcaccagccacatagtaaacaaaatactcgaaaggtagttttttggtcgtctccctcctgccatgctcctccctcaagtaggccccagtgtatgttattctcctctttgtgtccatgagttctcatgtttagttcccgctaatgagtaagaatatgtggcatttgattttctgttcctgcatgagttttcttaggataatggcctccagctccatccgtgttgctgcaggggaaatggtttcattgaaaaagacatttcatatactgttggtaaatacattttgaacattaattgagtagcatattcacacacacatatataacagtaagcatatataatacatgtaaaggatatttgtatagatatgttatatgtatacttatgtataaggacatttattatagtattatgtaaaaaatttggagctagtctaattccttatcaataggaaatagctcaatttccatatccccaaaataatgtattatgcaaccatttttaaaaaatgaggttagatgtagggtatactgattatttcacaattaaaatgtatttaaagcgtttagtttgatgacacatcttaagagttcttgttaaaattcttgtaatatctgctgtgttgcaaatggaagctacatgctacattgacactgtaccttgttagcaacaagattgctagttactaaatttttgttgtcagtgcctgagtgctgaaatattggaccctcaatctgaatattgccaagcgattgtacatggggatctatatttaatataaacatttcagtatatttggtaaaacttttattaaaatacatcaaagaatctttgatctactaaaccaggagttggccagctttttctgcaaagagctagttagtaaatattttaggctttgtggactacatatattgattttcttgagacagggtctcactctgtttcccaggctggagtgcagttgtgtgatcatggctgactgcagcctcgactttctgggctctagtgatcctctgacctcagtctctactagctgagaccacgggtgtgcaacatcacacccagctaactgacactatggactgtaaagtgaataagcatggctgtgttccaagatacttgacttacaaaaacgggcagtgggctggatttggcccacaggtgcttatttgctgacccttgtgctaaaaggaaggtgctgctaatgcagtgacttttatttgtaaaagtgccctgcatgtgtgacattatcctccctttgagaaaaggatatatttcagtattcacctcaccatatttttccagtgacttcatatgatttggaaaactacatttataaaataagattattttctgcatttctcccactttattcctgttaatagaactcagtattttactgtgatcaattacttcgtatatttgatgagtgtcaactgtcctagaattggctgatttttatcaagcaagaaatattctccttgagagttttagtatttcttggtctttatgtataagcatgaacaaaatgataatcagcttatgtaatctagaaatgttcaaagggcctttaaaaccttggtctgacatttctaaatgccatatgtgtataatttttataacctttagaatatataatggttacataaaatttgaaaactccacctggtatgtaaaatttggaagctactatttcttgtctatcacttttccatgactgtggatgaaaattacatcattctcagtcatgagcgttaagtatattgtccttaaagaactgtctacactcatgaactcaaattttctttccattcactcttgatctcaatgccggtaagtcttcaatttcagcactcctccagaactatttttcctcaagattatcactaatttttttctgtactaaatctaggcatttttcttacacctcatttaatctgtcagcaatatttgagccaatggagggcatctcctccctaatggcgtcttcacttggctttcaggacctcactccctcaggcttttcctcctgcctttctagtccgtttatcatggtctgttttgcttgctgctcctcatctttctccttttggacattgttgtttctcatggctcagtcctcaatcttctttctcatagttttttttttttttttttttttaagacagagtctcgctttgtcccccaggctggagttcagtggcatgatcttggctcattgcaacctctgcctcatgagttccagcacttctcctgcctcagcctcctgagtagctgggattacaggtgtgcaacaccacgcctggctaatttttgtatttttagtagagacaggtttccccatgttggccaggctggtctcaaactcctgacatcaggtgatctgcccgccttggcctcatgacatgttgggattacaggcgtgagccaccgtgcctggcccctcgtgactttttctactgtgtatatgctagtgatttccaaatgtatgtctccaacttagatctctttccttaattccagatctctatatcatcccacctacttgacatctctatttgattagctgttgggtatcacacacttgtcagatccaaaattgggctactgatgtccttcctgaaatctacacctcatgtagtctttcctactttggttaacagcaactcttccagttgctctgccaaaaacctcagtgtctgatctttctctctcagtcaagatcttcttgactgatctttctctctgtcctgacacttcacatctaatctctcagtaaatcttgtcaggtctatctgaagaatatatccagaggccagtctatcttgtacatctgagccaccgtcatctgcagtttagatgagtgtcatagacgggaattgatagtcctggtttttaaaaacttcccctttcatcaattcttatctcagtggatgtatttaaaacataagtcaaatgttgtcattcctctgcccctgcccttctgattgcctcctatttcactctgagtatgtggcagagttcctcctaataactgaaaggcagtaaaccatctggcatgttacctctcctgctgaaacttctgtttcttatctctattgctgtgtttcagccacactgaacttgttgctattcctgacctatccctagtgcttaaagactccaggcacacctctgcacttagcagttccctgtgtctggaatgctttttccccagatattcttctagcttactgtttccattacttcagctctttacttaaaatcccctttctaagaagaagaaaaagggtaaaaagaaacccattaaggaataaccacttcctgaggaagaaccatgtaccagcacgattcctaatccagagaaaatgaagaaaatgaaaaaaaagagagataatgaggactaacagaaaggaattaggattgtatcatcaggacgcgtcaggcttgagattcaattgggaacataccagggatgctctctaacgtaattgagggaaggttcaatgaaacaaagtgatttatcatctttaacttcaaacctgtttgtgtcttgacatcaactctgttaacatcatcattttttagagtctttgatgtacaaataaaagtttctttgtattaaagaaaaatcctctttctcagcagggatttttctggccatcccaactttcccaccacccttcccatcaaacacataaagatttcattttcctgctttagtttttctcctctaacgtactgtgtattttgccgtatctgtctgttgttattgtgtgtttatctcactctcatgaatagggtttttattgttcattaccatatcctcacttcctagaaagaggcctagcctatcagacgtagctacctaataaataggtattaaatgaatgaatggagtttatcccgggtatattgtttgattgattctcacttaaaaaatgtttgacaaggttcattttaacaattttgcctggtaattatatgtattttaaaaattctttcggctttttataataagctacattctttatattaatattttttcacttagggagaaaagcccaatattgtggttattcactattcttttactggtaatcatgataattgcaattatggtaaaatgagttagagaaattacaaactttactggtattttatttatttagagacagagtctcgctctgtcacccaggctgcagtgcagtggtgtgacctcggctcactgcaacctctgcctcctgggttcaagcgattctcctacctcagccccctgaggagctgggattacaggtgcgtgccatgacacccggctaatttttgtatttttagtagagacggggtttcatcctgtttgtcaggctggtcttgaactcctgacctcaggcagtccacccacctgggtggattacaggtgtaagccaccacatccggccactagtattttagtttttttagggtggtaaatgtaatggactcacaaattctttccaagggattatggaccttcggtatttgaaataaaaagacagttggaattttttgcttccgatagtaagactatactggtcaggcactgtctattctgatggagcagctgttgctgcttggctgtctttcagaagcaagctgctcacactgatattggttggtgagcacagccagtggtcggtcattgatcgattgactagattttgaactggctctggctggcttcttgttaccatggctacaggtcaattctttcctaagtttgagtcaactttaaccagaaattttctgttcaaaagttgccttccattaactatgttcaaaaagaaactttttaatattccagaattgtggatttaaagttttggttatgatgacttggttaataatagctctcacgaagattttttttttttgatacatcatcttaaccagaagtgttctctgtataatttatttcttaaaaataagtgttttgtttttgtttttggtatttttagaagcttttgctcaagtcctaacataatctccagtaggagattttagtctctttgtcagttcatgtatgtatgtgatagtcatattctgtgtttttaaattccttttcttgttcacttttttctctgtacaataatagtgatattgttatacatttttatctcattaaaaagttgttaacaattttctgctggcaaatctagctttttctatattttgactgaataggttaaaaatgaagaaaatttacgagatcattttattttcaaacaaaatcataagtaataaaaattgctattttgaattataaataatgacatttagatattttaaaaataaggataaccaccccccccccccccccgcaatagtttggctttgtgtttctatgcaaatctcatgtcaaattgtaattcccaggtgttgaggaaagaccagctgggaggtgattggctcatggggtcggtttcctccatgctgttcttgtgatagtgagtgagtcctcacaagagctgatggtttcataaggggctctttgcgcttcacttctctcttctctctctcctgccgccttatgaagaaggtgcctgcttccccttccccttctaccatggttgttaagtttcctgaggcctccccagccatgcgtaactgtgaatcaattaatcctctttcctttatgaattacctagtctcaggtatgtatgtgtgtgaattacccagtctcagctatgtacatatgtatatgtgtgagtgtatatacacacatacatatatatgatacatgtatgtgatgtgagatatatatatatgtatatacgtccattttctttattccacgcatcagttgatggacactggttgattccatatctttgcatattgtgaattgtgctgcagtaaacatatgtatgcgggtgtccttttgagagtatgatttcttttattttgtgtagatatctggaaatgagaatgctggataaaatggtaggatctacttttagttctttgagaaatctccatactgttttccatagatttgtatgaagttgcattcccaccagcagtgtatcactgttgtcttttcaccgcatccacaccaacatctgttgttttttgatttctaatagtggccattctggctgcagtgaggtgatatctcactgtggttttattgtacatttccctgatgattagagatatttagcgtgtttttatatgcttgtttaccgtttgtacatcttcttttgggaaatgtctattcatgtaatttggccactttccaatggaattatttgcgtttttcctgttgatttgtttgagtttcttgtaggttatagatattagtcctttgttagcatcataattttcaaaattttcccattgtataagttgttgttttactctgatgattatttcttttgctgtgctgaagctttttagtttaattaggtcttatttatttattttcatttttgttggatttgcttttagggtcttcctcataaatcctttgcctaggccaatgttttcaggtcttaggtttaggcctttcatccatcttgaattaatttttgtatatggtgagagatagagatccagtttcattcttccacatgtggctatctttttttcccagcaccatttattgaataacctgtactttctccagtgtatgtttttgtatccttgctcagagatcacttggttgtagtggctttatttctgagttgtctgttctgttccattgatctatgtatctgtttttatacgagtaccacgctgtttctgttactgtggtcttagagtatcatttgaagtcaggtaatgtgatgccaacatatttgttccttttgcttgatatgtctgttgctgttcaggctcttttgtggttctacatgaatgtcagcattttaaaataattctgtgaagaatgacattggtactttggtaggtattgtatagaatgtgtagactgctttgggcactatggtcattttcactatatcagttctttcagtccatgaacataagatgtattttcatttgtttgtgtcatctgttattttctttggtggtgttttccagttatctttatatagatcactcacttttttcattaagtatattcctaggtacttcacacctttttgagccactgtaaaagggattggattgttgatatgaactctcagcttggttgtagttggtgtatagtggtgctactgattggtattcatttattttgtaacctctgagactttactgaattcatgtatcaaatctaggagtgttttgtaggagtctttagggttttctaggtataggataatatcattggtgaagagatagtttgacttcctcttttccaattgggatgccctttatttctcttgcccaattgctctgcctaggacttcccagttttattcttaatatgcatgaaataaaagtaaaatggaaagtgcttaacgatgagtttatttcacatctctctctcatacacagataaaattatttcaaagtcctatgttaaaaacataatattagaccctgtcttgttctaaaaggaatttctaagttgtttataaaatacataggaatcaagaatataagtagaaagtgtttccaaacaataaacataaagagtatgggttacaggacacagaccattagcagtccctggcctgttaggacctgggccacacagcaggaggttcgaggcaggtgagcaagtgaagctccatctgtttacagccactctctgtcgctcgcattaccgcccgagctcctcctcctgtcagatcagcggtggcattagattgtcctgagtgtgacctgaaccctgttgtaagttgctcatgcagggggatataggttgttcactccttatgagaatcgaatgcctttctgatctgtcaccatcttccgtcacccccaaatgggaccatctagttgcaggaaaacaagctcagggctcccactgattctacattttggtgagatataattatttcattatatattaataataatagaaataaagtgcacaatgaatgtaatatacttgaatcatcctggaaccatcccccacctcaggttcctgtaaacattatcttccacaaaaccagtccctggtgccagcatggttggggacacctggttaacagatgtgagacccctttgccttgtcttggaataatgtgcagatatgcattgtgtgaatgacatctgatggcgccatcttgccctgtacatcattttagggacagctccagtatttcatgaaaattaaaatttcttctagtgacgaacaaaatgatactcagaagcaattttgtgaagaacagaacactggaatattacacgatgagattctgattcatgaagaaaagcagatagaagtggttgaaaaaatgaattctgaggtattttctttagttattttcaaatgtttttatatgtgtgtatattttaaagaactgtattttggaaatataaaggatttttaagtcatatatatgtgtgtatatattctatatatcctttgtcatatatctatatacgtacgtataggataaagccatgttcttaattcaccttcatttgcctgcaacagttgagtagtgacctgcacaatggcctcaatccaaaggagaagtatttgatgtttttcataagaattgatgatctttccacatcagaaataagttttgctactgaaaacagattttctcgtttttggacattagttttttaaaaaatgttaatagagaagtcaattgattatttttactgataagaaagtaggaaatgtatagctgggtcagaggccacattgtggataccattatccttacttttgcagagaggaacagtttgctccaagtagtttctcatttcagtgtaaagaggtttgaaaacaatgacatgccatgatacacatttagtaataatttattgataagtattttgtttctggagaaatagttcagtatatttcccctatttcaccattactactgtttcaaacattataaagaggaaataaaagttaccgcaatggcaaataatctcatgatttctaagaagatctctataagttgtatcttatttaccattcatattttgaaacaaaaggtttcttttgtatttatatatttacaccacagaagtaagtgtggttttgtggaggatcactagaagtagcatcagcagacctggggaaaatcctgcatctgtgtatattttttgacctctccttttaagaatcgcgatcttaaatgagttcagtattatatgtagaagagcaatgcctagatacagatgtgtacagtgtagaagggtacagtgcttagatttgacagttataaataaatgtaattcttataactgagtatagaaatattagaaatgtagaatatcggtaaaacgttcttcagtaaaagaaacttaaagaactttgagaaattgcttctgtccaaatatatgcatagctaaggctcttaggatggtgtggttgataggttagatatcagagtgtaaacctaatcttaaaaatgtagtcaaattattaatcttatattttatgcctctgggttttttgtaactcagaaaaaggcttttttaattctgggattcttaaaaatcctctagtgatttatttttcatcgtctttaaataaatatttaaacttttaggaatttaggagcagattcctaaaagtttaaatatttatttaaagacgatgaaaaataaatcactggaggaatttacactcttattaggtttgaagttttgtccaatttttttccagttaaatatccactatggggattctttcattatacaaatacatgttatttttgaatttcagaagaaatcatgatatgtcaatctattgagtgctaactaaaagttctctttgtttacttagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggctcccgaggagcaccccatcctgctgaccgaggcccccctgaaccccaaggccaaccgcgagaagatgacccagatcatgtttgagaccttcaacaccccagccatgtacgtggccatccaggccgtgccgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcgtggctataggttcaccaccatggccgagcgggaaatcgtgcgtgacatcaaagagaagctgtgctatgttgccctggacttcgagcaggagatggccacggcggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgttgccaaggactttgattgtacattgttcttcttttcaatagtcattccaaatattgtgagacgcattgtttcaggaagccccttgccctgctaaaagccatcccacttctctctaaggagaatggcccagtcctctccctagttcacacaggggaggtgatagcattgcttttgtgcaaattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaaaaaattgaggaagcacagtatttcagtacagtggacagcttagcatgttgacaactgagaataaaatgctcagttctgaactggacaatgtaagacacaacgaggaaacactggaaatggaaattcaattacgtcattgtagactggctgctgctctacatgattgtgaccaaagtcagatagctgaaagagacttctttccagagaacaagacatgaacaggtttatttacagaagacaatgaattctcatttatctcacctaaaagagaacagattctttctcaacaagtctaatgtagacagtaaaatcaacaggctaaaaattaagctccacgaaacaagataaaactctgagagaaaagacggggcaggccgccatctttcccgttcaggcaacttagtcattccagcctgcgggctttggagagtacaaaccgacgagggacagaagagatcccacagcacagcatagctgctttaccaaatcatggccagactgcttctgtaagcaggcccctgatcctgttccacctcactggacaggacctcccaactggggcctccagctacccccaccagcattccttggccaatggaaatgtgaaatgttcctgggacagagctcccggagaggggcaggcccccacctttgctcttttggtgactagccattctggcctgcgggctttggagagcccaagctgacaaggggtggaagaggtacctcagcacagcacagccacgctacaaaaacgtggccagactcttgtttacgtcagtccctgaccacatttctagtcagcgggtgaagtctttcaaccagggtctctggctaccttgactgctgttctctggccgacagaggtctcaggcctccctgagtcagagctcccagggggaggaccagattgtcatctttgctgtttgggtgacccagccatttcagccttagggcttcagagtgtctgaggtggaccaggggctgaagtgaacccccagcacagcacagctgctctataaaaacgtggccagacttttttttttgaagcaagtccctgttcttgttcgtcctgactaggtaagacttctcaacttgcctccagccacatcttataggtgtgttcagattggcaacaggttcgtacctcagtggtacagagcttccagaggaaggggcagactatcatcttccctggaaaatacaaggcaattagggactggaggggacccccagcataccacagcagccctacagaaaagtggccgggctctctacttgatgggcagatcctcctggcctgggtctctagccagcccaccactggagctatcaagccagtagcaactctgcagttcctgggacagagcttccaggagcaaatgaaatcctttctgccactgcctctgcagtggaactgcccttgctaccctcagaagatgcaagggagcaaagaccctaagtgccctatcaacacctccaataagctgcagttgacccaaagaacaagccagtccatctcccacgggtaccacacaccctccactactcatcaccagacagggaaccctggcttgggctcacagcacagaccctccatcctgggctgattacactaagtgattgctaactcacatgtctctgggatggagcacccaggaaacaagcaaagtggtggagcagcaagtcaggtgatgtggagcccagaggtcagggatggctatctctctagggtccacttgcccttgtgagacactttgtcccagcactttaggaatgctgaggtcataccagccacatcttatatgcaagattgcccagcagagatcaggtccgagagttccctttttaaaaaaaggagacttgcttaataaaagaagtctagccatgtttgtgtagagcagctgtgctgtgctgggggttcacttttgagagagttctcctctgagacctgatctctggaggctgggcagtcttgcacttgagatggggctggtctgatctcagcactccttagtctgctcgcctctcccatggccccagcctggccacacctgcttacggggcactcttagatgcccacaccatagcttccatgctagtggactgtaccatatcagtggagagctgcagcaaggtggcccctagagccacgcaccagcctgcacattgcctctccatacggcagccctttatttggaaacttcctaaatcactttgctgtgtgtgtttacacgggtgggttttgctttacttgccctgagagcacacgggagtgcagcacacaccccaacccacatcagctgccattaaagaaaagaaatttcagcccagaatttcatgtccagcaaaattaagcatcataagtgaaggagaaataagatccttttcagacaagcaaatgctgagggaatttggtatcaccagatctaccttacgagagctcctgaaggaagcactaaatatggaaagaaaagatcatcacctactactacaaaaacactgaagtacacagtccaatgatgctaaaaaccaagcacatatgtaagtctgcaaaataaccagctgacagcatgacgacaggataaaatccacacataccattactaaccttaaatgtaaatgggctaaatgctcccattgaaagacacggggcaagctgggtaaagaaccaagacccactggagtatgccgtcttcaagcaacccatctcacgtgcagtgccatacataggctcaaaataaaggaatggagaaaaatatttcaagcaaatggaaaacagaaaaaaggtgttgcactcccagtttctgacaaaacagactctaccaataaagataaaaaaagagaaggacattacaaaggtggtcctgacctttgataaatctcattattgcttgataccaacctgggctatttgtattgcccaaaccaataggataatttgctgaggttgtggagcttctccccttcacagagtccctgatctccgaaaatttggttgagatgtaaggttgattttgctgtacaactccttttttgaagttttactcatttccaacaaggaaggcaagttttcctgcttccattgacaaaggagagcaggcacctcctttcctgagtttcagcttgcttctgacagggaaggtgagtgtaagtttttccagcttctaagatggcagagaatgatcacccagtctgagccttatttccaggtaagtagcagaattagagttttgtcttaaaatttttgtttaatgactaaaatttaagattacccatcagctgcttttaattcctccttaccattagaacactcagttaatcatatgaattgtgcatttgtttgttttgcttaactctttttgtttatgtttggggttttattgttgtttcacttttctcccatctcttcctgacttggtcaaatccaaaggaatgttccaaattgtggggagcaaggcatctgaattggctaaaactcctgtggctgcaaaacaaaaacaaaaacaaaacaaaaaaaaaacataaaaaacaaaaaaatccagttggaaattttttaaaacttttttttaatttttaaattttattattatactttaagttttagggtacatgtgcacaatgtgcaggtttgttacatatgtatacatgtgccatgttggtgtgctgcacccattaactcatcatttaacattaggtatatctcctaatgctatccctccctcctcccccaccccacaacagttctcggtgtgttatgttacccttctgtgtccacgtgttctcattgttcagttcccacctacgagtgagaacatgaggtgtttggttttctgttcttgtgttagtttgctgagagtgatgatttccagcttcatcgatgtccctgcaaaggacatgaactcatccttttttatgggtgcatagcattccatagtgtatatatgccacattatccagtctatcattgatgggcatttgggttggttccaagtgtttgctgttgtgaactgtgccgcagtaaacatacgtgtgcatgtgtctttatattagaatgatttattattttttcagtatatacccagtaatgggattgctgggttaaatgtatttctagttgtagatccttgaggaattgtcacactgtcttccacaatggatgaactaatttatactaccaccaagagtgtaaaagcgttcctatttctccacgtcctctccaacatctgttgtttccttatcttttaatgttggccattctaagtggtgtgagattgtatctcattgtggttttgatttccatttctctaatgaccagtgatgatgtggtttgcttcacatgttctttagctgcataaatgtcttatttgggaagtgtctgttcatatgttttgcccattttttgatggggttgttttttttcttgtaaatttgtttaagttctttgtagattctgcatattagctgtttgtcagatggatagattgcaaaaattttctcccattctgtgggttgcctgttcactctgatgatagtttcttttgctctgcagacactctttagcttaattaggtcccatttgtcaattttggcttttgttgccattgcttttggtgttgtagtgatgaagtctctgcccatgcctatgtcctgaatggtattgcctaacacaaggacatttctgtgcctgagtgccataccacccaaagtgatttatagattcagtgctatccccatcaagctaccattgactttcttcacaaaattagaaaaactactttaaatttcatatggaaccaaaaaagagtctacatagccaagacaatcctaagcaaaaagatcaaagctggaggcatcacagtacctgacttcaaactattctacaaggccacagtaacggaaacagcatggtactggtaccaaaccaggtatatagaccaatggaatggaacagaggccacagaaatgacaccacacatgtaaaaccaccagatctttgacaaaactgacaaaggtaagcactggggaaaggattgcctgtttaataaatggtgttaggaaaactggctagccatatgcagcaaactgaaactgggccccttccttacactttatacaaaaattaacttaagaaggataaaagagttaaacgtaagacctaaaagcaaaaaacctagaagaaaatgtaggccaccaacctcaggggaaatgtacttgtagtgaaatgcatggtacaaacacgcattccctacttccttgagtgggtgaggttggtggctggtccatctgctccaagtggacccttacagatgtggctggttgctctttgagccagcttggccttgcccggcatgcacaagcatcagtgaataactgtgctataaatggagccacatagaggaaatgagcagcaggctcaagaccatggtgtgcactgcctttggcgctccagtccgtgcctcagggatggtatggcactgcgagcttcttgtttgccaagaggcagaccacaggccatcttgaggaggactttatgttcaagtgcagaaaacagccaggattaccacccaggggacttggccttctgtggccgtggccagacttagaatttgtgtcagggcagggcaagctcactcggagcagcgtgtcggtacctggggcctgtgcatgccagggaaggccaagctggctcaaagagcaaccagccacctctgcaagggtgcgcctggaccagttggactagccaccaacctcacccacagaaggaagcagggatgaccaggttacaggagcctgagtagctgccacctgagggctgatggagcagaggcctgaggaaaatcagatgacatgtttaactgtttaatggatcttgttaatttttctataaagcagatgtcaccagtccatgcctcagagctcgtatggcactgcagaccacagaaggccgagtcccctgggtggcaatcttggctgctttctgcacttgaacataaagtcctcctcaagacggcctgtggtctgcctcttggccctacctttagggtagaagaaccgatgtaccatgttcggcagcaagtgaggttggtggctggtccggttgctcctggcaaacccttgcagaggtggctggttgctctttgagccagcttggccttgctcggcatgcacaagcctcagtgcgactactgtgccacaaatggagccacagagaggaaatgagcagcaggctcagcagcagggtgtgcgctgtctttggggctccagtccatgcctcagggctcgtatggcattgcaggcttcttggttgccaagaggcagaccacaggccgtcttgaggaggactttatgttcaagtgcagaaagcagccatgattaccacccaggggacttggccttctgtggccctgtccagacttagaatttgtgtcaaggcaggagaagctcactcggagcagcgtgttagtacctggggcctgtgcatgccaggcaaggccaagctggctcaaagaccaaccagccacctctccaagggtgtgccaggaccaggtggaccatccagcaacctcagctactcaaggaagctgggatggccagtttccaacagcgtgagtggctgcgtcctgatggatgatggagcagaggccttaggaaaagcagatggccctgtggccctacctttagggtagaagtactgatgtgccatgtgtggcagcaagtgaggttggtggctggtgcaccggctcctggcacaccctcgcagaggtgactggttgctctttgagccagcttggccttgcccggcatgcacaagcctcagtgcaacaactgtgctacaaatggagccacagagagaaaaggagcagcaggctcaggagcagcatgtgcactgcctttgggcctgcactccatgcctcgggtcatatagcactgcgggcttcttgcttgcctagaggcggaccacaggccatcttgaggaggactttatgttcaagtgcagaaagcagccaggattaccatccaggggactcggccttctgtagccctggccagaccttgcagaggtggctggttgctctttgagccagcttggcctccctggcatgcacaggccccaggtagtaacacgctgctccgagtgagcttgtcctgccttggctgccacctaattgctgatggagcagaggcattaggaaaagcagatggcactgcggcccacctttagggtagaagaactgatgtaccatgtccggccgctagtgggtgagtggtgcacctgctcctggcacacccttgcagaggtggctggttgctctttgagccagcttggccttccccggcatgcacaagcctcagtgcaacaactgtgctacaaatggagccacagagaggaaacgagcagtaggctcaggagtcgggtgtgtgctgcctttggggctccagtccatgcctcgggtcgtatggcactgtgggcttcttggttgccaagaggcagaccacaggctgtcttgaggaagactttatgttcaagtgcagaaagcagccatgattgccacgcaggggactcggccttttgtggctctggcgagacttagaatttgtgtgaaggcaggagaagctcactcagagcagcgtgttactacctggggcctgtgcgtgtccgggaaggccaagctggctcaaagagcaaccagccacctctacaagggtgcacctggaccagttggaccagccaccaacctcacccactgaaggaagcagtgatggccaggttcccacagcctgagtggctgccacctgagggctgatggagcagaggcctgagtaaaatcagatggcatgtttaactctttaatagatcttaggttaatatttctataaagcagatgtcactagtccatgtctcagagcttgtatggcagtgtagaccacagaaggctgagtccccttggtggcaatcctggctgctttctgcacttgaacataaagtcctcctcaagacggcctgtggtctgcctcttggccctacctttagggtagaagaaccaatgtaccatgtcccgcagcgagtgaggttggtggctggtctggctgctcctggcacacacttgcagaggtggctggttgctgtttgagccagcttggccttgcctggcatgcacaagtctcagtgcaacaactgtgctacaaatggagccacagagaggaaatgagcggcagagttaggagcaggatgtgcgctgcctttggggctccagtccatgcctcgggtcgtatggcactgcaggcttcttggttgccaagaggcagaccacaggccctcttgaggaggacttcatgttcaagtgcagaaagcagccaggattaccatccaagggactcggccttctgtggccctggccagactcagaatttgtgccaaggcaggacaagctcactcggagcagcgtgtcagtagctggggcctatgcatgccaggcaaggccaagctggctcaaagagcaaccagccacctctgcaagggtgtgccaggagcaggtggaccatccagcaacctcagctactcaaggaagctgggatggccaggttccaacagcctgagtggctgcctcctgatggctgatggagcagaggccttaggaaaagcagatggtcctgtggccctacctttggggtagaagtactgatgtgccatgtccggtagcaagtgaggttggtggctggtgcaccggctcctggcacaccctcgcagaggtggctggttgctctttgagccagcttggccttgcccggcatgaacaagcctcagtgcaacctctctgctacatatggagccacagagaggaaacgagcagcaggctcaggagcaggctgtgcgctgcctttggggctccagtccaagcctcgagtcgtatagcactgcgggcttcttgcttgcctagaggcagaaaacaggccgtcttgcggaggactttatgttcaagtgcagaaagcagctaggattaccatccaggggactcagccttctgtggccccggccagaccttgcagaggtggctggttgctctttgagccagcttggcctccctggcatgcacaggccccaggtagtaacacgctgctctgagtgagcttgtcctgccttggctgccacctaattgctgatggagccagaggcattaggaaaagcagatggcactgcggcccacctttagggtagaagaactgatgtaccatgtccggccgctagtgggtgagtggtgcacctgctcctggcacacccttgcagaggtggctggttgctctttgagccagcttggccttccccggcatgcacaagcctcagtgcaacaactgtgctacaaatggagccacagagaggaaacgagcagtaggctcaggagtcgggtgtgtgctgcctttggggctccagtccatgcctcgggtcgtatggcactgtgggcttcttggttgccaagaggcagaccacaggctgtcttgaggaagactttatgttcaagtgcagaaagcagccatgattgccacgcaggggactcggccttttgtggctctggcgagacttagaatttgtgtgaaggcaggagaagctcactcagagcagcgtgttactacctggggcctgtgcgtgtccgggaaggccaagctggctcaaagagcaaccagccacctctacaagggtgcacctggaccagttggaccagccaccaacctcacccactgaaggaagcagtgatggccaggttcccacagcctgagtggctgccacctgagggctgatggagcagaggcctgagtaaaatcagatggcatgtttaactctttaatagatcttaggttaatatttctataaagcagatgtcactagtccatgtctcagagcttgtatggcagtgtagaccacagaaggctgagtccccttggtggcaatcctggctgctttctgcacttgaacataaagtcctcctcaagacggcctgtggtctgcctcttggccctacctttagggtagaagaaccaatgtaccatgtcccgcagcgagtgaggttggtggctggtctggctgctcctggcacacacttgcagaggtggctggttgctgtttgagccagcttggccttgcctggcatgcacaagtctcagtgcaacaactgtgctacaaatggagccacagagaggaaatgagcggcagagttaggagcaggatgtgcgctgcctttggggctccagtccatgcctcgggtcgtatggcactgcaggcttcttggttgccaagaggcagaccacaggccctcttgaggaggacttcatgttcaagtgcagaaagcagccaggattaccatccaagggactcggccttctgtggccctggccagactcagaatttgtgccaaggcaggacaagctcactcggagcagcgtgtcagtagctggggcctatgcatgccaggcaaggccaagctggctcaaagagcaaccagccacctctgcaagggtgtgccaggagcaggtggaccatccagcaacctcagctactcaaggaagctgggatggccaggttccaacagcctgagtggctgcctcctgatggctgatggagcagaggccttaggaaaagcagatggtcctgtggccctacctttggggtagaagtactgatgtgccatgtccggtagcaagtgaggttggtggctggtgcaccggctcctggcacaccctcgcagaggtgactggttgctctttgagccagcttggccttgcccggcatgaacaagcctcagtgcaacctctctgctacatatggagccacagagaggaaacgagcagcaggctcaggagcaggctgtgcgctgcctttggggctccagtccaagcctcgagtcgtatagcactgcgggcttcttgcttgcctagaggcagaaaacaggccgtcttgcggaggactttatgttcaagtgcagaaagcagccaggattaccatccaggggactcagccttctgtggccccggccagaccttgcagaggtggctggttgctctttgagccagcttggccttcctggcatgcacaggccccagatactaacacgctgctccgagtgagcttgtcctgccttggctgccacctaattgctgatggaacagaggccttagggaaagcagatggcactgtggtccacctttagggtagaagaactgatgtaccatgtccggccgctagtgggtgagtggtgcacctgctcctggcacacccttgcagaggtggctggttgctctttgagccagcttggccttccctggcatgcacaagcctcagtgcaacaactgtgctacaaatggagccacagagaggaaacaagccgcagggtcaggagcagggtgtgcgctgcctttgggcctccagtccatgcctcagaactcgtatggcactgcaggcttcttggttgccaagaggcagacaacaggctctcttgaggaggactttatgttcaagtgcagaaagcagcccggataaccatccaggggacttggccttctgtgaccctggccagactcagaatttgtgccaatgcaggacaagctcacttggagcagtgtgtcagtagctggggcctatgcatgccaggcagggccaagctggctcaaagagctaccagccacctctgcaaaggtgtgccaggagcaggtggaccagccaccaacttcagccactgaaggaagcacggatggccaggttccaacagcctgagtggctatcttctgatggctgatggagcagaggccttaggaaaagcagatggccctgtggccctacctttatggtagaagtactgatgtgccatgtccggtagcaagtgaggttggtagctggtgcaccggctcctggcacaccgttgcagaagtgactggttgctctttgagccagcttggccttgcctggcatgcacaagcctcagtgcaacaacagtgctacaaatggagcgacagagaggaaacgagtggcagacttaggagcagggtgtgcgctgcctttggggctccagtccatgcctcgggtcctatggcactgcgggcttcatggttgccaagaggcagaccacaggccgtcttgaggaagactttatgttgaagtgcagaaagcagccaggattaccactcaggggacttggccttctgtggccctggccagactcagaatttgtgtcacggcaggacaagctcactcggagcagcgtgttagtacctggggcctgtgcatgccaggaaaggccaagctggctcaaagcgtaatcagccacctctacaagggtgcgcctggacctgttggaccagccaccagcttcacccactgaaggaagccgggatggccaggttccagcagcctgagtggctgtctcctgatggctgatggagcagagtccttaggaaaagcagatggccttgtggccctacctttagggtagaagtactgatgtgccatgtctggcagcaagtgaggttggtggctggtgcaccggctcctggcgcacccttgcagaggtgactggttgctctttgagccagcttggccttgcccggcatgcacaagcctcagtgcaacaactgtgctacaaatggagccacagagaagaaatgagcagcaggctcaggagcagggtgttcgctgcctttggggccgcagtccatgcctcaggcatcatatggcactgcgggcttcttggttgccaagaggcagaccacaggccatcttgaggaggacttcatgttcaagtgcagaaagcagccaggattagcatctaggggactcggccttctgtggccctggccacacttagaatttgtgtcaaggcaggacaagctcactcggagcagcatgttgctacctggggcctgtgtatgccaggcaaggccaagctggctcaaagagcaaccagtcacctctgcaaggatgcgcctgtcgtctggaggttggtggctccctgtgttagtcctccaagcccatattttccttctgcactgccctcgcagaggtttctgaagaggctctgcctctgcagcatgcttctgcctggaaacagtgggaggtagttttgcagggtggaagccttcaccagtggttaagcaccatcttcatgatgctgacctcgtgatagttctcatgagatctgcttgtataacatgatgtggcacctctttcctctctgtcttgctccttctcctgctgtatgaaacatctccttgccccttggtcttctagtatgattgggaggcacctgagtcctcccagaagcagaagccactgtgcttcctttgcagcctgcagaactgtgagccaatgaaacctcttttctttttgatcatacagaaggttagtactgtgaagtgaagctatgaaattccttcaaggccttttccctatgaaatgccttcaaggccttttccccattgtcttggcaagcagcactcagcttcttttcatgcaaatatctgaagcctgtgtgaattttttccctgaaaatggacttttcttcttttaccacattgccaggctgtgacacagagagctgataatgtagaagcaggttcagtagtgggtaaaagacagaggtcgggagagttgggaaagcttaaaagacagcaagatgaggaaaagcttggacccctgtagagaattgttaaatacttgtgatcagaaggctgacagaaggatggacagtgaaggccagacttaaaagttctcggataaaaatcaggaatttcctgtgaataggagccaaagctacatttgatttgcccaacagaggctgcacagtgaccttgccctggagatctgtgaaactatgaacttgggggtgatgatttaggatgtatcttgtggaatgaacatctaagcagcatagctcaagaggtgtcctgtctgcgtcgagcagcctgtgttatgtatgagctaagaaaggacctcaagttggaacttctacttagaagcggagctcaaaagtttggaaaatttgcagcctagtcaagtggtcaaaaagaaaagctgattttcagggcgaaaattcaataaggcttagagtatttgcataaaaaggaggttagtgcaagtgtccaagacaaagggtaaaaggccttgaaggcatttcagagacctttgcagtagcctttgctctcacaggccctggggcctagcagagaagaatggtttcctgggccagttccatggccctactgctgtgtgcatcctcaggacactgctgcctgcatccctgcagccccagctccagccatggctgaatgatgcacaggtacagcttgggtcactacttcacatgtggctccaagccttgatggcttccacatagtgttaaggcagcaggtgaagagagcaagagactagaggctttggagcctcttgtctggactccagaggatgtagagaaaagcctgggtgtccaggcagtagcctttccaagaggctcatggaaaacctctgctagggcagcaaagaagggccatgtagtgttgaagccccctcacagggaggctccattctccaaaccccagattcatagacccaccaacatcttgcaccctcagtgtggaaaagctacaggcattcaaaacagccctgtccatgagaggcagctgtgggtgctgaacgctgcaaagccacaggtgcagatctgcccaaggccttgggagcccggccctcagccctgtgccatggatgtgggacgaggattcaaaaaggatgattttggagctgtcggattgaatgactggcctgctgggttttggatgttcatgtatcctgtgagtcccatctgtgttttgtttttctttctggcattttttttctactggctgggaatgcttacccattgcatgtacaattattgtaccttggaattagttaacttgctttataattcagaaactcaggggcagatcggactgtagccttgtctcagacgagactttgggctttggacatttgagtaaatgctggaattatttaagatttgggggcctgtggggaaggtatcattgtattctgcaatgtaagaagcaggagatttgggggaccagggacagaataatataatttggctctgtgtccctaccaaagctcgtggaattgtaatgggcaaagttaaaggtggggactggtggaaggtgatttaatcatggtggagagtggagtttggaaggtgggggtggttgggagcattgggggggattgtgttggggttgtggggaaaggcagaggtggggggcagattcttcacaaatggttaaacaccatctttgtaatgctgtccttctgacagtgagtttgcttcatggtttaggagctttgagatttgaatactggcctgctgggttttggatgtgcattgggcctgtggtcccatttgtgttatttttctgggaaatttcttccctttggagtgagaaagcttacccaatgcctgtaccatcatcgtaccttaaaagaactccattttaagttcagggactcattggcagaagagaccgtagccttgtatcagataagactttgaacttcttacatttgggttaacgctggaatgagttaaggcttttgtaaacatttgaaaaggcatgactgtattttactctgtgagaatgacatgagattcgggggagggggtcaaggtcagaataatatggtttggctgtgtttccctagaaaaactcatgtggaattgcagtcccgaatgttggaggtggagcctggtgggaggtgatttaatcatggatggggggtgggtggggttggagggaaaaagaggtgggtagcgtggtgaggagtaagctcgctgtagggtggtgggagggtgggggtagtaggaaggaggagtagcctgctgcagaggcagaggctggtggaaaacctctgctaggactgtgcacctgtggctttgcagggtgtagcccccgtggctgctctcatgggctgggctggtgttgagtgccggtagcttttccatactgaaggtgcgagctgttgatgggtctatgaatctggggtctggaggatggtggcctcctgcataggggctccaagcccatatttttcttctgcactgccatagtacaggttttccaagaggctcaggctctgcctcaggcttctgtccagaaacagtagggggtggaggtgggttgggggcggatccttcactaatgattaagcaccatcttcttgatgctgacctcgtgatagtgagttctcatgaacttcctcatagtgttaagccactggttggatggagcatgagcctaggggcttgggaggctctgtatagattttggaggatgtatggaaatgtctgggtgtccaggcaaaagccttcctaaagggcagaacctcataagaaacctctactagggcagtacagaaggaaaatatggggttggagaccccacactggaggccaccatcatgaagactgcagattaatagaccccgcaacagcttgtaccgtcagtgggtaaaagctacaggcgctcaacaccagcccagcccatgaagacagccgtggggcataaaccctgcaaagccacaggtgcagagctgcccaaggccttgggagcccagcccttacatccctgtgccctggatgtgggacaaggtttcaaaaagggtaattttggagctgtaggattgaatgactggccttctgggtttggagtttcatggggtctgtaagtcctttctgtgttttgttctttctggcaaaattattccttttggctgggaatgcttacccattgcctgtataagcattgtaccttggaagtagttaactttctttatatttcagaggctcatgagcctaagggtctgcagccttgtgttagatgagactttaagctttgaatatttgtataaatgatgaaatgatataagactttgggggactgtagggaagctatcattgtagtttgcaatgtgagaaggacatgagatttggggagccagggacagaataataaaatttagctctgtgtccctaccaaaattcgtgtggaattgtaatggggaatgttaaagttggggcctggtggaaggtgatttaatcatggtggagtgtgggggttgggaggtgggggatagggagaatggggagattatgttgggggtgaggggtgaaaagtgatggtggctccttcacaaatgattagacacaatctctttatttctgtacttgtgatggtgagttctcttcatgattttggagcagtgagattgaatggatactggtctcctgggttttggacttgcattggtcctgtggtcccatctgtgttattttgctgggaaatttcttcccgttggactgagaaagcttacccaatgggtgtaccatcattgtgtcttaaaagaacacccttttaaattcagggacttataggcaaaagggactgtaggcttgtctcagatgagacgttgaaccttttacatttgagttaatgctggaatgagttaagacttttggcaacttttgaaaaggtgtgattgtattttgctctgtgagaaggacatgagattcggaggggtcagggtcagaataacatggtttggctgtgtttccctacagaaactcatgtgaattgtaatcttgaatgttggagatggggcctggtggaaggtgatttaaccatggatgggagggggttggagttggaaggaaataaagtggacagtgttgggaggagtgggttgtcagtagggtggtgagaggatggtgggtattaggaagcgggagtagcctgctgcagagtcacatcctcatggaaaacctctgctagggcagtgctcctgtggctttgcaggctttagcccccatggctgctctcatgggctgggctggtgttgagtgcttttgcatactgagggtgcgggctgttggtgggcttatgaatctggggtctggaggatggtggcctcctgtgtgggggctccaagcccatatttcccttctgcactgccatagtggaagtttcccaagaggctctgcctctgcaggaggcttctgcctggaaacagtaggcggtggtgtgtgtggtggatccttcaccagtggttaattttgatgctgatctgatagtgagttctcatgtgatctggttgtataatgggctgtggcacctcttttctctctgtgtcttgcttctatttctgccatatgaaacatctgattgccacttggccttctgatgtggttaggaggggcctgatcagtgtgggcctgctcagtggacctagtcagttgggacttggtcagtgaggcctgtttagtgggagcctggccagcaggggtctgcttagggagggtctcattagggggatccagtagtgggggttttggcgagtggggacctattggcagccagttgtttggtgtctggtcagtgcagacctgggctgtggggcttgaccagtggcgacctggtcagctgggcttagtggtggcctggtcagcatgggctgggtcactggtgaccaggtcaagggctgctattcagtggaggactggtcacatgggacctagtcagcagggcctggtgggcgtgtcctcatcagtgagtcccttgtcagtggggacctgatcagggcagcctggtcattggaacctcatcagtgggggcctggtcagtgatgacttggtcagtggtggcttttgtagcactggtctatggggtgacccagtcagcggggacctgagtagtcggtgcctgttcagtggggcctactcactagggtcccagtcaggggcatctggtcacctcaggcctggttagtaggggcctgatcagtggcagcctgttccctggaggcctggtcagtggggcctcatctgtggggccaggtaatggggtcatgatcagtggaatctgatcagtgaggccttgtcagtaatgacctagtcagtgaggccttgtcagtaaggacctggtccatgaggccttgccagtgaggccttgtcagtaaggtcctggtcagtgaggccttgtcaataaggaccttgtcagtgaggccttgtcagtggggccttgtcagtaaggacctggtcagtgaggccttgtcaataaggtcctggtcagtgaggtcttctcagttaggacctggtccatgaggccttgtcagtggggccttgtcagtaaggacctggtcagtgaggccttgtcaataaggtcctggtcagtgaggacttgtcagtaaggacctggtccgtgaggccttgtcaataaggtcctggtcagtgaggaattgtcagtaaggagctcatccatgaggccttgtcagtgaggccttgtcaataaggtcctggtcagtgaggccttgttagtaaggactttgtcagtgaggccttgtcagtgaggcctggtcagtaaggtcctgttcagtgaggccttgtccgtgaggctttgtcagtaaggtcctggtcagtggagtcatggtcattgttggcctggaagcaggggtcttgttagtgggtcctggtgatggggatctaatcagtgagggtgtggtcagggaagacctgatgtgtggggtctggtcagcaggaacctggtcagtggggactgctgagcgctgcttggagaagccaggtgcattgcacgttatcgagggccctctggacagctgggatggcccagtgatgcccaatggcccggtcaaaagtagacaaagcagttgtttggatggacctgggagatgttgctcagagattctgacaggacaaaggtgaagaaagggtcagagtgtctggagagatggtcacagtctatgggctgcacaggatggagaaagccagggaacaggcagggtgggcagtggggtgcagggagaggcaggtgcatggtgggacgtcagaccctgtgaaggctgtgagggtgtcaggtgggttgggctccaggtgcaccctcagtgcactgggtgggtctcaccccaagctccctggaccccagccaggtgatgtggtcactccctgggggactgctctcaggccccggctacctaccctgggcagcgctgtcccatctcaggactggactttctcagatcctgtagagggcacagactccacccaggaggggcaaccgcatggtgcagcctgagctctccatgggcctggagcatcccctgccagccttgtgctccccattctcccaggtcccacttttccagtgtcagccagcagggatgccccgtcctcccttccccatgtgtctcctaggctgaaacttgtggcagattgggacagggatggtgcttccctcaggcccatttggggaggggactggctcccagactggtgcaggtcctcagctctgcctcgactggcttagagtgagatggatcagtcagttccctgaaggtgaagattagagactgtccctgctgttgggaggctagtctagggatggaggacttaacaggtcctcccaggctgtcaggcctgggcagcactgtcttgtcttaggactcagaaagtccagtcctgagatgagacagtgctgcccagggcgggtgtctgggacctgacaacattcccccagtgattgaccacatcacacgtccagggtccagtgagcctggcctcagacgtgcccagtacactgaaggtgcacctggagcccactccacctgatgcctccacagccctcgcagggcctgacctcccagcatgcacctgcctctccctgcaccccagctgtccaccatgcctgttccctcacttcctccatcctgtccagcgggatgggatggacatgggaacagcctgtgtgcacatttcgtggcgagtgggaatgacacaccatctctgggaggcaccatggttcctggcaaacccgatcccaagactttatccttgaggtggttttaccaaaccccaaacccagaactgcggttgtggctcaggggtcagctcctgctagtgccaggacactactgggaggctgggacccgaccaaagcccatggtgtctctggcctgaggaccaggtgtcttgggaccataaggccaggccaccaatggccattgggtcataggggctcagccccaatctttgtccttccctggctccttctgattcagtcccatcagggccctggatcccaagactcagcatccaaggtcccctccaggaatcctggcagctcagcatactttatcctgtttcatctgagagcaaaaatgtaaaattggatgcacagaaaagtgactcaaagtgcttaatgactagaagaaatctaggagcagcaagaaggtaatgtggagggagggacctccatgaccggtgtctgtagagccaggggtacaggcacccagtgctgtggcctggcaccacctgcatctcagagggtgggtggcacactccttaaccagaggacagcaggcctggtcaccagcttttctacctgtccctgtaagcatcacattgctggaggaaaatctcatgccagagcttggaccatcccctagctcaggggttaggggttgtcccttggtgacctaaatgaaaaaacaggtccagaacagagttcctgatgctggacactcattcagtctttgaatcgtgggaggggaggcctggtactaggtagacctaacctctttgaggaaccacagagcccaaggctggaaacctccagaatcctccacccccttatcctccctggggacccctgtggcctgtctcactgagcactcttccatctgtagatgtctgggctgctgtacaagggagtcccctttcaggtgtggtgctagacatggtcactcctgctggatgtctaggtggtagaaaccaaggacctagggaaataccaggtacagcctttccacgctcatccagagcaggacaaacaggccaggcggtgtcaggagcccaggtctccagctggagggaacgtcaaccctgcagtgggagcaggggccctttgcacatcctaggcacagatggtaatgtagacaccacaggtaagctgggcttggtacctacccctccccggattcagaaagaaaccaaacaaggagctttgtgtggaatgaaacctcctttcctcccagaagcactgctgattgtttggtggttgccatttgtggcagtgagcccttgtttgttctgaggttgggctggtttctcctcttggccctgccctacagatcataaaggagaacagcaagacgtccccagcaaacatccacagatggccttggaaataagtcaccttgtgagaaacatgtcatgttctgggagggataaggcatcaagtaaggcctatggggttggaggatccctgggcaggtggggcaatccttggggtcttcccatgggaatagggaggtcctgaggcagaggcaggggttccacaggaggagtcacagagctaccaagggctctcctgtgccaggaagcagtcaacaccatgaactgaacacctgctgggctccaagccctggtccaggctggggcatgtggggccaggaggcagctcagagagggaggcagagagaagtgtgctgagagggcacccatttctgggtgtaatgtggtccagagattttggctgggaagggcttccagagtttcatatgtgttacggagctgcttcctctccctagcctcaccctgcaggaatgccagtgaacatattgctgacatcttggagctcagtaccctcatagtgtaacggcgtcagtagatctgcctgtgctgggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccgggatcttaattcaggaggtagaatggagcttgagatcaagtgtctgatcaaggtacttgaacttgatctggagggctctggggagccatggaaggtgctggataaaggagtgacagtcagctatgttttcgagatgactgtagaaggctgcctggaaggagtgaacaagagccaggagaccagggagggagcttgtggggcaggtctggagatggcaaaggagggatcctgcttggatgaaaggtcttcagggactgtctcaggttacacacaggtgtcctcagagctagtgtgttcagagtcttgcctccaggatgaaaatgggaaggagttgtcagacgaggacatataaatggaggctggcatattcatgagtgctggtggtggtcccggtgtgggactactgtgggaacaggggtctctccatccagggatatgatggatggaccctacatcactccattctgcccttcctttccctcctcccattctcccgaaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatggtgggtgcagggcctcatggcctgttccccagcccctctcattggctctgctccaggtggtgaagggggaaaatgtttttgtcaattctgtcatgattgcctagcaagaaaaggagcagaaccaagaagcagtaaaatcagttagtaaaatcagttttcttttctgaactacatttctaccatctctaattgaggggaattccttcgactccacgaggttgcttggagaatgactgacagtgtatgtagagcaggtgccagccagcaggcgtttggtgtccagaccactctgcccccttgattttctgcctatattttcattttgttcccaagaccctcactccccttaattttgcttttccctctgattcccaccttatcttctatcccatggattcaccaggatgtaagtgggtaacagttatctatgcatgtatgtgtatgtatgtatgttctctgttggtgttggagtatggtgtgtgtgtgtgagagagtgtgtgtgtgtgtgtgtgagagagagagagaatgtgtgtgtgtgtgtgtgtgtgtgtgtgtgtgtgtgttggggtcactgagggactgaaactctccacaccaggctgtggtcctgctcactgctggaggcgctgtcagggctcttgccattgaccctccaggtctcattcttgcagtgcaggcagggcattctggaggaatcatgtccttggaagaagccctgaggagtgactggtgtgtattggtggataaataacccagctcccttgctctgggtgggatgactctgaggcacatgttctatgctgtctctcagaggtacccggcagggctgagtcctggctgcccacagtagaaactttcttgatgaaggtccctttaactgctacattccattcctgtctcagttccccactcctctactggtgttgcctgcaattagtactctaaggaagaactggcagtagaattactgtcctggagtcatctccagataaaatttttatacttgaatctttgcctcaggatctacttccaggaaacttaaactaagacacacatttttctttcctccaatcttcatagacctgtcgttgtgctgtttttaccaaaaaggatcatgaggatcagagaggaaaagtcacttgcccaaagtcacacagctgaacagtggtggagttcaactttgaccgtgggctgtctggccccaaggtgtatgcttgcttctctcccaagagactcctttcttatcaggctcaaatgaatgaaaggaggatgttaaaggtaggatctctgaagcctgtgccagtggaaccgcagctcatggctggcacctgtgttctcattcttacctcattaagagtaaagtttattgagtttattgaatttaagtatctttagtgagatcatatattattagtaagaactgggaccaaacagattttctgactctaaaagagagattttcacagaaacagatatatacctataagtatacagacacgcatacacacatttctttactgctcataaaaattagtccttattagaatgtgggatgtataaatgtaagagaattttcatgttaaaattgacagatacatttttaaattgtcctaaaagaaatttaattatttttcttttagaattttccattattaatgttatttttatgggaaactatataactttattgataatacatacgataaccctttgtttttcacattgaaaatacagtgtattttgcaaataactaagtcctaattttgtattaaaattttaaattttcaatcttttttttattatattttaagttctgggatacatgtggagaacgtgcaggtttgttacataggtatacacatgacatggtagtttgctgcacccatcaacctctcatctactttaggcgcttatctacattcggtgctacattatgatatggagaaataggaacgcttttacactgctggtgggagtgtaaattagttcaaccattgtggaagacagtgtagtgattcctcaaggatccagaaccagaaatacatttgacccagcaatcccattactgggtatatacccaaaggattataaatcattctactataaagacacatgcacacatatgtttattgcggcactgttcccaatagcaaagacttgaaaccaacccaaatccccatcagtgatagactggataaagaaaatgtggcacatatataccatggaatactctgcagccataaaaaaggatgagttcatgtcctttgcaggaacatagattaagctggaagccatcattctcagttaacgaacacagaaacagaaaaccaaacaccgcatgttcactcataagtgggagctgaacaatgagaacaaatggacacggaggggaacatcacataccggaacctgtcagtgggtggggggctagaggagtgggggagggatagcattaggggatttaataattttaaaattcaattctgttgaaatgtttactccaagaagcaatgtgtttttgagagctaatcctgatatattcaaatcttaacgacttaagttgatggagtggacttcttttaaattagtgattccctaatttacctgacagttggaatttccaggccatgttgaaaatacagattatccagactcttacctctgcagatgtatttagtggttctaaaatggcacccaggagtctggatttttcccaggggccttgtgtaattcacactgatgaccaggcaagtttgggaaattgtgccttaaggagatttttcattaagcagtcttcatttgaaaagaggatcatttatcttctaataccccatgcttcctctttctcctgctctctttgtctcctgttgtctttcagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggtgcaggggtgagaggcagggaaatggagacccccacagccagcatcagtggccctcatcacagccctccaggagatatcaaaggaggtcagaccttggacagtagtcttgacttcctgctatagaacacattgttaacactgaaaaagatgatctgttctaggggaatggtgaaagctgactctagcacttgtgctttttgtttgtttgtttgagattgagtcttgctcttgtttcccaggctgcagtgcaatgcgtgatctcagctcactgcaggctctgcctcctgggttccagctattgtcctgcctcagcctcccgagtagctgggattccaggtgcccgcaagtgtgcctggctaatttttatgtttttagtagagatgggatttcgccatcttggccaggctgttctccacctcctgaccttggccaaagtgttgggattacaggcataagccattgtgccggacctgtgtttttaatttcatcatggcacagcttcaaaatgacatctaagtagctgacataaaaatgaaaattctgtgtactttgatattagcaggcttcaaatacaaaccagaatatgagtaaattgtttcttaaccaaactgaataattttcacattggcaggccattggtaggccattcagcatctggctcatgtttgggccaagctgggtgcctcatgaaagtctggagggaaatacagagggcaattctccataagcattaggctcagaaatatcctgcttcccagtgaaaagtttaagttgactttcacgccaccttcatcaaaccgaggttggtcaacacttttcaccactgccactggacactttgacttccaattttgctacctgctgtacaaaggtacccccttctttcctttcctgcattctccctacaaccttgtctttttttgagtacatccactctgtctcatcattgtccatctctgcttcccaaaaccttatatagtacagaaattggccaatcaagattaccatgtggaagagcatccatttactgaataaggtagctggctcctgggggcagaaaagtgattagacacagagataaaaatcataatccctgctctcctggactcactgtctagtgggcagacagacagatgaacaaatacaacttgataactacaacaatcaagtgaattatataatttagactggagagagagagagcaaacgttatcataagacagtgtgtccactacttactctctaacagatttcctcataaaccactaggcttgccaacttgttgaatgagaaaattggagggtcaggggaggggaaatccatatgcttcttagtatttcattccataaatacataaataatgaaaccattaatgatatcatcatgttgattcaataagtttgaaagcaaaattgatagtaatctttggaagaaattgtatatgtgtctatgtatgtacatacatagacatacatattgctttctgaaattttcaatgactttatgcttcttctgaagcaattcgagtttagtatttgagacccctgggtcaaaacatcttcttgagtatactgaagaacatttggattaatttcagacacgtattatggtttatatagtttttttatccatggtaacttatttactgtttaaaaacatattgagaacaaacagcagcagcaaccctgaattgaatgaaagtcctgagaagggctttgcccaatcagtgcatgtgcatgtttacagtaatctgtctgaacctaggaactggctgaatgagctagcagatggcctgtctggctgcattataaatgataatttatttttatttgttttactcattcattcattttgagacagggtctcactctgtcatccaggctagagtatggtgacacaattatggctcactgcagccttcaactctcaggctcaagcaatcctcctgcctcagcctcctgagtagctgggactacaggtgcacaccaccatgcccagctaatttttaaaactttttttgtagagactgggtcttattatgttgcccagggtggtctcaaactcgtggactcaagcgatcctccttccttggcctctcaaagtgctgggattacaggcttgagctaccacatatggccagaaatgacattttaaaaccaactattacgtacacagatatatgatgctctccgattgttttatctaaaaataggagtgccttaggtttattggctcattttgttttatcaaacagcttaaatgcagttgtgaatatttttgtctaccctcataacctgagaatttagaatgaatataattattgccattttcacaagtaaaattggaacgagaatataaaacagtggaatacaggtgcagctaagagtagcagaggtaagccatctatagaatattaaaatttcttccatgtgtgttgttagaaatctataaaaccaaaattttttcatgcctggaatcccagcactttgggaggccaaggcgggcagattacctgaggtgaggggttcgagactagcctggccaacatggtgaaaccccgtctctactaaaagtacaaaaattagccaggtgtggtgggcacctgaaatcccagctactcaggaggctgaggcaggagaattgcttgaacccggggagtggagattacagtgagccaagattgtgccactgcactccagcctgggcgacaagagtaagacttcatttcaaaacagcaacaacaacaacaacaaacaacaagaacaacaacaaaacccaacattttctaatacaaggaaactcactaagctttataaggcccccatccctccaagtattatcctttccggctgccccaacattaatgacagcaactggtactagccatctgacatacaatcccagtacatttttgggctctgatgttttctaggaattttttctttacagacttattgaaattaagctctattccctgaagacctggttttcataaactgtatagttttgcagttgaggggaaatggtcttaggtcagtcaatccactgttgacacagaaatgaaatgaggtaacggtaggattattgttaagattgagagatgtatgaatcatcctatgctctttcccagcccccaggtgaccatataattaaaatatccttgatatttctatgtagtttaagtttttaattctagaacccctcaatctttctctattcaacttaaatgaaaagacatttagtatccagaagacactcagcactcagaagcaaaggaagaaaaatggaaacataatggtcaatgcccatgttctaccccaggatcaaatgaggcattaatattgagagttgtgattctgaatgagtcttaacctcatgcacatcttagttgttcaaaaatgtgtcatgtcagcaaggtggtaacagtgaagattttctacaatcaaaatagtatagttatgttctgttgtataaaatagaaataaatggaccacattgatcagaaaaatcaccctagcatattccgacagcttaatttttaaaaagctatgttatattaacaatttaaccacatagatctgtcagctagagtacatgttgcatatttaattgacaataattttttttgctctctcagagagttgtagatagattttggggttatcaaatggttctgactttttttttttttttttttttttgagatggagtcttgctctgtcaccaggctggagtgcagtggcaagatctcagcttactgcaacctttgctccctggtttaagtgattctcctgcctcagcctcctgaatagctgggattacaggcgcacgccaccatgcccacctaatttttgtatttttagtagagacggggtttcaccatgttggccaggatggtctcaatctcctgacctcgtgatctgcccgccatggcctcccaaaatgctgggattacaggcatgagtgactgtgcccggctggttctgacatatttttaagaaagactaggctgatgctatggtaactcagttattcatgatacatgtcatcttgtaagtagaagtattcaatattcatggttttgaaacaatttcagagtactataatcaccacacttgacagacttcagaattcattgaaaatctctggaaataattagcaatttgttatcatagactctaaacagaccttcaaaatgcattacatagatttggtaaaacagattgtcagtctgccaaaagtaatcaccttggtttgatttgcattgaatgaaaattttaaaatgtaaagctaaactcttcaggatcactgcactgggtttctataggacaacactgaacagggctgccactgaaacaccttggaggagagcctcaaactccctgaacacagcttccagcacactactgggagaatgattgggactcaaaaatatgtgcaatgaatgtacttacgagcttgttggaaaggaagtaaagaggttgtatgtaattacctcaaattaatactgctacagataaagtagtaattagcactgacaaagtaatagtagcactaaagtagtattaatagccctacactagtagtagtaataaagtggtatcgctattgattctatccgtctacctacctacctgtctggataggagggcataggatttgactgtaagattgggcttagcagtgaagacaaaacagctcatgcatgctttggacaggtatgcactcaatcttggtatcatgtgactgttctgaattccagaaccaaggctaaaaggtggaagttttgtttgactgtgtctcacattttccttttggtctattgtctaacacatgttgctagaattctttttattctgactacctttcatgtatagacaacgccattattgacgagatcactcccaagcggattggagattgtcccaatatttagacctatagcaaggccttgggagaaatggtggtgcagcaggagagcaggaacctaaccattgccatcctaaggccctccattgtgtggagcaacgtggcaccagcttttcctggtaagcccacttacctggattctgtgttttgctttcaaactaaggttcttctagcccaattattttctgatgtctttcttcttcttcttctcctcaggatttatagctaagtgcagccaatcaaatattaacccattatactagggcaaaattccactttgggatcatgcggctcttctggcagttaccctatcttagagttggatggagatcttaaattagcttctaactactctagtctcaaaattcccatgggtgatgttttcatatcttggctttcccactgtagcttaaacatatcagaatgttcttgatggccaaattggtagtattgcaactaactgccagggttacaaagctcacagaaggatctcagtttgggaatactaatttttttaaacctcagtatactgctatgtccttttgaaagtactttgaattataccatcttcttcaaagcaagtccgtgaagctttgggggcagatacattccagctccaccacttactggcaatgcaacatttttgagttgttctttcggtagaacaggacagatactactttggagagttggtttaatgaaacaatgtatgaggagtgctcagtctctagtaaaaggtagatccctactaaaaggctcaacgaatattatcccttcatcttctcctcccgtatatctggtctcccattatatgcatttcgacttttatactgtaaggtaaagagacggcttagggcttaggaaacaaactcaaaaagacatttccctctaactactcttaagcataatctttcctgtaacatctttaagcaagtcaacacacattattaccaatcatgttttcaatgttctcctaaggaggctaaaatcaggaatgaggtgaagtatggttggtgaattgcttagcagatcatgatataaggacaaggtccattgtagcccttaagttgtcataaaacaccacaaaaccattcatgactcctgctacaacaacaatcctggccaaattttaattcttgcacaaactgcagaaaatagccaacgctttgccattgatctttgggatcttaatcatactgaattagatagttctatcggctggagtctcagtgcccttgtttgaaatttattaagattagacggcagatgttccaaagatacaacaattttctgaaatgtgtaaccaatggaaattttctttcttttagggttgggttgataatctaaatggatgtagccgactcattattgcggtatgtatagggatgaagaagtaactgtaatgtagtggaggaatagtaagaaaattcttagtgctggcttagcttaattgatccaaaaacataaatgctactttactatcaattgaagcatattatttcaattattctggttataatatggaggcaggatgaaattgtttttattcttttagaatttttttttatcaggaaaacagaggtaaagtgctatcaattactatttaagagttctattttgaaaagtgagaattaaggatttttcttttctttttaaaaaaaacttttttaaaaattaaaaataaaagaagcaaaagtcttaggaaaatgaagcaagtagccctgccactctatgtacagtaataacaatatctgtcccagttattatgtacaatattataaaaaatgtcgcagacagtacaaattaaggcccttatttctcaaaggacatcaagtcttatgccccgtgggagggaagatgccacttaattattgcaccattttgaaaaacagaactcgtcaaggcggatagtggtcttttcccacctggtcttcagtcacagatgggggctggggcggtggcaccgtcttcgtcgtcgaggtagaccctatggagccacaccgccctgccgggttctctgggtgcaataaataccagtcacagtttgggagggggccgtgtgcaggtggggaggcctctgggctgcatgtgccgcttcctgtgcagggcaaggtgggcagagcgcaagaaggcatggtggcaccaatggccctgaaatggccagtggcccctgtgcttgtggtggtggagcgttagcttgtctgagtgagcacgcttccagctgcttccatcccagtggcagtggtcgggcttgtcacttgtgtgctgcgcagatgtgcctgcaggggagaattcttgctgtaggtctggccgtagccacataggtatgcctggtgttgcggttcccaggccaggagcagctgtcacgcttgggcttggcctccagcagctccagcggggacgccggtgccaccacaaggaggccgcgggcgactgggggtgccaggcccagggctgtggcggcggcggccaccgcctaagagactaaagacgggcgtggaggggcggagctgggcggggggcgcctcatgaaggccgggctgggtgtcccaaaccagggccacggaagggcagcgggaaggaggcgtgcgggccgtaggggctgaggggcaggtgttgggggcggaatgggagggacccgggacctcgcatgcatgaagctgcaggcccggggcgccctagtgtttgagaggacgcgcgatccatacctgaacctgggtgcgtagccgccgccatctgcttcagggtgctgggctttgaccaggtggctgggcagcaccagttgaaagcggttgagcaggcagggcgcagtggctcacgcctgtaatcccagcactttgggagaccaaggcgggccgatcacggggtcaggagatggagaccatcctggctaacagggtgaaaccgcgtctctactaaacatacaaaaaaaaaaaaaaagtagccgggcgtggtggcggacgcctgtagtcccagcactttggaaggctgaggcgggcggatcacgaggtcaggagatggagaacatcctggctaacaggtgaaaccccgtctctactaaaagtacaaaatccaattagccgggtgcggtggcgggcgcctgtagtcccagctactccggaggctgaggcaggagaatggcgtgaacccaggagatggagcttgcagtgagccgagatcgcgccactgcactctagcctgggcaacccaaggagactccatctcaaaacaacaacaacaacaacaacaacaacaacaacaaccagctgagcagcgcgggccatctggcagcgggtccagctccagggcgccgtagggcagcggagtgcagtgttcgggtaataggacgcagacggcggggtcgccgggggcttcggggtggcctcagccccaggccatccagccctgtggaccgaatggagtcccacacgctgttgaggtagttgtgggttcccctggcctcgggctgggcgcggggtcagcgcgcctgcaggcggcgcttgcggtacgggctggtgaaagtggagacggacggcaggatggattcacttggccacatggcacgaagctgggaagacggacaccggtgagtggctgcccgggagggctggtcggggcgcggacaggcgggcatggttctgccaaggattttgctttatttatcgcaagacggggggtatttcctcctttcttcagtttataattgcatgaattagtgcagtgaattgaggatgcagtaaaaatatcttcaaagattattaaattcgttattataaaacacatagaagagtttatgtgtgtatatggaaagcaggtatacatcaataattcttaatgaatacaagaaagaactaccaatattggggcaaatttttcaaatacaaacatcagtgaatataggcaaggccttttcttttttattattctattttaagttctagggtacatgtgcacaacgtgcaggtttgttacataggtcgacatgtgccggcaacgccttttcaataatgtcttacaaggagaaacgtggctcctctaggtgagcagccctcagtgcgcatctccctgaagtccacattgatccggcagagctgtggggttcacagctcacactgaggcattcagggcctaaaccccactttactcttttgtacaatgaatgggaaatcagtgatctaaatgagtttaaatcttattagggattcagcctgcccttcagactctgtctctattcctcccagagctgggttcaacatgaattcaaatacaaatatgagacaatgaattatggtagtgacaaagaccttccttcgaatttcggatttttctagcagcccctttctttctgcttcccacctgccttcaactctttctcctaaaaaagttcagttggggtgaacgtttggtgacttagaacatcattattttaacgtgatcccaaagcggttttcattatatgcaaagctgtatatttatttacatttttaaaaatgttctaaattggtttcttatgtccaaaagaaggggagctagttataagaaaagagaattgagtaacataagaaagtgctaatcatttcaaattaaagtgggaaacatgcaaagcagaaagaatcaatttcataaactcaacaaattattaacataaacaattccaaactcttgtatctatataacatcagtgatctgtgaggtgaaatgagattctgaagaaaaactaaataataaggccatttttctaagccaaaaaagtttttgtcattaattgtggaatttcaccaatcaatttttttctaataaaagtttcttaaacttttagtgcctactattgcttgtaggttaataaaccctagcagaaaacaaaatcattaatgaaatggaaaacaaacattaatgggaaatttgtgtaaccttaattcttaacgtgtcttatgagttaatttttaaaatgtgaagttttattcttggtgtttggtaattaactaagtttattaatctctcacaaatatgaggaattttattccctaaaggaacgtgaggaacacgagtagttcaagaaaatgctgaagatgcgcttggctgggaagctaggataggctgacgaagtcagacttagtgtgggaacctggtaagcagtggatcgatgttagctgttttcacttattgcactagtataatcagtttgatgatacatacttcattcagccccagctgttacttaagacctggtttcacattttatgttctttttcctgtgcaggctgggaaagggtttcttttggccataaaagctactccaatggctgtgggagacttaattccaattccaggtgatacagccgtcagtctcccactagctgtaggatggtgtgctgcagttcacaggtgtggatgctcaagtgggctttcaaagatgtcatgagagggaggggtaatgtattaggcacattttccaaatataggcatttcattgtacaagaccccaaatgtgagagggtgtttgtttcagtgttttatagagttcctaatatgctatcatatatacattcagttgttttcaaaatacagtttagtacttggctactcacaaagtaataaaacatttaaatcacttaaccatacaattcttgataaccaaaaggcttttctttctattcagtagtttaacattcagctttcttttttagggtaaaggagatagaagtggatgaaatgagagagtatttttttaactgaactctgattaatgccaaaagtgttcaatcactatgtgtggggaagcttcctggtacaaaggaaaaaaaacaggttgttcatacacttggctgtgttagtaagtggtaaacagaattaaacttttcttatgtgaactcacacatatgtgcttcataatatgtcactcctatttaacatctctttcacacacacacatccccccacctccacacacacccttttgctagtcttcttccattttgcttattaacccaaagaaagaaaaaaatacagaagccttcttgcataggttgccttaatcagatgaattattgaaaccactctgtctaaatattattttcccttatttttctttctttagttttccattctgttgtatttatttaatttttatttcattttccagacctaagtcaatgttagtctactactgtacatctggtaacctcaatccctgcaaccgaggcaaaatgggtaagtactttagccatgtaactgcataattactagtgtctgacacagagaaaaaatagacaaaaagtgtgtcatggagcttagagcctacatggggagaaggacaaaaagtaagcaaagagacaaaacaatgagaaattgtaaatgtgtggtagttaactggaatgtactgtggttaccaaggaaaggagtcattgggaacacatacatgattgtaagcagtagggggtccattggctgtagagattttaaaaaacagtgatgaaataaagcaaaagttggcagttataaagaatctcagtgataaaatactgaaatactcctccctactggggcagcgggtcctatacacaccccttcccttcttgatatgtcactgagaatgggacgtgatcaatgaccggtgagatttagaaaagtcgggtgatgttattccttccttttgagtgtgtaatagtgatcgctaatttatgcaacttgtttctcttgggtgtgcattaactactctactagtgatttgtaaaaatgaataggaatcactatgggagaataaaaaaaacacccagattccttggaccctgggatcaaggtcttgggtgatgctgaggaaactatttttttaataagcatctagatgattgttgatgcttgcggagatgctctttgagaaaccctgtactatacaaatgattaatttgtctgaatgtaagggatttaatctggtcaatgtacaaaaaccatggaaatcaatttgagtacaacttaaacatctaatgatggtagaagataaaagtagggagttttgctattctgtaggatttcttagtacctactaactaatgcacgccttctatccctgttacataggtaccactagctcttcatattccaatggtaagccatggtaccacactgaaagttctattgcagggcagctagacactgtggctcatttatatattgtggctttgaattgagaaatgcttttccaggaatgagaaatacctggcctgcatgtttcctctacctctctcacacctatagcaaatactgtgggctgatatgacattggttatccctgtgccaaggctctgttctagattcccttctaacacagcatttctggaagctattactattaatttgatgttgcattcaaattaaagtcatttgtgtttcctatcagggactcttaggagagataaaaatgctgcctactgggagcagtagccatgttaacaggaggttgagcatatatagtctcaggtgatattacaaggagtgatagacagctgggtgggtgaacataggctgtctctccatagaattgtctcctttagtgtcccttaagaagagtttttaatttcctgcatataggtcttaagcatcttttatcagatttatacctagtgcccaggtaattgatgtttcttttttttttttttactaatttaaatgtcttttgtaaaaatatattttctaattgtggatgatgtcaaatgcaattgatttttgtatattgaccttatattcagctatcttgctaaacttattattgctagaaattgtataaaatttcctcatgattttctatgtagacagttaatctgcaaaaataccagtattatccccattttttcaagctttaggtctttatttttcttgttgatgacaccatctcagctcactgcaagctctgcctcctgggttcacaccattctcctgcctcagcctcccgagtagctgggactacaggcacctgccagctcgtctggctaatttttgtatttttagtagagacggtgtttcaccatgttaaccaggatggtctcgatctcctgatctcatgatccacttgccttggcctctcaaagtcctgggattacaggtgtgagccactgcgcccagccttcttgttgaacttctactataatggtgaataaaaatggcaatagtaggtattattgtcttgctgctcattttaagcagaagacttcaaatattaaattcgcctgccatttttaggataaacccaacttggtcatgccatgttatcttttcttatattttgtgtaattcagtttgctaatcatatagttcccttgtttttctattctctgaaagtgcttttgtaatagtggagtaatctattcctcgaaaacttgggaaaagcacctttaaattatctggatttgtaattttttgtgagaagattttttattgcttcagtgtctttaatagttaaagaattttgcagccttcattttctgctggaatcagttttagtaaattatatttgtctctttttctaagattttgtctgttttaacatgtgtttacattcatttttttatattaatatttttgtcttaaactgtatctgtaattatgcttcttttttaattcataatatttttgtgtcttctcttttcttctcagctagtctccaaagggtttattttatttctttttttcaaagaaccaacttcttcgggctttattgacttttttctttgttcttttttttttttttttttttgagatggagtctcgctcttgttgcctaggctggagtacaatggcattttcttggctcaccacaacctctgcctcccgggttgaagcagttctcctgcctcagcctcctgagtagagtagctgggattacagacatgcgccaccacacctggctaattttgtgtttttggtagagacggggtttctccgtgttgatcaggctggtcttgaactcccgattacaggcatgagccaccacgcccagcctattgactctttattatgctgctttgttttctattgcatagatgtattgccttatgtcttttttccccttcctcctgttgtctttgattatgtttttcttctctttaacttagaaatatagcccatgaatatttggcttgtctaatacatcatttatggctttatatttccctcaatgccactttgactgtatcccacacattttgttgtataatgtttatgttatcattactctctaatccttcaacatttttcatttgaatttcttctttgacctatgaggatgtagagtccagttttcaactgccaaattacattttctacatgtgcatgagtttctacttgtccctcacatcagacagatagtagcttaatggttaaaagtcttgagctttgagatgtaatagacttggattcaaatcatagctcattcactcactcctgtattcattaaataggcattattcttggtgctgaggatgtatcactaaacagaaatccatgctcacatagatcttatattctggtatgcatcccaccatttagtagactccactacttattagttgtatcagttggaaaaagtctctcagtttctccctgtagatcaattttttttatctgtcaatgagaataataattattctattctagggagctcttcggagaatgtagtgagataaagtgcttagtacagtggttagaacagtgaacattttagtaaatgcttgctattaccatatggacagctttctcagaaagcctttcctaacccagccccacccctccccttcctggcacccagacagagctagatgcttcttttgtgttcctccagagcatattgtactggcctctagcagaatactcaggcaaaatattgtaatcatgaattgtccacatgtcccaccagactgccagttctttaaagacaaagaatatatcgtatgtaatttttttttacctcagcatctaccacagtgcctggcaagtgttaaatgctaaataaatatatttgaaatgactaaaggaaggattgatacagatttaggaaaaggaaagtaagtgtatgttgctgagatatttattgattcgttcagtcaaaaaatgtttattaggcactgattacctgtcagccacttttcaaggtactgtataggttcaaacaaaacaggcaaaattttgttatgatacttaaatcttagaaaggagaaatatacatcagatatggttgagtgattgcagaacaataaaacagattaaagaagtaaacagtattgtgggaaggctgctatttgatatgtgatggccaaagaaagtctctctgataaggtgtcatcttagtagagacctgcaagaagtgagagggcaaatcagagggacacgtggatgaaatattccaagttgaagaaacagcaagtgctgaagttctttaatcatattcaaggacagcaaggaggccagtatggctgcagcagaagcactgagagggagagcggtaagaggtgaagtcagagtggtgggcagagagagtgaggatgcagagtgcaagcccttgcagaccatggctttgcctctaaatgagaagagattccgttgaagggctctgaatggggacgttcctgtaatacactctgagttacattttacaagaatccctctggctgctacatggaggtccgactagggttacaggggtagtggcagagaccacttaggacagtattgcaacattccaggctacagtagtggtttggatcagagagatagcaggtggaaattatgattctgggtatttttcaaacagagagctgatagattttgttcaattgtgtgtgggttgttaaagaaagagaagaatcaaggataaccccaaagtttttggctgaactactaaacaaattgaattagcatttggttagaggtagaagactggtgaaatagcaagtttgtgtatgtattgggaggggggtggttagcagtgggtgtatcaggaggcccattttagagctgttaaatgtgaatgtctcttacacctccaggtggaaatgttgaacaagtatatggatatatagttcagaacatcagtgctgagatcagaatctcttatgctatcaacctgtacataactttcttatttaccaccatctttttaaagtataaatccctatggaccaggtgattcttgagaatcttctctgaagaggagttatatttttcagatagatttttagctggcatttttttaagtagggcaataatcgtattactataataactgacatcataattgaataatgagcttaggcatatgctttgcaaaaacctacataacttaattaaaattgaattcaaatgagtaccttttcgaaagaactactgaattcacaaatgtacataaaaagttcttaattaagcttaatctaagtattaatataaaaagaaaaacactattatgaataaaaccctggataccagagtggacaattgggtctgacatattcctggagaaatatttaaagtaagctaaaacaagaaaatcttgcctttagaattttttagttaaacttttaaaaaagattcaaataaaacgttaagaaactttctaaatggttctgaaagtaatggtccagccagggaaataaagtttctagcctgtgtcttggggctttcagaatagactaggtaaccttagaattaaatgtggatttatatttttctgaacagtacccccttttattgactacatgtgcttccccaagaatttgttgtagagtagatgtttcaaataaagggtccaattcttaacccattcacattgtttcattttgcagataaccacttgcctagcataaaaatctttacgttgttctcagaaattgattcttgactctacacagcaaatccttcatctttattgttgtgacccattgtaaataccttccactatgatgggcttatattctcctattctcctctagcacttactctcttttttcccccaggattccaggtcttggcaacctttgaaattccaattccatttgcgagagctttgaggaggccatatgctgattttaccaccagcaacttcacaacccagtactggaatgccatcagccagcaggcccctgccatcatctgtgacttctatctgtggctcactggaaggaaacccaggtgagaagctgagtcaatggctttgagaatgtcactgcatatgggagattgaggccccaaagtctttagggcttccttcagccaaggattaaaggagacaactgaatctgacccatatatacagattgaacacacctactctgaaaatgcaaaatctgaaattctccaaaatccaaaatgttttgagtactgacatgatgccacaaatggaaaattccacacatcttacctcatgtgatgggtcacagtcaaaacacattcaaaactttgtttcatgcataaaattatttaaaatattgtataagattaccttcaggttatgtgtatgtggctaagtgtgtatgaaacataagtgaattttgtgtttagacatggctcccattcccaagattcctcattacatagaagcaaatattccaaaatctgaaaacagttgaaacccaacacacttctgacccaagcatttcagataaaggatactcaacctgtataagttttgaacaaacaaagcagtcatagtgagaagccacagaagcctcctacattaaaaatgctccagcataataaaggaaggtaaatgttaaagcgcctgcttggtgaattcagcaagtgatcattcacgcaaaaagaaaagcaactgagactctgtcgctagggtttttcaaataggtagagaatcttaaatatccagtaatgatgacaacctcacttactgggagcttactcgtggggctaaggaggatgcatgatgatcccgtttttattgtcgcagctaccgaaggaagataccctcatcaacccaattttacaaatggagaaatagaagctaagggaagaatctgaagtagtctcaaaggcagtgacaggaaggatgtggagaaagctgagtgtcaaagtcagtattcatgactagatttactgctacttagagatgaatgaagaaatcagagggaacgcagtgtgctgatgctaaagcagctgtcaccactcagctgtgtgacataggacatcttcttcctctgtctcacttgaataatatgatgtgtcagaggagacatgattgtaattgcctaaagcaatttttgtgatcaagaatcagaaacatgaacagtattgctgtctgtgttagcccctttataagggaggaagtcatcttcagcatgttgaattgtcatctttcttagcagtgcaaatgactaaaacttagccaatgtagagtttatccaaatttggagcaaagtgaaaagaaaccattgtgattatggggaaaatatttgtatgggactattaaataaagacacgaaaagaagaaaacccaaatattataggcagaaatgctaaaggttataaaatatatcaggattggaagaaggcatggataaagaacaaagttcagttaggaaagagaaacacagaaggaagagacacaataaaagtcatgtattctgtgagaagtcagacagatttgtggggaatggattggtttgttgtatggtatgtattttagcaataatctttatggcagagaaagctaaaatcccttagcttgcatgaatgatcacttgctaaattcctcaaggtaggcatgatgaaggagggtttagaggagacacagacacaatgaactgacctagatagaaagccttagtatactcagctaggaatagtgattctgaggacacactgtgacatgattatgtcattacatgtatggtagtgatggggatgatagaaggaagaacttatggcatattttcacccccacaaaaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgacgaggttggtaaaatcctttgtgcaacactcttactccctgaatgttttgctgtgctggaacttgtgcgtgccagacaaggccaagctgggtgaaagagcaatcagccacctctgcaacctgccacctcctgctggcaggatttgtttttgcatcctgtgaagagccaaggaggcaccagggcataagtctactcacttatatctgtttgtctgaaacataacccatgtttgtttttacaacaaataaaattgatcttgaataaaaactgagtggtcactgtcattaatctttgaacccagattaaccttttggtcatacctagtctaagagaaaagagatactcttatcaataaatacagagcccagctatgtcagtgaagatctcaagtgcatagacaatagtatagggaagagtcagaggccaaaaagacagggatggcagacattgaacagaggagagtgtggtgtttgcctttgcatcaactgagattatggaagaacacctgaggcttggggagagcacctacaagataccaataaagcattctaagaacatctatgaagtgagaagatttgaattactgttgttcttgtgattacgattgtatttatggttgttacttcattcgtattaatcacctatgtgcccaagtgtaatcatgaagttagatttttcccagatttttttattagactcaagaattcccatagacaagggcaatatcactatcctatttatacatttcttctctcagttctgtagagccaaaatatagagtccaatcttttagataggtcatgcaataaaggctgacttggattatctaactggtacatgaggccccgtgtggtagtttactccagaggaaattggcacctgtatataattgtagttaagttgatcccttgatatcagaaaagtttctgctatgcagtcctttttgatgatttaataatatacatcctcattttagacagtaccagtggccatagatgcacttggcagcagagtattacagatggtaaagcttgaatctgcgttttagtagcaagagcatttggagtcttgtgcttcccttgtagacatcttcttcacatctacagcctatctttcgtctactgttgttactgctactagttccatagacattctaattttcacttgggatatacatttttgttatttgtaagctccctcttctttttcattttttcactccatttcagactgttctaaaatcagaaaggaaattctcctccatgagcatgtatatgtttttggctcttggaacttgagatggtgcaagtaagtacaagcacattttccagataagtcatgtgaagtgatttacatttcataatatgatcatttctgattgatcttatctattaagaccacccatagagatggctgtaatgaattaagaacatcaaacaatgtcaagttgttcattgcatgtatttcagaacattgccaagataaagccaggtggagtcattaatttcaccagctggttatttccttgctgcagtaccaaagattgtcatttttgaattaaagcctctggtttttctaactcatctttcattgttgatcatggcaagtgaataattaatgaatgtatatgtttaggttgtgagaaatttaaaacacaccctaagagttgtaatgttgattgcttttaaatgttgtagtggttttgagagtgtctgctaatgattccttaattacatacttgcttttcttagaaaatcaactcatttcattgggattaattttctcttaaatatttaagttcatattttaataaatcactatgcctgggattccattatatatttgaaaagatcaagtttaatttttttacccaggtaacatacacaatggctcaagatttgtgttctttgatctcacgatttaaaaaaatatgcattaagcaccatggaaatcccagcaacttcagcaagaaagagtctttgttccatagtttcttatgcttgataaatatgtggactaaaataaatggaatatcttaattcagtttttgcttcatgagactggttgagtgaacataggcctagtgctttgacaattggcctattgtagaagattgatattctagtagcctaaatagaatccatttcttataagaacatatatattttggaaaatgtggtatttctcagaaaactgctgaaatgaattatgtatcttttctgtcttctattattttcaaagatctaaagctttcacttgaaaattagtcttttggaaaaaaagacattgaaactagtgttaaattatatttcattgaggtaatgaatatgaagattcatttgctgtaatctccttgggatcttctaaagtagtttcttgtgcttttaaaaataacactataatggtctatatgtgtatcagtttttacagtaatttgtttaaactttagcttataccagtgtgcatgaagaaccaagtgcagtctgaattagcacaatgcaaatagaaaaccgaccttttattttcctcacaaaatatctaatataaaccttatgtaaaataaagaatttttaagtgcttgtaaattaataacaaaatcatacataatgtcagtggaagagaaaagttaagggttttatatcgcagtaaaatgcatttctaaattgatgtagtattgttataaaacatattcttgaatattgtatcagaatttatcatcactattgaagtcaaaataaagatggatctctaaagtatacaatttatttgggaatcacagaattgtagttctgaacaaaactgaaaaccacagtggtcttctatatgtgtgaaggacaaagagaagattgggggtttactagcgagggaaatgctacatattgttttgaaagaaagctcacggacactagagaagattttgggagctggtcaaacaagcctaatgggagacaaatcttttgagacttcccaggagcccaactagaaaatcccttagtcaattttaggtgaaaaaggcttaaatttgaatttgattctggggaagtttgtcatttgtttggattcaaaaagcctaaaaatatttaattaaagtagaattacatatccttgagagataatggtcacttatttaatcagagtaataatggaaagacttcaaaaacaaattcaaaagttacatagtcaagagaaaaaaaatacttagacctgtattagagatgtcttagttttttcaggtggtcaaaacccgaataaagacagcccaaaccacaagaagctatcttaaaacataaaatatctgcttgttaggtagaatacttagagagagagaaaaaagccttttgtaatatgaccattgctcttggtatatgcccttttgcataaactggaaattaaaccccatgaaaaactactttaattcaattagacactggaagagtgtgtgtctaaggttataagtaaaccatattatagaataatacacacacacacacacacacacacacacacacacgtagtacctccaccaggggaaatggatggcttttagaaaaagtaagggcatgtgaaatttcctggttacatagaacaattgggatacaacaggaaaagccaagagtacagaattaatctatactggaaaaacattgttttttccagtttttttgagacaaacattctcagtgtcaggttataatacctgagtgcaaagtggggaaaaatgcaataggaactgacaaaaaaaaaaaaaaattgagacagtcaccactttagttaagcaaaaagatgtactgttttaaggagagacgtaagaagagcagaaggcattgatgtattaactgcaaattacatgtagtgagatgcataaaaagccaaacctttgagattaaatctgaaaacctttaagaggaaaactctacctcctgaaatgaagcgatcacttatttttccttattgctgcttctaaaaagaggatacgtgtacagaatgtgcaggtttgttgtataggtatacgtgtgccatggtggtttgctgcacctattgacccatcctcttaagttccctctcctcaccccatcccccaacagaccatggtgtatgttgttcacctcgctgtgtccatgtgttctcaaggttcaactcccactgaatgagaacatgcagtgtctggttttctgttcttgtgttagtttgccaaggatgatggcttccagtttcatccatgtccctgcaaaggacatgctctcatgtcctgcgtagtattccatagtgtatatgtaacatattttctttatccagtctatcattgatgggcatttgggttggttccagtctttgctattgtactgcaataagtagaatgatttatattcctttgggtatatacccagtaatgggattgcagggtcaaattgtatttctggttttagatacttggggaatcaccatgctgtcttccacaatgattaaactaatgtatatcctcaccaacagtgtaaaagcattcctatttctccacagcctcgccagcatctgttgtatcctgactcttctaaataatcaccattctgactggcatgagatggtctctcattgtggttttgatttgcatttctctgatgatcagtgatgttgagcttgctttcatatatttgttggccaacttcttttgagaagtgtctgttcatatcctttgcccactttttaatgatattgctcatattaactttgaaatgactgaaaattcaaaataaagacaagaaagataaaattatattttttaagttataggtatgaagtatttttgaaaggaaagaaatctctagattatatatatatgtatgcatatatatttatatgtgtgtatatataatatatatattgctttcaacaaaaaaattattagagtcaaaatagtaccatctccagatgtttttatttagcttggtatctaaaatcacttaggtgacccattcccatatttggagaatttttaaaatttgttgtctacatctgtgatattcagtatagtagccactagctacttaacttttaatcagttataattaaatgaaatttaaaattcagttcttccaacatactagctacatttcaagtgctcaatagacgcacttggctagtggctactttattggacagggcaggtacagaacatttccattatcacagaatatttaaccagacagtattgatctaaatggttttttttttctttttttaactggagtgcagtggtgcaatctcagctcactgaaacctctgcctcccaggttcaagcaattttctacctcagcctctgaagtagctgggattataggcgcccaccaccacacccagctaatttttaaatttttaatagagacaggatttcaccatcttggccgggctgttcttgaactcctgacctcatgatccaccagccttggcctcccaaagtgctgggattacaggcatgagccattgcaccaggccaagtatcttgtagagaaaatttatattatgattcagatttccatgttgcccatcttttttattaatcttatagacacttattggagtgcttattatgtcttaagtgcatgagaagtgcaaagagtgtaaagacaaaaaagatgtagccaaatcaaggggtggagacagacatttaaaacataattgcaacccaacatgaattctccagggagaggagagcaaaggacaatgaaggcagaaagaatcacgcttgcaaatccatgaacggtgtggtgtgtttgggaaactctgggtaatttatttagccctagacaagtaaaaataaggactagaaaggtatgctgaggccagatcttgaaagatttcaaataactgcagtcaggttacactccattgaatgaaaacccagttgaaactggtttaaaacacaaaggtggtgtattgatgtacaatggaaaaaatccagtactagagtggtgagcagctgtgattcaactagaactctggctgccttggtttttgaatctctcaactctgccactttgttctggttttatcctcatgatgaataagatgtttgctgtagcttcaagctttgcacacataatatggcaatctttggatgaagagaggctggccctgttcaagattttctcccaagattgatgaaacttgttttctaaaaaccctcagcaaatttccctcccatcgcatcagcttagttaaggttacctgtccatttctggccagcccctgtggcctgagattatgccatgtactaatttgttgagaaacctcagacgtaagccaatcactgtctagaatgtaagagtgcatggagatcaatcagcttttctctgaagctggggttagattatgtgtttctgaggcaaggtcgctactggagaagggtgaatacctgcgtgataattcagaactcatcaagagatagaagactgggtgttagggggttagcattctgagtggagtgtggtttctgaagtcagacctgagttggtgtcctttatccaccactgcgtggtgtaactttatgtaactgagcctcagtttccaaatggagattataatggtcattgtctttcgtaccgttgtgagatgtaaaggggttaacaggaaaggcacttagaatagtgcctgaaccacagtaagcactcagcaaatactagctttaaattcatactcaaatatgggagggagtttgagctttatcttttagagtctgacattcccattgaaggtcttttgtatcttgacagctagaagatttcctactacttaaataataataaaacattagaactcaagtgatgctgatgatgacaggaaatgtgaattagttgagtagttgggacggaaatcacatggcccgcaaagctgagaatattatctggccctttacagaagtttgccaactcctgaaatagaggaccagaaaaatgtcttctgatataaaacacctaagcatgttaaacctggtgcagtggctcacccctgtaatcccagcactttgggaagccaaagtagctgaatcctcccacctcagcctcccaagtagttccatatcagtctggacaacatggtgaaaccctgtctatactaaaaatgcaaaaattagctgagcatggtggcagttgcctgtaatcccagctacttgggaggatgaggcaggagaatggtttgaatccaggaggcagaggctgcagtgagccgagatcacaccactgcactccagactgagcaacagagtgaagctctgtctgaaaaagaaaaaaagataaaatatgtttttataaaatagttttaatgcatagctgaacttgaggcaaaataaggaaattcctaagtgtcccgaaatgacaagaaagtacacacctatacacaaacagagtgagagaagttgaacaagcacacacacaaatatgacaaatgtatattgagagccaaatatacgtcaggtacatattgctctgtgcctggggagcaggggcaataaggtagaaaacaaaacagacatgggattaacctcatagatcttaaagtccagtgaggtaggcaacttctataagaaataagtgtatattaaatattttgaaaagtactgtgaagaaaaagagcaagacgctttgaaagagagtaacaagtgacacctgctttaggattaggtgccttgaaaaggactccagaaatagtgccactggaactcaggaggagttaatgtgttcacggaaatgggagagagcatttcttttaggtagatgcctaggctctgccaactttgcttgattctatctgactctattagacaagttatagaagtataataatgcctttgctacaaaaccagaaatggataaatacttaagaaattttcacatctcatcaaatgtgcgttttgatgctatagtaattgttccaatttaaaacattcatttttacatattttcttctttcctttttttttttttttttgagacctgttcttactccggttcccagattggagtgcagttctcaatcagctcactgtaacctcaaattcttgggttcaagggattctcttgtctcagcctcctgagttgctgggaatataggcatacacagccacagctggctagttttcatattttttgtagagatggggtctcacaaagatggggtctcaccagcatcttgctgatgctggtcttgaacttgtggtctcaagcaatccttctgcctcagcctcttaaaagtgctaggattacaagtgtgagccaccacacctggtttatacatatttcaatagttttaatataacagcaaagtccatttgaggcagaggacagacttttttaaaaaaattatagtaacatctgtcttgctcttaccaccaaggctggaaggcagtgcatgaccatggttcactgcagcctcaacctcctgggctcatgtgatcctcctacttcagcctcccaagtagctgggaccacaggtgtgtgacaccatgcccggctaattttttttttttttttttttttgtagacatggtggtctcactacattgtagaggctagtcttgaactcctggttttaagcaattttctggtctcagcctcacaaagtgctgggattacaagtatgagccaccacacctggctagagaacagacttttaataacaaaagaaaagtcctttttattctaaggttgactttaggagcctgtttaaaggcgggtagatgagactgcttacagaaaaagctagctttgtgtgctgaacttgatactgttagaggtttcttgaaagatctgggaaaaaaggtttaaaattgcaactggaagatgtttgctaggctagaaatggagagttctaagcactcaggaattcagcaaatggctgctggttaggtttttgtttttattttttgggtttaagataccctcaaactctagttatttctgaattgaagatgaccaattgatgggtatgtttgtattagtaaaatcaaaagcttattaatttatatttcacattaacaaaacccataaagaaattatactttgcctttgtaacccatatgtcagcttggatatccctgccctttaataaaatgtaattaatgaattccccaagaactgttgaggattctcaggtggctaattgttcatggtcatctctgctgttgctggggatggatcagttttgtttatgaatcattttcatttcacatagactccataacaagtcgatccagaccaggtaaaggcctcgttcttcatttgtcataaatttaagatcaaacaacaaaaagagaaaacacgtgcctaggcctgcctaacacttataggacctgcttttacctaccacacatggacacccaatcttacaatgggtcatcctctaccttgttaactgaagttttctgtgtttatttttttcatcttttaaatcttccatttactgtaatttaggagaaaatgaggtcactgagttaattcattttgctgagtttagtacacaaattctaggcaacatttcacagacctgggtctttcatggtgtaataaatgtgggcttttgcaaactgttttcctctttttggtctcacagctatgttttggatgattaaagttgctaaaggtctaaacacttactaataggttttgttcttacatctgcactgggtggtagcatagggcagtagaaagaacactgaatctctagatactaccgtctcctcaatcagagaagtagagcttggttgagagaccatagcctagttagctaacccatatgagtcttgtttttagtatgcgtaaagtggatctgataataatagctatttcacggggatttgcaaaaatcaaatgtaatcctatgtataaaataatgtctcatattgtgcaatataaatattagttttgttatcagtaacctctcatttcttttacccaggtatgttcttttgttcactatccctaagaaagactctacattgcctgtatcagtttcacactcttatcaaggatgtatacattcctacattttcttttctacagttagtcatttcattagaaagaattttaagtattcacatttatattataacacttaatttgaaaaaagctttttgcaagaaaggagagtataatcagaaattcatctataaagtcctaggtttcagcagcctgtgccacatgtgttcacagtcactctccattctgcatgagttgtactaatgtgggagctgaaggagataaaccccccaaatcagtagcttaatacaaatgaaatgtgattgtcaatcacagtagttctaactggtagaaggcattgcactccacagtcactcaaggatccatgctgatggaaggttgccatcttctgcacatggcttctaagtcatccaactctctggatgacaatatccagctgccaatggagtaaaaggggcactgacatcatgtggaaggattttatggtccaggtccagcagtgcccatcacatctgcccatattccaccctcagaagtgtcactgggctacatctaagtacaaggatggctggaaaatacatagctgtgtgcccgggaagaaaggaaaataggattgttgaacaactaatgaggttctgccatggccttctttttaggtcaccagatgtctgccttcctgtctttcccacacatacaagacactcattcctacccaagggtctcataccattattgcatccagttcaaagtccaaggtccaaagtccaaaggggaatagactgtactctgtatcagattctgatatgtaagcttctggtttggcattcttgaataaaaaggccaattttctgcctcccaggtagaggtaaaaatatctctgttctacctcttgtcatggtagaacagtgaaaagaccaccataattgaagaaaaaaataaaattaaataaataaacctgctatgcaagaaagaagacagacaggcaagcagcagtccctagagtataaccataaggaaatccagagtagcaagtagtgagaagctccctacacagggcatggggaaattccttaaatagcccctgaatctactctctgggaggaaccctcttttccgtcatttttggtggtggctgcatcctctggaaggttcttatttcttattccctggctgtcacctctgaactggctgttaaggagtgtgcttttcttgaggtctttggctttataactcattctgcaagagtaaaggtgaaaaccaatgagtgttgtatgccgatctgtcctgcagactctggccaagtgatgaatgaaaggagtttgctgacacaggtatttttcctgacagtgcggctaggggactgcaccactcagtgctgctgatgagagagtgcagcagccgaaaggagtgcagcccccctaagctggccccgcttgcgtttatttagtacagatttaatgacaagggcttggagcaaacacaatttgtgggtaattaacattgtcaactccccgagtagagagcagtcctgcacatgaatgatcaaagcatggtttccagagatataagtagaacaatttacctagataagtttctttacattccgttgttatctaacccttgctcttaagagaatttaactgccttcagctaaattctcttttgaagcttttgcaaaatctcccattcttccaagaaggtttgtgtctttccctataaccttttcttacaacttttcccaccaccctgaccaaactcctacagttttaggtttaaggtcagccatttgctggctctggggctgtggaagaaaaactaaatccctcagttcatgcacacagtgtgacagcttggcataagtaaaagacatgaacaaaaggattaatgaaggagtgaaagaaggaaggagtatgcattaggcacaaccatctaaaaactaaaaaaaactggaatgcattaaactcattcattcaacaagtattggttgagtgcctactaagtgtcaagtgctgggcccgatgtgggggatacagtggaggatacagtggcaacacatggaaagtaaaggcagtgaaaaggccatggatttaaaaattaaaggaaaaaaagaggtaatacatttgttattggttttagcaaatccaaaaaatgtgagaaaatagtgcagtgtgtgccaaatctacaactctttcaccctcactgagtctcaaattaagaatgcacaaaagcagaattactaggaaatcaaaagttttatgggtgtattcccttaagtaatagcactatactgcaaaattggtggaggtcgcctgcacatttgaaataaccaacctgcacctttaccccctcccccagattctaaccaaataaagtatgaaataaggcagaactcgccatgctacaccaacttaccaggaatgaagttgatgctgattggaaaagtgtcaagcaataaaggagagtttggatttatcttaaacattatcttcatgtcacttgagactttaatctcagccaaatctacttccaaaaccaatttcttgtgcaatgatcttgtctgggtccaggccaaggcttacttctattgcatagctactctcacccttctcgatttttactctgaagaactttcctatctgggttagagtttcttctgctaggcatcagattctgcaaatatttattatctcatgttaatcaagaccccctctagattctgctatttaactttaactattttgacataaacagagtgatttaaaggcagttgtaacttgtttctaagtagggcctggtatagcttttaagcaatgtatctctccagtcacacacaataatgaatggattctaacttaccctaagtactaccatgttcctgaaggtaaataaaccatgtcagctctgtgaggcttaggaatttttctttaaaacgtagtaaccaaaaatgttaccagttttcctttgattactactatattgcccaagaagtgtgatcaaaagacatctgttttatgtatcaaaattcatacatctgcttcattcacttccttttatggtatcacctctgacttccagtttccctattgtcagagagaaacaattaaatgggagatgctttggacaacaggatttttaaaaatccagtggccacagagagttggaactgaagaatcagaagagaggattaattttctttcctcttaccaagtttcttaagtattttcagaactcttaaagggacctatcaatagcagggaaagtgtctgaattaatggcaggattcttgaggactttctcacaaagataattaaggtggcactctaagaaaactaccaaagacatcacaaataatgtatagatatttttattgtagcattacttatggtaaacttggatccaatttgaatgttccacaatagaggaatgattcattcaacaacaatacatacaagtgttagaaaagtattcaggcattaaaaatcatgttttatcaaatagtaaatgacacaaaaaggcttgtaatatattcaatgcaaaaccatattcagtataatctcaactcttagccctaaatgttcatatgatcttggattaatattttttttttacattttcaaattttcaaattagaagtgtgattattctacttctatggtgtggaaacaattaccctctgaaaaagtgaaaaagtaagaacagtcatcttctactttccacattttccaaatacaatgaacacattacacgtttacagtggaagaaaagaaacacctatcttttaaaatagtaaataaatcagaataagaaattcatcatgaatttacaaaattatgtcatcaagtataagttcagttcatgtttagttttgaaactgtttatcaaaattaaacagtttgacttatttttattagaaatacgattctaagtattcaacattgctttttaaaaaattatcttctagtttttcacaaaatctgaggagctgctacggaaatcacaccagatctcatgtgtttaaatgtgaacatgctcaccacagaccaaggacattcaacctttcaatccccaggatttccaagccaggggtttcatctcttacttatggaaaatttgtccatttaattgtgaaccaatcagcttttcattgtgtcaaaatcaaatctagatagtgaaattggtattttatctttattgttatcttaaatatatcttggcttaaagagacataagtggctcttccccactataccagataatgagttgcaaataaatcattcagtagtaaagttcaaagaaagcttgaaagcattttgaatttcctagtgtcttacagatttgtttctttttacaacaaccatgtcccatgtatatctatttaggaccttaagttgttaataatctactctgaataattccttaagaaaacattaagaggacaatgtctatacctgggaaataaaacccaaagtagtagaaattgtattaaaaatcatgtagttaattaagaatgattgtgagcttagacactgaaaaatgtgtcactgaaagaataccaaaaatggtcagccttttcctgttaagttatattaaggtatatattataagcacttagtacgtaagagaagagttagaatgagattgtaccaggttcagaattccttatctgagaagaccagacaaaattcaaggtttttagagagggactaccctgaatgatgtcaccagtaagtgggtttataaacaaagacagagcttggcaggttgcactggatacttcaaaccagtttctctggaaaaatttgagttactcaataaaccctcagttttcctgaggtaaatcaactttgaaatacaatggagaactctgggtgataaatcatgctgggttacacactgggactgcagttcacagaacatgattagatttaagacaatagaagataggaacattttttgaactagtttattgaatccttttgagaatatcactgtttggcagttcctagaaagcttagacaaactaatcttcaagaggcaaacaaattaactttgaactaaaaaaaaaaaaacaaacaaccaaaaactttgaattagagaacatctgcaaagaaaagcccaacaatctgacatgttgattattactttttaacactgcaggaatacaaagatgattttactgttcagacctttacacatcgcacaacagaaaaatccttcagttgactagtttccataaactttgtagcgttatggcaaaacgagtcatctgtgaaatacacaaatgttttgtactgagggatattttcacataacacaggagatgatacacttaaatttagaccccctcaatctcatcgtcatgctgattatactgtaagcagtgattggggtgcacacattgcatgttttgaaggtatggatgtggcaattctaacgtatcaacattgtttctgaaaagctaaggttttgttattgaactactattagaagtcgaatgtgatcctcttccaatgtctggcgttgccttcctgtggaattaacactctgtgtgatttagagtacgtgtcccgactttctcaatgctcataaataccttgtctgtaggaaactttctttaagggaaaagcagctttagcctgtctccagtacatggccctgacttgcttatacatgtaatctattatgaaggaaaaagagccatcctcacaaatctacaagattaaaactcctagcacaaacacagcttgaatcagtgcttctgtagcttgtttcagcaaagggaccatcgccagcactgtggctacaacatatgccttgccatcagatacaagagttaggcttcatatccacgtcctgtgcaataaaaaagctttaaatctgaatggaacatctgtagaattagctcacagacaactcagaagcaggaacactttggtctgtgttcaagtaaaatgaaggttgaaatttctttatgcagcagcagaagtaggattctgtatctctctttggagtcaagttggtctttgaaagaaaaccaatttgcttttaagaggttctaatctagtaggataccagatgatggcaagtgtgtttaaaccaagtatagactaagggactggtacactgaaaaactaccttctgtttcagcagagggtaatcagggtgtcagcaatgctgttgttactactaaggtcaccaaggacctagaccaagaagttccatccagcaacaccttattacagtgtacagaggtcaacagtaagaggtaaaagaaaaagataaccttttatcagacttttacattacattgctaatttttattacagaatatttttcattcttttattttgatccactgatatttatttctgattctgactctgcctactgttattcaccctacttgttaattctaatctattctttttatttgtaaaagcataacttttctgaggcatagttgtgtgtgtatatgtgtatttaacctattctagaaacattaaattagaagagatagagattacagattataatagcatgtaaagagtttcatacagttaatacctgagagtctgcacagtggggaactctgaagtaatatgtaaggtgtcaagaacaagcaggtcaggactgtggcactcaaagggcaggtaactagcttttcagtaacatttttaagtaacagtttcacagatcctcagagaatgccaggcagtaaaggacgcatctcaaaatccatacagcagatttctggtttccaaatttctgggagatagtacttaatacggtatttaaaactctgcaattgctatggaagagacattctggagagttacgtattatccaaaaataaatttttcagaagcaggaaattttaaaatgagaaaccaaccaaaaaagaatggccaaccttttaaacctttttttttccattaataaggagctacatagtctgctggtgaagaacttgatagaaattgactgttttcacttagtgggctgatccccttgtatctgtgtcagataaaatcatagcacttattatttgttaccatggataccatgaagatactgccatccactaaatagtagtagaggaagacaacataattttctggaactagtcccgttttgccttcataagttgcctttaaccatcctggttccactgatgggtccacgctggaaaatatcgctccttgtgggaaggaaaactcatgctgtgctctgctttacaggagtacatggctttggcttggtgcccagaagaaactggcttaggtgaaccaacattttcaaacagttgagcttttgctgccactactgagccagtacgctgatagctattgcttgcagtggtgtctagtcttaacctcctgcacatttttggaggcaggtctgggtttgaagctttgggtgtcttcttggaacctacagaagttaagctttgaatagatccactgtagctggtgtttccttcagctgcagagatggatctgagagaagaagcagaagctcttttcagtcctgaaagtccataaggccctttcttgactaggtctatgggtgggggaacatcccctgggctagtgaccgaagcagcactctggcaatctgattctgcatctgtcttggttgcatcttctctagaacttgattcaggactggttgtccagagaccaaggcttttctgtccatgggaagatgaaagggttgcaatccaaggaatccctccagatttctccctgggctggcaggaagctgactttgtagtgctattttgttccgaggaaagagaagagagtgacttgatgctccccatgggggtgctgtctgggctgctgctataggagtcactgtcaggttcagccaggtatggagtacacgtccctctgggcttcctagagcctgtagagaggcagattgctcgtgtcctttgggatccagatcgagactgaggctgaggaagaggaatgcttgggtctggagcagtatgaaaaatcgtttcatcgtgctctgtaagaatttctaacacaatattctgaaatttaatattcaccatagcagctacagtttattcttgtgctctcattagagttgggagaaatatgacaccaagatttgagacagtcatgagattttgttggctgtgcagtgatactttgaccagatgttttattaagatgtccagcatctctctgtttttctctggcaatttgcacaccaatgcatgtacagcctccaccctgtagttttggtcatcagatttaacagcaatgatacaaatctttgtgtaacttgtaagtcatcagtggtgctgcaaagcacctgaggtagtttttcagcccactcattgtcttattgtcccacagttcaatatcaatatcaggaggggatttaggagaaaatatgatattcacaagtttttgaactttggagttcactcctcctattcagtagaggcctaaaacggtgataccgcttgtttccacagcttgaatgcagtttctcacaaaattgaaccctgcttcattcaaatacctttcttctttcttgcttataatgtcaggcagagtataaatcatttccttcccatccatggcttcaagccagagtttcctattagcgtctgagaaggcctgtaatgtgatgatcccatgcctttcaactacttgtatgtcgaagcagaagtggttgtcaattgaatctgtctttcgtcggatacaagtttttgaacatttccggtgagctagtaacaaggctgtttaatccatgtaaaaccaagcggtcgtttctcctggacatacggatagccttccatcgtccactggctgggtggtctgtagtcctggttggcagatttcatcctctgcatcaacccctctacctcttgtcgagtactttcaaaattattccttgtattctgcaagttgaactgcagctgttgcttatgcggtgcaaattcctgggcaagttcatatccctcgtggtaaaaaagtaaataaaccctgaagaaatgacaaaagcggttcaacaaattcaaactttttttcttgaaccgcttgaattttaaagacatatttttcatttatttttatttatttgtttatttatttattttgagacggagttttgctcttgtttcccaggctggagtgcaatggcgcagtctcggctcaccgcaacctctgcctcctgggtccaagcgattctcctgcgtcagcctcccgagtagctggctttacaggcatgtgccaccacacctggctaattttgtatttttagtggagacggatttctccatgtaggtcagtctggtctcgaactcccaacctcaggtgatccgcctgcctcagcctcccagagtgctgggattacaggcgtgagccatttaaagacattctaatgatgcttcatagaagttctgatgtgcttgatcaatttgtgtatctgcctcttgcaaatgagactcctttttctttgcagataaatttaaatgcttttcaaggatagagtaatatttttcactctttgtcaaacttctttccatcttttactgcacctatctgttctttttgaaatttctcaagtggtgcaattaatacatcattagccttttggatcagtcttcacctttcttcttctgctgcaatgagtagtcttgcaaattcttttagtgactgactaatactaatttcatcatctgtttcagcattatcaatacattcaaattggaaatcttgtaatgactgggaaaatttctgcactgccatagacagatccccaacctgggtagaggtgtgttcctttggaaagggtgaaagggtaagggaactgggtaggcaatcaacattacctgtcctcaacgccccagtgagcggagagccctccttaatgagctccttgatgaacttgttggttcgctccagttcaatctcctgacactgcaagcgctccctgaaatccgggctgtccaagtaggaatcgctgaactccagagtaggcagccccatggcacaggcgctgtcagcggcgtccgcgggcacgtctgggccggcggtcagggcagcagctggcggcggcggcggcgggcgctggggacgcgcgatagcggggaaggcgctgctgggacgccaggggactgatcgctgaaaggaaacgggcccgcgcgctgcagccacctgagccgggctcagtcttcctctcccggggcgaggcagcgcaggcctggcctggcggagggcctaggcgcgggtccgctcaggttgctgtcaacgggaggcaccgtcgttcggagcgctgggactgcgagcaacattgttgattattaaagaagcacacaatagaagtgctaattttattttatgagttccttgataatttttagaatcttttgtaggaaaaaaaagtagtgtgtttatgcttgccccaggcttccctgtgtgaaagctgctttttctcaactttcaaaaatgagtttctgatcgacattaatgattctgttaaacctctatataaggcaaaggcaattgggaacatctggaaaggcatttggaaacttccaaaattataaatatttgcatttaaatttccaaagccagttgtgttcattagttttatttttttaatttttcctaagaaattatctcacaaaaagcaagaggcctctagtgtaactagttttcatttttcctgttactggagtcagatcagctgaagcatgttcaacctctcccctgtgggccagttacaggggaaggaaggaagggggggagggaggaagggagaaagggagggagggagggaggaagggagggaaatttagtcctggggatacactaacagttccagaaacagaagcaatttattttctcaatttctttcttaccttcttttacactatcattcactaattaattcaatcaccagcatggttttacatgtccagcttctttccttttcttaaaaatctcttccaatcacaccgtctttttcttaaaagcttcaaatttcccatagttattttattcaaaagccacgaggttcaacatgattttggcatacactctggatcacagaatagaattagaaaccttggcatggcccaacacacacatacacacacacacacgacacagctttctgatcagcagcttttggaaatggagtactgctgtggaagtagaaaggggattttcctattattagggacctacaatgtggtaggcactaagacaaacatctgacttcattactctaatcctcagaaatctctgtagtgtgcccattcctatatcacagatgagatattagttcatgaaagctgtcctctatccaaggttacgtaatttgtgccgagttatacagcaaaattggaatgccggtctctaatctctaaagcccatactttccctactgtagtttattgcctctcctaggaaatttcttcctccatgacaatatcatggagaaggggaaactattgcttgtcacttctgagttagtatgaacacttcttccatcctcgagcatgaataatgtagagacaccaccaattctgttggagagcagaaataagcttaaggttgttcaacttcctagccaccctagttcctttcctgaccagatgcaagaaagaattattaaagaactctgtgaaattgacctttggtgtgggaagaaagcataacaagatggtgaatcaaacattgtgttgcatttagcatttattatagattattatgcaaagtgaagtaaaattttgttaaatgcaaaattgtctataagaacagcataacctgtgcttaatcctacttctctgcgatcacgtgataagttagtcacatgattgggattttagacatgatggtgcagagaggtaaataacttgccccagtcacatagcaaataaatggcagaatcagaattcaaatccagtctttcatgactccaaagggcctgagttctttccaatacaccaatggttctcaacttcagagtgtatccgaattactagacagtgtgttcaaagtaaagctagatacccaagctttgacactgctgaatgggcatttccagggtcaggatgtatgtttgtttgtttgtttgagcaactttctaggcaaccctgctatatgatgaagtttgacggccatactactataccatgctgccttatggagttatagaaatgatcctagctaaagcattaaaaacatgtagactaatctttacatcttatgggagttactagtgaactagcaaaaattttaacattttgtgaatttttgttaatctgtacattgggtacatatatatatatgtatgtaagcaggtctttgtaggttaatgggactaaataatacagttatttttgaagagcaagacttagtaaagtaattaaagaccaaagattctcatgacttgaaaagtttgactggaaaagcttcaatgagcccaatgaagtagaggccaaatctcctgtggatactaccaaatgaggtcatgtggctaacgcgttgattataagagaccacattaaaggcttctgaattgtttcaaaagcattatataaatttaatgcccccaacccaattcctgcttctaataaaaacacagtgttagtgtctgactacagaagtcatacatgaggagtttctatttttattttttattttatttacttaattttttttgagatgaagtctcactctgttgcccaagctagagtgcagtggcacaatcgtggctcactgcaacctccacctcccacactctcatttttacagagttttcctgactgttctcattgcatatacttcttgattaaatttaagataatcttgccaggtttttaaaaatcttgggagtttgattggaattactttatagatatagaatactttagaaacatttagcatatttaaaatattgattcttcctatccaagaacaaagttttcccatttattcaatttttgttgttttttgttattatattcatttatgattaatttgttatattttaaatgtccacatttgaacttcttccattgtattctctaatttttgtttatatataggcaagctaatggtttttttgttttgtttcatttttgtttttttgagacggagtcttgctctgttgcccaggctggagtgcagtggcatgatctcggctcactgcaagctctgcctcccgggttcatgccattctcctgcctcagcctcccaaatagctgggactacaggtgcccgccaccacgcccggctaatttttttgtatttttagtagagacgaggtttcaccgtgttagccaggatggtctcgatctcctgacctcgtgatccgcctgcctcagcctcccaaagtgctgggattaaggcttgagccactgcacccagcctttttatataatttttaatcagcggacaccttactgaactatagtacactttagctttttaaaaaagctgcttctgttttccaggtatgcaattatataatcctatagtaatttttgtgactgtctttttaatatctatatttcttcattaattttagttttctttctaattacttacatggctaggacctcagaacaatgttaaatagtagttgtgactgtaggcattatttctagccctggctttacaagcagtattcctagcttttcaccattaagaatgacattggctagcaaatttaaatatatattgtttaatcattttattcctattctagtgaattcatttaattaaattggaaatgaaaactaaacatcatcttaaacttttcaaaatacatatagattattaaatagtttttctctttttgagttaaattaaattaataagtttcctggtattcaataaaccatgtattcatggaatgaactacttcattgttatcacatactgtttatatagctttgtattccagtagttgcaatttcagattttgacatcaattttcatgtctggcctagacctttataataacaactgatattgctcatttaaaaatccactgttgctcctctccagtttatttatattttccaatttcttcagttagctgcttaatttacatgtttttgttcttttaatggctgcttatagaagcacctttgtaaattcagaggattgtgattctttttccagttgattagagccaagtgacatctaaatatgcgtacagtgcatcagtgaatagggtttatgtacacagacacatcatcaatacataagacattccaagtatcacataactgtgcagccgtgccccatccttttcttcctggtgttttggtgcagccaccaaaatctgataggtatgccggttatgggagtaggtgcagttatagccaggcatgatgctgacttacctcactgtatttccttctgcttaatcttctgtagacatgctgtgcaacttaacatcactgccacccagcggctcttatggctagtgagatgccaaagctggaagcctttatacatatctctactgccttttcaaatggtaacctgaagcacatcgatgaagttgtttattcgtgccctgtggagccaaaaaaaatctgtgattcccttgaataattcgtcaaataaagggatccaggtgtgagtagaatgttgctctctttgattctttgtagctattaatgagatgatgaagtgaaacacttttgaagcaaaatgctttgaaacactgctagccttagctaccttgtccctgctagctccttcatcccctggtggggaatatactgctgaaagagaagggggatagaaaattcttaaagaaacattttgctaaactgtataggattgcatgaggtacttgggaatattatacatagaagtggtttctcacttcttaatgaacttaacattgtcactagataaagcaagtacattgtatagtataaaagttcagaagaaaaatttttgagtcagacatgagttcggcatagctccacaactaactagctgtgtgactttgagaaagccccttggcttctctgaaccccaggtccttcatttgtaaaatgggcccatttgattgttgtgaggttgaataaagttatataaaacacttattgcagtgctagggagtgtttaatatcagttaatcaaatgattagtaaagaagaactaatgaagaataagaattgctccaagatctggcagaaggtctcttgacttctttggttaagacaccctttccttactgtcctattatgcaagagaaatagtgtctaggatttttctcttcttgccaaacagcagaaaccactttcatcctaggacacagctcgggtctcaggataggtttgttttctgtttctttattctgctccatttcactaagtttaccttgttttttgttctattttttttaaaaactctacataaaaataattataccagaaaaatggactctttcacagtaaatttattacattataattttctataatattgtatttacatttaatatatactctttaaaaagctttagcttaattaagagttcattcccttcaggggaaacatttttatctcctccagctctgagaatagatatttttgtctgtcataaaaatgttcaggacagagaagaatgaaagtcatctaaaggacctggaggttacttaaagttgctaataaatggaggtttgctacattgatacagagaaacattttagagtgcagaatttatcaggatagtgggagaaaaggcaggtgtaccctgaggcccaacatcaaggcaataaactatgtttaaaacctcagagcattttcaggatagaattgacttctgtcagttaccctcttatggtgttgtctcttggcaaatgtgatgcttccatatttgatataccaaggagaggggcagactccttttgtttccaggccatttcctgggactctctccactgctgatctctctaacacctgacaggtcgtagtgcaatttgaggcagcaagagtctgagggttcatcagagaaaagaagtaggagttcactgctaacgaagggcttctctatgtactccataccaccatgtccagacactaaataatgggtttcaaagaagaataaactcacctcccagaggaagagttgatttatcttcaggcattcagcactttccacactccctcaagtatgtgatatatgaacaaactgcaattgacatttttacaaaatttttaatgttcatctgtcattactgttctccaaggataacaattatttaagcaactaattagaaccaggaatgaaattattttatctcaacagataccttttgcatgcaattaaggaatgaagtttttttaaaaaaacagaaaaagtcatacttattatttgttaattcaaaattaattaggacatccaggaacagctgtcgaggctcatttctctcagccctccccttaccttcatgctgcagtcacaaggaagtaaggcctcctctcctcacactctgcctgcctttgcgctcaaagctctctgttcctagagcctatttccctttctgcttcacctggttaattctcactcagacatcaaggctccctgtgaagctctctggcttaggcagccttcccgagtgccccatagtacctagtgctcagctttattattgcttgtaacacagctcattctgaatgtctggttgcttatctacattttccattagacaatgaccgtctcaatggaagagaatatttcttgctcctctttgcatcttcagctagggactcaatgcttgctgaatgaatgaaaagtttttggtggaactagatgattgttgttcatgctgttctgactgtttttgtttgcttgttttgactggaacaagaattccatagcaagctaatatttggggatgcagaagtcttatgtacaaaatatctatttatatccccacatcttacccgtttctgattgtttttttcttcttaaactttgaatgaaacctatatgtgaagctttgaatagcactttaaacaaagcccagcaacccctctccacctataccatcatctatgactatttcaataactcctataccagacggaagttttggtagttttagaatggcaaataacgttaaaaatcattatgaataaatattaatttacctaaacacaggtttagttttttgtttgaagaaaatactttttctttgatgagttctctatttagtaattggcctgtgttaaaaaagaattattttcaaaggtttttaggtttctatttcccctgggagtttatcttttagtgaaacggagaaatacctagggaagagtttttttttttttttttttttttttttttctgaacagtaacttcaaggggtctagcagctgtcatttgctcttagtatttcagccattcttaaggaaccaggagttagacatcaagataatcttgaagctgtactctgggcattgtgatctcaaaaacatagccatgacaatgtaaaaggaaactttatttttccagaaaatctgttgaatgggaattctagttctggaagataaagaaggatttgcatttttggccaggacctttctgacggcttgggcagaagtgatactgctcagtgctgttaataaagtgaatgggactgtgaacttcaacctcatgctaacatcctggtccctacctttgcaggcctaacgtctctcctcgttcagctcccctgattttctatctggcctatatcctgagactgtcaggcctgagctccctttctttagcacctatctaaaaactttagaattaccttggctctgaaatattccagaaagatgaaatttgattttgttagcacaaaaactttagcatgttagcataaaaatattttcaaataacttaaatcagaagttaatgcttttaatgagtaggacaagcatggccattaatcagtgttaaacaacaattttcctggctcttatacctgtagttgtcttctgcccctcatcccagccaccagttcccatcctgactcatctctatcttcatattaacagcttctgcctatttggtgtatttaccttggaaatttatgggcataaatggatcagggattgccagtgaaattctggttttccagaataacggtttacgtagaacgtttatttttaaaaatgcatataactgaccaagaaaggcagagttttatggttggtgcttttcttatgttttaggtcaaggtaactcctcttaagggaaccagtgtagaagaaaagggcttctgcacctgtataaaaacctgaaataactagaattaggaactagaaaaatggaatcacaaatacttattggtttattgaacatatgtaaataaatctgaaataagaagggaagggaggagatgaatcattattgagcaatcactgtgaggaagacactttcacagacatttatttccataacttaatattgtagggttgatttatcatcactgctatgctaattaaggagcaaaaagctcaggaaggctaagtaactccttgaaagtctatcaagacttccaagaaaggtatccatggccacttgattctgaagctcatggtctttccagtctactcacatactcggcagtgttagagattaaaaggtgctttcttagcatatagactgtgttcccaaggacctcacatcccagacaaatagaacagggcagaattagacacgtggggtggtgggaaaacagtacatattaagcctggtggagtggagagaggcatatgaggtgacttggaagagtgggaagattgtgggtaggtgagatgtgcacacgtgccaggcagggcaactggagctgggaaacccaggcatgtttgggacacagccagaagtccctcttggcagcacatgtgtgtagggaagcagttagagatcaagctggagaggcaggctgggctgtactgtggagattttgcataccatgcagaggaattggatttaattctctaggcagtggagccccattgaaggagggccatgtgtgtgtatgtggttttgtgtgtaatttttggttgtttgctcatttgtttttatcatggaaagacactgatgaaagtgggcttcagtaatattgatatggccaggggttgggggaggcagtggattagcaatgtgttttgggaaagaaaacaaaaaaacaattggacatggctactgctttgcttatggaattacacataccaaattaactccagattagaacatgcatacttgccatgttttacatttctagtaccagggatttaattcttttttttttaataaatgagaaagtagagtttattcagtttaagtagttttagtaagatcatattattagtgagaactgggaccaaacagattttctgactacaaatagatatttccattggaacagatatacatctataagtatacagacatgcatacacatatttctttactgctcataaatcaattccaattagtccttattagaatgtgggatgtataaacgtaagagaattttcatgtgaaaattgacagatacactttttaattgtcctaagatggatttaattatttttctttaatgttatttttatgagaagtgatataactttattgataatgtatacaataactcgttgttttgcacattgtttggaaatacaatgtattttgcaagtaactaaagcctaatttaaattaaaattttaaattttcaatcattttaattgtcattattattatactttaagttctgggatacatgtggagaacgtgcaggtttgttacataggtagacacatgacatgttagtttgccgcacccatcaacctctcatctacattaggtgctggaaatgatgtggaaaaataagaacgcttttacactgttggtgggagtgtaaactagttcaaccattggggaagacagtgtggctattcctccatgatctagaaccagaaataccaattgacttcacaatcccgtttctgagtatatacccaaagattataaatcattctactataaagacacatgcacacacatgtttattgcagcaccgttcccaatagcaaagacttggaaccaacccaaatgcccatcaatgatagactggaaaaaaaatatgtggcacatatactccatggaatactctgcagccataaaaaaggatgagttcatgtcctttgcagggacatggatgaagctggaagccatcattctcagcaaacacaggaacagaaaaccaaacaccgcatgttctcactcataagtgggagttgaacaatgaaaacacatggatacagggaagaaaacatcacacactggggccggttgagggttggcgagctagggaagggatagcattgggggatttaattcttttttttttattattatactttaagttttacggtacatgtgcacaatgtgcaggtttgttacatatgtgtacatgtgccatgttggtgtgctgcactcattaactcgtcatttagcattaggtatatctcctaatgctatccctcccgcatcccccaccccacaacagtccccggagtgtgatgttccccttcctgtgtccatatgttctcattgttcaattcccacctatgagtgagaacatgtggtgtctggtttttcgttcttgtgatagtttgccgagaatgatggcttccagtttcatccatgtccctacaaaggacatgaactcttcattttttatggctgcatagtattccatggtgtatatgtgccacattttcttaatccagtctatcattgttggacatttgggttggttccaagtctttcctattgtgaatagtgcctcaataaacatacgtgtgcattgtctttatagcagcgtgatttataatcctttgggtgtatacccagtaatgggatggctgggtcaaatgatatttctagttctagatccctgaggaattgccacactgacttccacaatggttgaactagtttacagtaccaccaacagtgtaaaagtgttcctgtctctccacatcttctccagcacctgttgtttcctgacttcttaatgatcgctgttctaactggtgtgagatggtatctcattgtggttttgatttgcatttctctgatgggcagtgatgatgaacattttttcatgtgtcttttggctgcataaatgtcttcttttgagaagtgtctgttcatatccttcgcccagtttttgatggggttgtttgtttttttcttgtaaatttattggagttcattgtagattctggatattagccctctgtcagatgagtaggttgtgaaaattttctcccattctgtaggttgcctgttcactctgatggtagtttcttttgctgtgcagaagctctttagtttaattagatcccattggtcaattttggcttttgttgccattgcttttggtgttttagacatgaagtccttgcccctgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaatattagatggttgtagctaagcagcattatttctgagggctctgttctgttccattgatctatatctctgttttggcaccagtaccatgctgtttttgttactgtagccttgtagtatagtttgaagtcaggtagcatgatgcctcctgctttgttcttttggctcaggattgacttggcgatgcgggctcttttttggtttcatatgaactttacagtaggtttttccaattctgtgaagaaagtcattggcagcttgatggggattgtagtgaatctataaatgaccttgggcagtatggccattttcacgatattgattcttcctacccatgagcatggaatgttcttccatttctttgtatcctcttttatttcattgagcagtggtttgtagttctccttaaagaggtccttcacagcccttgtaagttggattcctaggtattttattctctttgaagcaattgtgaatgggagttcaatcatgatttggctctctgtttatctgttattggtgtataagaatgcttgtgatttttgtacattgattttgtatcctgagactttgctgaagttgtttatcagcttagggaggttttggactgagacaatggggttttctagatataaaatcttgtcatctgcaaacagggacaatttgacttcctcttttcctaattgaataccctttatttccttctcctgcctaattgccctggccaaaacttccaacactatgttgaataggagtggtgagagagggcatccctgtctcgtgccagttttcaaagggaatacttccagtttttgcccattcagtatgatattggctgtaggtttgtcatagatagctcttagtattttgagatacgtcccatcaatacctaatttattgagagtttttagcatgaagcattgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgttgctggattcagtttgccagtattttattgaggatttttgcatcaatgttcatcaaggatattggtctaaaattcccttttttggttgtgtctctgccaggctttggtatcaggatgatgctggcctcataaaatgagttagggagtattccctctttttctattgattggaatagtttcagaaggaatggtaccagctcctcattgtacctctggtagaattcggctgtgaatccatctggtcctggactttttttggttggtaagctattgattattgccacaatttcagagcctgttattggtctattcagagattcaacttcttcctggtttagtcttgggagtgtgtatgtgtcgaggaatttatccatttcttctagattttctagtttatttgcatagaggtgtttgtagtattctctgatggtagcttgtacttctgtgggattggtggtgatatcccctctatcattttttattgcatctatttgattcttctctcttttcttctttattagtctttctagtggtctatcgattttgttgatcttttgaaaaaaacagctcctggattcattaattttttgaagggttttttgtgtctctattttcttcagttctgctctgattttagttatttatggccttctgctagcttttgaatgtgtttgctcttgcttttctagttcttttaattgcaatgctagggtgtcaattttggatttttcctgctttctcttgtgggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagtgctttacttccaactatgtggtcaattttggaataggtgtggtgtggtgctgaaaaaaatgtagattctgttgatttggggtggagagttctatagatgtctattaggtccgcttggtgcagagctgagttcaattcctgggcatccttgttaactttctgtctcgttgatcggactaatgttgacagtggggtgttaaagcctcccattattgttgtgtcagagtctaagtctctttgtaggtcactcaggacttgctttatgaatctgggtgctcccgtattgggtgcatatatatttaggatagttagctcttcttattgaattgatccttttaccattatgtaatggccttctttgtctcttttgatctttgctggtttaaagtctgttttatcaaagactaggattgcaacccctgcctttttttgttttccatttgtttggtacgtcttcctccatccctttattttgagcctttgtgtgtctctgcacgtgagatgggtttcctgaatacagcacactgatgggtcttgagtctttatccaatttgccagtctgtgtcttttaattggagcatgtagaccatttacatttaaagttaatattgttatatgtgtatttgttcctgtcattatggtgttagctggttattttgctcgttagttcatgcattttctttctagcctggatggtcttttcaatttggcatgtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattctttaagaatattgaatattggcccccactctcttctggcttgtagagtttctgccaagagatccactgttagtctgatgggcttccctttgtgggtaacccaacctttctctctggctgcccttaacattttttccttcatttcaactttggtgaatctgaccaaatctgtgaatctgtgaccaaattggtgaatctgtgtcttggagttgctcttctcgaggagtatctttgtggcattctctgtatttcctgaatctgaatgttggcctgccttgctagattggggaagttctcctggataacatcctgcagagtgttttccaacttggttacattctccccgtcactttcaggtacaacaatcagacgtagatttggtcttttcacatagtcccatatttcttggaggctttgttcatttctttttattctttattctctaaacttcccttctcgcttcatttcattcatttcatcttccatcactgataccctttcttccagttgatcgcatcggctcctgaggcttctgcattcttcatgtagttctcgagccttggctttcagctccatcagctcctttaaggacttctgtgtgttggttattctagttatctattcgtctaatttttttcacagtttttaacttctttgccattggtttgtatttcctccagtagcttggagtagtttgatcgtctgaagccttcttctctcagcttgtcaaagtcattctccttccagctttgttccattgctggtgaggagctgcgttcctttgtaggaggagaggtgctctgctttttagagtttccagtttttctgctctgttttttccccatctttgtggttttatctacttttggtctttgatgatggtgatgtacagaagggtttttggtgtggatgtcctttctgtttgttagttttccttctaacagacaggaccctcagctgcaggtctgttggagtttgctggaggtccacttcagaccctgtttgcctggatatcagcagcggtggctgcagaacagtggtggctgtagaacagcagatcttggtgaaccgcaaatgctgctgcctgtttgttcctctggaagttttgtctcagaggagaacccggccgtgtgaggtgtcagtctgcccctactggggggtgcctcccagttaggctgctcgggggtcaaggacccacttgaggagacagtcagcccgttctcagatctccagctgtgtgctgggagaaccactactctcttcaaagctgtcagacagggacatttaagtctgcagaggttactgctgtctttttgtttgtctgtaccctgcccccagaggtggagcctacagaggcaggcaggcctccttgagctgtggtgggctccacccagttctagcttcccagctgctttgtttacctaatcaagcctgggcaatggcaggcacccctcccccagcctcgctactgccttgcagtttgatctcagactgctgtgctagcagtcagagagactccatgggcataggaccctccgagccaggtgccagatataatctcctggtgtgcggttttttaagcccactggaaaagcgcagtattagcgtgggagtgacccgattttccaggtgccgtctgtcacccctttctttgactaggaaagggaactccctgacccccggcgcttctcgagtgaggcaatgcctcaccctgcttcggctcatgcactgtgcgctgcacccactgtcctgcacccactgtctggcactccctagtgagatgaacccagtacctcagatggaaatgcagaaatcacccatcttctgcgtcgctcacgctgggagctgtagactggagctgttcctattcggccgtcttcgctccaccctcaggggatttaattcttttaaaattcaattctgttgaaatgtttacttcaagaagcaatgcgtttttgagagctagtcctgatatattcaaatcttaatgacttaagttggtggagcggacttctttaaattagtgattccctaatttgcctgactgttggaatttccagggcatattgaaaatacagattatccagactcttacctctgcagatgtatttagtggttctaaaatggcacccaggagtctggatttttcccaggggccttgtgtaattcacactgatgaccaggcaagtttgggaaatagtgccttaaggagatttttcattaagcagtcttcatttgaaatgaggatcatttatcttctaataccccatgcttcctctttctcctgccttcctcaccttctgttgtctttcagttcctagaagctttaattgaatgaaagttcctcatggatctgtacctactaaaaaccacacttctgaagctacatggccaccagaagacatagctagtctgccatgtaaaaaaggaaaggtggcatgtgccctaagggtgcaggggtgagaggcagggaaatggagacccccacagccagcatcagtggccctcatcacagccctccaggagataggaaaggaggtcagacgttggacagtagcctttccttcctgctatagaacacattgttaacaccaaaaaagctgatctcttctaggggaatggtgaaagctgactctacaacttgtgcttttaatttcaggatggcacagcttctaaatggcatctaagttgctgatataaaaatgaaaattctgtgtactttgatattagcaggctttaaatacaaaccagagtaagattaaattgtttcttaatcaaatcgaataattttcacattggcagtccatttggcatctggctcatgtttgggctaggctgagtagtctgtgaaagtctggagggaaatacagagactaatcctccataagcattaggctcagaaataccctgcttccctgtgacaagtttaaattgatttgacgccaccttcaccaaaccgaggttggtcaacacttttcaccactgccactgcacactttgacttccaattttgcttcctgttctatgaagatatccccttccttcctttctcacattctccctataacctcatcttcctttcatccactctctctcatcattgtccatctctgcttcccaaaaccttatatagtgcagaaattggccaatcaggattaccatgtggaagagcatcgatttactgaataaggtagctggctcctgggggcagaaaagtgattagacacagagataaaaatcataatccctgttctcctggactcactgtccagtggggagacagacacataaacaaatacaacttgacaactacaacaatcaagtgaattatataatttagactggagaaagagagaccaaatgttatcataagacagtgtatccactacttactctctaacagatttcctcataaaccactaggcttgccaacttgttgcgtaagaaaattggagggtcggggaggggaaatacatatgcctcttggcatttcattccgtaaatacataaataatgtaattattaatgatatcatcatgttcattcaataagtttgtaaccccaaaattgatagtaatctttagaagaaattgtatatgtgtctatgcatgtacacgcatagacatatacatattgctttctgaaattttcaatgactttatgcttcttctgaagcaattcgagtttagaatttgagacccctgggtcaaaacatcttcttgagtatactgaagaacatttcgattaatttcagacatgtattttggtttacatagtgttttttatccatggtaacttatttactgtttaaaaacatactgaggacaaacaacagcagcaaccctgaattgagtgaaagtcctgagaagggcttttcccagtcagtgcatgtgcgtgtttacactaatctcctgtctgaacctaggaactggctgaatgagctagcagatggtctgtctggctgtattattaatgataatttatttttatttgtttcattaattcattcattcattcattcatttattttgagacagggtgttgctctttcacctgggctggagtagggtggcagaatcacagctcactacagccttcaactcccaggctcaagcaatcctcctgcctcagcctcctgagtaggactacaggtgcatgccaccatgcccagctaagttttaaaaactttttttgtagagacagggccttattatgttgctcaggctggtctcaaactcctggactcaagcgatcctccttccttggcctctcaaagtgctgagattataggttcgagccacgacacctggccagaaatgacattttacagccaactattacctacacagatgtttgatgctcccttgttgttttatttaaaaataggaatgccttaggtttttggctcattttgttttatcaaagatcttaaatgcagttgtgaatatttttgtttaccctcataatagcctgagaatttagaatgaatataattattgctattttcacaagtaaaattggaatgagaagataaaacagtggaatacaggtgtaactaagaacaacagaggcaagccatctatagaatattaaaatttcttgcatgtgtattaccaacattttctcatgcctgaaatcccagcactttgggaggccgaggagggtgaatcacctgtggtcagtagttcgagactagcctggccaacatggtgaaaccctgtgtctactaaaagtacaaaaattagccaggcgtggtggcaggcacctataatcccagctactcagaaggctgaggcagaattgcttgaacctgggaggcagaggttgcagtgagccgagatcacaccattgcactccagcctgggggaaaagagcgagactccttctcaaaaaaaaaaaagcaaaaaaaaaaaaaacccaaataaaccaaacgaaaccaaaacaacaacaaccaaaaacaacattttctaagacaagcaaacctactaagctttataaggcccccatccccccaagtattatcctttccatgtaccccaacattaatgaccgcaactggtactagccatgtgacatacaatcccagcacattgttgggctctgatgttttctaggaatttttctttacagccttattgatattaagctctattttctgaagacctggtttttataaactgtatatttttgcagttgagggaaaatgatctcaggtcagtcaatctgctgttgacccacaaatgaaatgaggtaggattattgttaagatggagaggtgtctgcatcgtcctacactttttcccagcctccaggtgaccatataattaaaatatccttgatattactatgtagtttaagttgcttttaattctagaagccctcaatctttctctattcaatttaaatgaaaaggcatttgagtatccagaacacactcagcactcagaagcaaagcaagaaaaatggaaacattatagtcaatgcccatgttctaccccaggatgaaatgaggcattaatactgagagttgtgattctgaataagtcttaacctcatgcacatcttagttgttcaaaaatgtgtcatgtcagcaaggtggtaacagtgaagattttctacaatcaaaatagtatagttatgttctgttgtataaaatagaaataaatggaccacattggtcagaaaaatcacactagcatattctggcagcttaatttttttattattatactttaagttctagggcacatgtgcacaacgtgcaggtttgttatataggtatacatctgccatgttggtttgctgcacccattaactcgtcatttacattaggtacttctaatgctatccctcccctagcctccacgctaggacaggcccccgtgtgtgatgttccccgccctgtgtccaagtgttctcattgttcaattcccacctatgagtgagaacatgtggtgtttggttttctgtccttatgatagtttgctcagaatgatggtttccagcttcatccatgtccctgcaaaggacacaaactcatccttttttatggctgcatagtattccatggtgtatacgtgccacattttctttcttttgttttgttttatggaataaaaagttcggcctttttactgcatgaaactaaaattgggaaaggtgggcatggatggggtgggagggggttgaggggagcaggagatgccctccccaccagctcctggataatgacacctcacttcttgcgtgatttctggcatcttcccgcctgcaatgccggctctctcagcgtcttggagaaggggggatcacacactcatcgtcgtgcttggagaatcattgtcattctgaaaggagtggaggaagttccctcctagctcgccctcatctggaggggtgcctggaggattgctaatactatttacgttgttaggataagtttttggaagtcatctatgtcgcctgaccctaacaatccgttcatgtggtgtggctccatgccgcccatgctgcccatccgaccgtccgagccgggacccatcgggaagttggaccggctgcctccaggcggcaccggattaatcgttgtgtagatgtcgctggaatttgttgaatctgagggactgggcatagtgggtgttcctggagggccgccaccaccagggagtcccacataggtaccaggtgatgaggagtatggaattgagttagcactgttaggattgggccagggtctgccggctcccgggcccatgttaatcccgggcatgggggggccgagggaattgcgtggtggtctcatgccgctgccataattctgtgggttgggacccatgggccccatgcctcggggagggttcattctctgcattgatcctcccatgtgggggtggccttgttgtgcgggatccatggaattgggcagcaatggctgtgtcccaggaactcctcccggaggctggtttcccattctgatcggggggcctggggccgcctgcgtatcgcggtgacaaaaaaggctgactgtggggtcccatcatgctgctaggattgtgaggtggaggctgtgcgtgcggcgagggcagtgaccccggaggaccctgaaagaaacctggggggactcggcctccaggcatcccatccttgggggaatgttgccaagcacggggcttggggcagctgctccactataatcatgaaaggcttttgcttcacttgaatgttcacaagtatctctccttttaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctccctctctcgctggctggcgctctcctagcagcgctcccctccctcccgagcaggcgctggctccgcgctctttccagctgtcaaagcatcaggcccggccgcggccccatcgccctggaactcctcccgtgccggcttggcctggggtgccgccgccgcctcccgcaaggccgcccgctctccggtag

SEQ ID NO: 35865 - DNA, 248680 bp, Homo sapiens; identical to SEQ ID NO: 35864

SEQ ID NO: 35866 - DNA, 4876 bp, Homo sapiens
attggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccct

SEQ ID NO: 35867 - DNA, 4876 bp, Homo sapiens; identical to SEQ ID NO: 35866

SEQ ID NO: 35868 - DNA, 9318 bp, Homo sapiens
cgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccggtgagccgagatcccgggcctgggagctcccttaccccggcccagggcgcccctccccggagactgaccctcccagcccatccccgccctgcatgttatcctgaccctgggtcgcgtcaccgagctgtccccagccctgccccgcgttcctgagctcagatccagacccggccggaacgctgttctgtgcggtctccatggaggcgaacccttctacccttcacgcgctgacagcttgtaccccccgtagatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgagtcactatcccattatccacccccacccccgggtggaacggtagaatggagacttggggtaccgtagggttgagctcaatatctaacgtcctatactcagtgcttggaggagcctgagagtgttggccccgaatgcaaactcttgtgtaggtgggaaataccttttctaaaattctaaattgtctggtgagatttcctagaaaaatccgtaacaaaattaagcaacggattggaaccatttttcttctgtgtaacctgccccttaacccccacagcccagaccaagcataatcttgattttaagatgacattgaagccaatctgtgctacatgtctcttcccatttcttaccgctttcttgtcttcattctgctttctttttgttgactgttaggcttagcgatgcaggctttggctttttttttttttaaaatcagaatttggaagttggccggcattgcatggaagtttaaagtcccagtttttgatagatttaacctctctgacagttgagcttgaacactacataatcaagacaacttttggcggattctctatacttaaccagtcactgtgcaagacgttcaattattcaacatatttttaaagactctgcaagacatttattcaactagttcagcaaatacttactagtgtccaaatattggggaagtgttaacatcactggatagtgtgctgcttaaacagttgtggaaacttcatccttgtccccttgcagctcattttccatattctctcactaaaagcagataatgaattttacagactgttccatctttgtctttttctggaagctttctgcacctacttgtctgggctgtcattaggaaaacagtaacgcagaataaagtcaaagactcagaaattagctgaactctccaatgatgtggactttgcttttacaggaataactaacttactttgttaatttagtgacaatggctctttgaatcctagaagtgaattactgccttggtataatccaagctcatgttttccttaccctacccccaacaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctggtgggtccctgttctcattgctcctgtctctaagcctcctgtgggtgcctttcctatcctgttaacctcattaggtaacattttgggcttattctaagaatccagtgacttattttagcatgtctataaggtttccttagggattttgcagtccatcgtaagtagaccatagcagcagtccaagaggcaaagacttggggaatgttgattacaggaagttcttgtttgaacacgtttttatgttgatagtgtaggtcaagattaaatgtctgtttgcttttgcttcttagcatcaaggtttgggaccttgctcagcaggtggtactgagttcataccgaggtgagtattctttcatttttagccctggtgttagctgttgtgtttttggactttttgaactttgctttgatgttaggagcagcaattccatgttctgatagttttcttgtaaaacaatagtcaggctccggtatctactccttgtccttttctcaatttccttgtttctttctttctttttttttaattcgactagtcaagtgcagtagtgaaaagggaggaaagaatagaacaaggagtttaatctgtaactgactgaacaatcaactgagataactcactaccttcagaccagccagtttccctgtttctattgatggcctcaccaccttggcaacacagggctcaaactcggtccttttccacctcttctgttttcccaccatcggttggccactaagttctttttagtcttttccactggtcagtcaccttcctgtccatttctatgcccgtattcactttcaggctttaccttacacaggcagtggcactcatctctccactagcaatctagctcttttggtcttttattagtttcttgtggcctgtggattaaaatcccattttcttgtcatggcattgaagcccttttactccatttcctctcttcaagcttactagatccttgacattcttgagggataaatcttgagacttttaaatcttgaacttttgagtatttaccttcataaaatgtctgttttctggtgagaaccattacttttttaatgcccctctttctgctcactttcattaacagcactagtagttaactttatcttgggagccattctttgtgaagataatgtctagagccttaatgtgtacatggttccaaggtttagatgctgggggatcactgtggttctctcaatggctaagtgcctttccctgccatttctaacttcaaagtacatgactaagttataggccagagaaatcactgactcatatccaaggtccagtatcctggaccctcagggtcacttggaaatagttttacaataatgttgaatgcccagctgtgcgcagtggcttaacgcctgtaatcccagcactttgggaggctgaggcgggtggatcatatgaagtctaggagtcagagactagtctggccaacatgccgaaaccttgactctaccaaaaagtacaaaaattagccaggcgtagtggtgcacatctgtaatcccagctacttgggaggctgaggcccgagaagtgcttgaaccctggaggcggaggttgcagtgagtcgagatcacgccactgcactccagcctgggcaacagagtgaaactgtctcagggaaaaaaaaaaagtcaatgttctatgtctattatatttgctttttatttcttagacatatgatgtgctttcctggttaatgctaactctttttcagcatttctgccatgcagcctttttgttagttctttgtgtttgtgtcttattccccctgctgaattccaaatcctttattatttttctattttttgtagagacagagtcttgctatgttgcccaggctggtctcaaattcctgggctcaagtggtctcctgccttggcctcccaaagtgctgagagatacaggcatgagccactgcaccctgccccaaaacctttgagggtagaggaaccatgtattcatcttttgtacaccaccatggtgcttgtcccagagctttgcttttttcaagtgagcaataaattccttttcttacttcttatcctgttggctttctatgaattctagggctaggaaagaactatggaaactggtttaattccatccttctgcctcagggaagggccacattcagactacctgggaaagtctggtaaaatgactgtagaaaaggtttccacagcttctaattaacatgtagcagtgactttaaagttttttacatgtagacctcctaaaacagttttgaaaatctgtgccccctcatacatttttaaactgatacctaaaaatgcttatttaagtagttgcagagaaggtaatttctggcatataatttattgtgtgcttatttcaagcatatatttgtcaaaattttagattcgcaggttaacgctacttagtttgcatgaatgtctaccaaacagcctaactggcaaaagccagtctgcattgtaaagccagtggaccaagatagactaaattttctgtcagaaaaagtctgactttgtttttaaattcagataaagttgttgaatatgtccttatcacaatgatctatcatattttttagttctcattattagacagaaacagagttaagtcacagagccatacttgtgtttgtggtgtgactgaaacaagatcagcccccttcattgaattttacctagatgctctttctttttgctctttggttcttatggaaaagccccttttgtcccttagtttagaacccttatatttttatacccctgagcattgtagcgtggaaagatctgggatgaatgacaggtatgtgttctttctatgaagtgggagaagagtgattgaaaacagaggcagttcaattttaagaaagagaacattagagaaattggctctcttaatactattagcgcccagaactccctcaaaagtttttgtatactacttggaggtgtgtgtactccagtatgaagactgctattctagaattatttagccctcacgtctaggatgcctaaactggaaattcctttgttattcttactaagcccctaatttctcattcattatcttcactaatacgttttttttttacaaggctttttaggttttataagtctataaacttctcctcttagcttttgtctaatccataatctcccacaaaatttgttaaattgcatcatgagaccagccctccctccctcctgccccttgattattcctgggctggccctctagtaatgcttcagcttgttttctatcatatttctctttctctctcctttatagctcatgctgctcaggtcacttgtgttgctgcctctcctcacaaggactctgtgtttctttcatgcagcgaggtaagagatagctccttcttccctaaacacactccagccatccataggccaaagtctctagtggggagactttctggcctgcaactgctcctttggattatgaaatcctttttctgttccaccttcctctaggacaatagaattttactctgggatacccgctgtcccaagccagcatcacagattggtgagtctgagattcattggtgggagaatagtacttggaaccctgatagaagagactgtctttggccagtgtcaaagcatagttgctagatgcccagtgtagttactgtgacatgagtgacataatctccttcttttccagtgaggctctgctaaccccattctgtgcaatgaataccaagaggaagggccagttcctgggtgggtgatttactttattagatggtaggacaaaggggccagaattgttatcgtcatgattcgtgcctgaaacttgcctgtgactcgtgtccagaaagggcaggaggctgctgggataaatggttatgaggctcaaggatgaggacactgctgccttagcagggtttgggaaatcaaataaaggtgctcccaggatttagagtgatatcatttgagaaactgcttcttctgtactctgagttttggtccagaccctcgtctctcctttgcaggctgcagtgcgcctggctaccttcctacctcgctggcttggcatcctcagcaaagtgaagtctttgtctttggtaaggcagcgtgtcagacttcatattgactctgggaaaggggaggaggaaaaagaaagagctgactccacaacacacaaggcccttgttgctcagtcttagccctcatggacactagatgaattatgaattgagggtggggaggtggggtgatgccaacgtagttttagtgtagttttggagaacatgattattttcccagtggatttgatttttgattgattgatccagcttctgtattctgggcatggctataagtcagtgatccacaaagcaagtggattgctatatagcgaattctgtcctactgtgggtaggtgtagcgctatcgtggtcatgaggctgtgtatatggtgacatagtttgtggttaaaataataactgcttcgttcattaacttaattttcacaatgatccagtgacttattattcctactttgcaaaagagaaaactgatgctcagaatggttaacttttacaagctcgaggaactaggattcaagtctttggcacaaaagtccatgctcttaatcactatgacatgttccttctcttctacaggtgatgagaatgggacagtctcccttgtggacaccaagagtacaagctgtgtcctgagctcagctgtacactcccagtgtgtcactgggctggtgttctccccacacaggtactgttctttgtcatcaggggcctgatgggtataaatgggaaccgtgagggtgtgtgtgtatgttttcaaagcattagctgatgaagtagttccttaaagcagacagtgttctagctgaggtttcggaacatcgaagatctcttaagtgtgaagtagaatcctttgggagtcaaaggatttttcagattagatggtttctgtctgaaatggctaaaatgtgatttcattcctgcccaacacccaaaatggttaatgttgtgggcttctaggactgtgagattggaaaagcctgtgtttctgggttattgctgaagctatagagagggaccagatggggtggttagttgccaggatggttgtcaaccctaactttgcttcatttccctcatctttacttgaaacttttagtgtggacttgtagtagccagattagccaaaagtgggaatcaggctgcctctcctgggtcactttacagtggcggcagggccggcccagttaaggttttgtcttgggatccaggctggacctttcacaaccctctcctccatctgatagtgttcccttcctggcctctctcagtgaagactgctcacttgctgtgctggactcaagcctttctgagttgtaagtgtgaagtggaatcctttgggaatcagggaaggggagcagtgggtgggcgagtcattttcctcttcagaaaactgtgttgtgcttttggagaacagattctccatctgtatccgaagggacttggtaatggaagcaggctggctgttgaccctgtccattcctggggcacattcacaaccccaaggacaagccgtgtccttggtagaggggggtggtaggtgaaatttttaagtctagccctccagcgctctcccacaagggggcggcagtctaccctctcacataaagaactgcgtatgaaatgcagcctgctacagggtaaaaggcagcacctggaagacctgaattgtacttccctccttgccgtgatttgctgcctgttactgcccctcatcactgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgt

SEQ ID NO: 35869 - DNA, 9318 bp, Homo sapiens; identical to SEQ ID NO: 35868

SEQ ID NO: 35870 - DNA, 9123 bp, Homo sapiens
aacggtttcccctaaaccgctaggagccctcaatcggcgggacagcagggcgcggtgagtcaccgccggtgactaagcgaccccacccctctccctcgggctttcctctgccaccgccgtctcgcaactcccgccgtccgaagctggactgagcccgttaggtccctcgacagaacctcccctccccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttcagattgcaggaggagatgcttcagagagaggaagccgaaaacaccctgcaatctttcagacaggtttgtagactctcttcccactcgcagccgcctgaccccacccaacacaacccacgagcaattctaaaagttgcttaactcacgtctaaaaagtgcaaaacttcagggctgcgcgtaaagccctctagtggcgggaagaccacaggttggagcttctcatgattagaaaaatattaataaaaccccttgagcgattttttttttttttttgagacggagtcttactctgtcgcccaggctggagtgcagtggcgagatcttggctcactgcatcctccgcctcccgggttcaagcgatccttgaatgatttctaagcagttccttgggacataaagaaaaatcttttaactttttactttgtttcccaaatgttgcacagttttgcaacacattgaccttctggtttcgaacggttacaattttagattgtggtttgccaaagtcaagttgcttaatttttacaaggccacaaaaagcgcaattatgccctgcagtttaaaatggaaaacgtgttggaagataagaaaacttagtttccaactggaatggagccagcaagtttcttttcttctttgcaaattctattgtgtcattaaagttcgatggaagtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcgtgttttttttttttttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccgtaaggctatgaactccaaatataattgctgacaagataagcaatcctcacgcatccttttgagaggaaataaaatcttagttgcaagattacatattctgatttggaatgctgagctttttaaatggaaatatagaaggacggctgaatcagcaaaaatcctttatgtagtttcattctttgcaagcttgaccagtcattctgaaacaggctaactgaactgatacagtggcaagtgaaaaagacatgcctttacaggatgagtcaaaggagttttagaagaaaaatccaccagagaaagccaagcaaatacagttcagagttacatttcttttccattttttcctgaactgaatctttggcatgcatatcctgaattgggttattgaatataaatctagccttgtacaatggatgccagatgactacatatttgctttggagcctaaggataagtttcaaaagatttgagtggagaagaaaagctaaaactcttgaagcacaagtttctgttctccatgtactcaagtgtacatgaagttgtgaaaatttgtccacctctatcatcatgttattccatgaaattacaaaacaaatcttaaaaatgttgtggcatagattttctagatttaaaaagtaattaaattaaatgaattactttattttttgagacagagtgtcactctgttgcccaggctggagtgcagtggcactatgttggctcactgcaacctctgcctcctgggttgaagaaattctcctgcctcaacctcccaagtagctgggactacaggcatgtgccaccacacccagctaatttttgtatttttggtagagacggggtttcgccatgttggctaggctggtctcgaactcctgacctcaagtgatccacccgtctcagcctcccaaagtgctgggattacaggcataagccaccatgaccagccttaaaaagtaattttaaaatatcactggtaaaatgtggattcagtcatgattgagtgcagtttaccatgtgtgtggacatttatttattttaaaattgtctgatcaccaccttgagtaaaacacaagcagtcacaattaaaatatattagtgagcaggagaaagcacagcatattatagcactgaatgatttataaacctattccagggtcataaaatgtgtcaacggcttttctatagtaaggagactaggttcagatggttaatctaagacaaataaatgagataagccatacacttttacatcctccatgtcctgtcttttctctgttcaaaataggatgttgacaatgcgtctctggcacgtcttgaccttgaacgcaaagtggaatctttgcaagaagagattgcctttttgaagaaactccacgaagaggttagtggagtgactttcggggaatgaatgagggtaaggcagcccccacggttggcagagctgaccgtctgtctgttctttttgcaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaaggtaggaaacaaatcagtgcggcttcaaccaaagaaaagcattgtgttctcaaaaccccatacctgtgtgtgattcctaaatatcctctagctccaatgcaaagctggctttgacttcttgctcatattgtgtttgccaccacagcctccccaccactcacatcacctcctttatttatttatttattttcttatttatttatgagacagagtcttgctctactgcccaggctggagtgcagtggcaacatcttggcacactgcaacctccgcctcccaggttcaagtgattctcctgcctcagccccctaagagctggaaccacaggcaagcaccaccatgcccggctaatttttgtatttttagtagagatggggtttcaccatgttgaccaggcttctctcaaactcctgacctcaggtgatccaccctcctcagcctcccaaaatgttgggattacaggcatgcgccaccacgcctggccacatcacctccttcagaatagcagactctcttccccctaaccttgcctccaagtaaaccccaatgccatacctttgacctccactgtgttgaaatgagcactgtagagtgaactctgaaaatactaatgtcagtactccactgctctttccctggctttcaaaacagaaatttaaacctatactggaagacattcagtgagaaatatgattttttttttctaagagagtcaaaagacttgaatgtgagcaatctacatttctgttttcttcccaacagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaattattgcagaaggtctgtaaatggttctgggaacagctgggtttttctgagaaataacaccagacatctttctcaccccctgcagaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatattttaaaatcagtgaatctgaatctcagatacagctggctaatttgagaggttcaggtttcattcatgcctactaaaaaaagaataggcttcttcttccagcagtacacacagccaactaattatttggctcctggatgtgaagttgagatagcagtcttcctgtgctccagaattagtgatttgctttggtgcttaatttgaagtgggagtaagcttccttaaaccacttcctaaagcagctacatgaaacagcttcactagactacctcaatatgaggaatgttttgatcctggacatatggtgtcttcctacctccatactttatagattcctaaacccatctatataatacaagcatgtgccatacgatcatttagtttcttattacctccctatgccaggaaagaaatagttgcaatttattgtagtcatcatgaaatcttcccttgcacataaatttaaaatgtacctgctgcacattttaatatgtcttaattgcttttaaacttggctgtattgtgtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatttgcacaataaattacatatatttagcaggatttttatttgccgtgatatataggataatttagtctttggcatgtggcattatatttattttggtttttttttttaaacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 35871 - DNA, 62888 bp, Homo sapiens
gcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacggtgagtccgggcgccgctgctccctccctcctcgctcgctccctgtccgctgcgctgcgggcggggtcggctcggatcccgccggcttctctggcctggtccccggggagggacggagacccggggtccgggtggcggagcgcggcggtcagtccagccggcgccacacagactgagcgaccctggggtttggggaaaacaaaacaaagaggaaacccaaacagtggcacggagaactttggattatttatcctcccttcccaccgccggtagttccccaggagcgcggggctcgcggctctcccaggaccactgctccgcctggagtgtcggtttttgccgccccaggttgaggtgtgctttttgtctaaggatccttttggccgtgctgggtttggagagatgacacctttccccaggggtacttggcagcccgaccgcgcccctctcccagctccagccccacggctctgacccctgcgccgcgagggtggcagggtgtctggaccacctgtcctcgccgtgtccccttcttgcctgcgttcagtccgactcatgtttcaatgtatcgtttatgggactggacagctaacgtggctgcagtgggaatgatcaactttatgtgtgtgtgtgtgtgtgtgtgtgtgtgtgtgtgtgtgtgtgtgtgccttcgatgcactttacatttttcatttcttttctccctcacatcaaagaaaaggccgagtttttagagcagattttagtttactgtcgcgggcgcacgctgtatgcatgcagtgttcaacccattgtgtgcaagacggagacaccgcgactggcgggtgtcagatgcgctagggtgtgcctagggcggggtggagaggggacgtgccattatcaggtacagaagccgcgtcttcaccggcgcccagcaaggctgggattccgtggtgatgcgctgtaatgatgcccccaaatagtaggcacatatggcaggctgggatggtcatttacaaaaatagaataaataaaaactaacgttttttagtttagcacgaagcagtgcggttgtgctttgtctatagtgaattggatggtgtgtgtgtgtgtgtgtgtgtgtgtgtgtgtagtgggggaatgggtggctactccatctttgcaagctgaacaaaggaagtgatcagctggcccctgggaggctctgcagccgccctagggcagagctttacctgccacagtagttgatttgcagggtccgccaggttttgttgtgggcatgagtctgtttgcacttgttcccttaggcttggaacatcctgtgcgtttgcgattgagatgcagaaccttcccctctgcaggcaggaagaagcctcccttgcgcctactatgttttattgtcaaatggtttatttcttttgccgcaccatacctttttcatgcaactgagcttcacttcacacaaatgcaccccacccctaccagcttcccagctggtgctggggaagaaacactccccagggagaagagttgaggccagcagggatccttttgcctggtagaggctttgggttttaactgatcctcctttaccactacctgatggcattcactttccattattgaagaaacatcgtgggtcttttacaatgcacagtattgtctagtgctgactgtcttgtctttccaaagagctgtggaaattatcatccaaaaaaagaaagaaagaaagaaaaaagaaaaaaagaaagagaaaaagctgattgggacaaaagctcaatttttacttatctccccaactcaggagattgaaccacagctctcatgctattctatgctggaggtatgccacatgtatctgccacttgctttaacatccagtatatatttgctagttttcctgtttgggataggcagagaaccgatattttttttccctcctagactgcagtggttcttcttctggactcagcctgtgacatgacattgagagccacacccattcttctaggtatcatttaagccacctttaaggaaagataaggaaattcagcattgataacttgccttaggagctccagtaaatgtggttgtgccccaatcccaggaccagatttgcagtggattcccttttgtctctggttgaatgatcttccctggggtacatccttcattttcagtgcggcttccatcctttctctctgtgtgtggggcgtggtgctgcatagcagcctctgccttgaagctggggctgtatctccagcagctgttaacaggagtagacagtggttgtgaatttcttcaaaccaggctgccttgaattcattggttttaacaaccaaggggatgaaaaggaagggcatggcaggaggcggatgttggtctttggggataaggaatccatttgtaaattttctcatgcttcgtttttgcatttccatgaacaaggaatctattttagaataaaatatttatgtatgtttgcatgtctatagaagattatagttgtctatatactgtgaaggttgaggtaccttttctagatatagttgtaaatataacaatgtagacatagatattcatgtgcagcaaatatgattaaagatctaagtataacatataccccctaccatcaattctagtacattttaaaaatggtaacatggaatttgaattgaattttctatgccacctctattcctttctgtgaaggcagccccacccagtagctgaagtgtcactacaatctgaggactagtgggggcagtctttcttggcctggtaccctttgccttcctgggaactactttctaccactgttttgggtccaagataggattggttgtttttgttttgttttgttttttcctccttccacctatttttattgccctcctgagattaaggcattcttactatccttgttttattggtttcctgtggtagggctggaaatgagggggagatttctgtgtccctgttggagttggctcggagtagctacctttctcccgagtagctcccaagacttcagatcttcattgtcccctctcagggcagctatgtggattatctgttctacctcaacacaagccttgcttctaattatcagagactggcagttttgggggttcgacagatcacagcaagggatcttcactgtctcgcgatgggcctggtttacagatacataatgattatcacttaaatggattaattgatttaaaattgttcctaataatagcccatacctgttgagtgtttattttgtcaggtattatgtttttttatgccttacatgccttgtttcgttgaatccttgactcagtcaatactgtctgagagggactatagttacccctattttacaagttaaaaaaatcttagaaaataaaaaataatttgctcagggtcagagatttagtaagtgttggaggccagacttaaacctacatacccaactgaaattaaaatgcatgtccctcaccatcacactctttttggtgtctccgcctctgcctctctaccattgctgttacttgacattggtagggcaaatggtttccagaccatctgcactgctgggaggcatatttttcttgtcactgtcaacaaatcccacaacatggtctttcctaccttttatattaagtacatataagaacacgtttttgaaatagtagtcaccatcaattctacaggtaggaacttttgataagttacagttattgttttcctctgacatacgttacaacttgaagctgaccacaggaatgggccaggtcctaatacttaggcacttaggttccagtgttttatatgtattttcatattagaacctccacagataatcatttcccagttaaggaaggacattgaaatatggttaggtgaagtcagttatttagagttgcctggtgagaatattggggcaaagctagcaatcaaagctaggccttgtccagcttcaaagctgaggctgccatggtgcagcagctgcctcttggaggcacgtgcagctgagatgttgaaagttgtggaaacagctccagaattccctctaggagacaaattatagagaactggtcttttccaaccactgattggatttctgtaaacattgtcttgcagataatgcatttgttttgcattgaaagtttggttgtgtgtgtggtatttgggaattgctggaagacgtatccccagttaggaatacaacttgcaaagttcggtctagggcgtgtagtcagagctctgtgatctcccttgaaagggtgtgattgtgagtgtagtaggtgccactggaatttattttctttttcggagaagtgaagggaccttatgaactggagtaacacccagatctctgcagcagttaagctgggggcctagaactagactagagctagaagaagggacaaatgcaatccgacctttggatctacacattcctcttgcttcaatgggtgtcatttaagaattagaggaaaatattaggagatggagaactagagttgaggaaaccaaaagaagaggagtcacagaaaaccagctctctctgtgcaaggcatcttgaaaggggaattccagagtcaaagacagaagaaaaatagcaaacacttaagaatggaaagcatcttagatatctgatcatggaagtctcagcccagtctcagccctgcctaaagtgttcatttgttattttaaattttgagcaggtatgtgctgattcttagccaggttattccttttcctcaaatactaggagaaggcctcaggtatagaaagagccctgaacattagtagctgtgaccaagccagctgggcattgggaggaattctgaagaaatagatttcctgagagaattcaagtctatgtggcaagaccctcagtttgtaaataaaaaaccttcctgcttattgcactgagctactaagaggctcaaatagtggccatgaaagtggtctgtgaactctggatgtgttcaagagagcagatgctgatttatatttataaaatctcaactactttggaatgtggaaattaataaaagaagacttgacaatggtctggtttagaaagagactacttaggaaatgattttgtaaaaataagagttttccaaaacaaaaataaacagcgttatataaaaacttttttgttgttgtttagttacgttacagtgttcctaagaattttatgcttgtcatctctgacagtccgacacaggccattagaccgcctttgaacttttgatacagagactctcccttaacctgaatagagggcattttcctaaattaattgaactctgtatcattttttagtcctgatcaccttctagcctagagtgacacatgttatgaagatcctttcagctgtttcttcataactcgttttttagtggcttgactgctcttttttcttcagttggaaaaaaataaaactaaatttgaaaagaacaacaaccaaaagaaaaaaaaacccctcctgtcctaatgggccctctgttctttacctattgacatattttatagggccatttgtgtttgcttattacatttgaaaaacggcaaaatgtttacagtagtaggaatgagtctctaaggtgtaaatgttttcatcctttgatgaaatcagtgcatctaatcagaaggagacaggaaatttgaatatgtcattacctcttgtgatggatatatgtgtttgtttgtttgtcttttgttttttgagacggaggtttgctcttgttgcccaggctggagtgcagtggcgcgatctcagctcacggcaacctccgcctcctgagtagctgggattacagacatgtgccaccatgcccagctgattttgtatttttagtagagacagggtttctccatgttggtcaggctggtctcgaactcccgacctcaggtgatccacctgcctcagcctcccaaagtgctgggattacaggcgtgagccaccgcacctggcctgtgatggatgttaataggagaggcgaactgctccctggttactccctcctcaaatcaatgctcaactttgccttttctcccactttctctaggcaaatgagaaacaaataagaaagaccttggaaaacccagagaaatcgactcctgtattttcagactccttttgctgtgaagtccctctttcatcaacatatgcctatttcaatatacgaaacacaggtatcctcccatccctcaaaaaaagccaaagctagtttggtggaatagaatgaacctctcaatttggcctcttcttttggttccagtccctacatgaagcccagtataaaaactacttttcttgaggaactttcttctgttaattagattgtagggaacacagtggtaagaaatatgggactaagcatggtggagctattattgttaactgtcttagtaaaagctacatggattatctcatttaactcacagcaactcttatagctacagttattaaccatcattttgcattctggagagaggctcagagaaactaagtaatttggctaaagtcacagagctgaaaaagcaagatcctgggattgatccctgcaaaggtgaattcgtttcataggcaagaaagcagtagttccataggcacaggtgactacctcctcccgccattagccattatctccagctgtccacacctgttagctcctaaatgtgggtcagtattcacagggtggaaggattggggatggtctggccaaccctgtcacatcactattggaacaacaagtgagttgtgtgtcctcttgacagtggttcatgcattgcttctgccagctgtctgagttagcttctggcttttgcccaggagcatgtatgagtacagggtggaaaagcagatgctgtttttctgccttgcttcagagcagatctgggtctaaggccctttctcactctctatccctgtcttcttcccagacatagccaggctgtctgtttcccttcagtcacgcggagaaacattaacaggacacacccagcactttaagctagatggggaagctccacagtagaatggtccaggaacccatttggaacatctggaattcaaggacaacatttctcatggcctaattactatttcttttctctggaagtgctggacaatgagattttaagggtaaaacgagattttattttttaagagaagagttcctcggactagaagagcaaaagaaccatcttgttcttggatgcggaataaggaagcgaaccctggagggagtatcagcacactgtgcttcaggcctgcctttgcctctaatttacttgtcactttgggcaaacccttattatccctctcagattctgcatcagtaaaatgagggcattgaaccagatgatccttgaggtccctgccagtgcaaatgaccctgtgagccagcccctcctcactttgttccaaattcacagagaggagttctaaggccttcctgtgagggaaaagagagtagggagaaagtggatgagagcgaccattgttggctgaaactcagagggaccagccaacatctgtgttggatataagcggctttggttgctttttacacttaaaatcccagtctttttctcattcagggagtagacttaattaatagattttgtgcagaggagaaatggaataatgatgactgagatcctctgcctagtagagcgttagtattaattcagatgaacattattaaagtgatatcatgattcatttgctgtcacatacagtctttctttaggataaggctactattgataagggcatgaaggcgataattgcccaaaatctagactggccaaacaaacaagaaaacaaaccaaaaacaactcggagtctgtatctgctcaccaggctcttttttcagctgctcttgctaatattttaaatatgatggctgccatccaatggaaataatctacccccaaaggcccaatcatgccatgtacatgccatgaggatagggatggtttttgttttgttaccactgaatctccagcacttaatctttggttgtcacatattaggccctctgtatttgctgaatgagtggatatatttaacacttacctacaggaatgatttcaagagagaagatcacctgaaagtgtaccaatttgttcttgtacataagcttccctttgacatctttctagaatattaacttctaaataaggccagactcttaaggcataggatcactgggccaagagaaacatgacagctctttagcagaacaagcaagtcattgtaatgcagggcctgacctgggcacatgtgccagaaagtccatccatcacttggacttctttcttgtctggcctccagtcctctttttcttccagcttctgcatctgggctcattctgagcttgtttcaggggcctacctggatacttattgcctgcaacaaagacatcatttctcttactgcaaatgatttgaaagaattaatgcagacctttatgtcgtctttcatatagaggaaactgtcaccatgactctttgaaccagaatacaacatagatcttaattgaggtctctttctgcctttgcacgtaaactacaaagtcattagagttattagcagcaactagatagaccaatctgcatttgtaaagcaaacttggtattttggaagtattggttaagaagcagctcatagttctttttgtttccctattagggctggacatttacatggaatggttttgtgtctgtgtgtttcaaaagatttttagtctcttaccccactgcacctgtcagctttctctgagctacatttggagctattcttattactcgtttttattctaaatgtaattctttggtttgaggggtggggccagttaacacagattttaccaggcttatctctgggtacaaaccagagagtttatggtttcaataggtttatgtgtaatggtaatcactagagccttttaaagggaggacaaaatgggagaatcaaagtatattcatggaaccaaaaacctttgattagaaagtgtttgaagaactatgtgtgttataagagtgtcatatataatataatcaggtatgataaaagcattttgctattttttattgcataaaagatatttattgaccataagctctggcaaaagttagtttaataataagaataattcacatttattgtaccctgtgtaaagtgctttttattcattatctcacttaattatcaaaacaacttaattaggtagatagatttttcaccaggtctttctttccattttattgatgaggaaatttagagagattaagtaatttgcctaatatcacacaaggcttaaatgatggaaccaaaattcaaacttaagtttatgtgacttagagcccccattcttaaccccacggtatggtgctaccttaaattatccctccggagggataataacttatccctctcccacctctggagtcacaagactttgattccaattggagttcacttacttcaagtccaggggtaagtccttctctgcacctgtttcctataaggtatgagtggtgtaggttatgggggacatggaaaacagttggtgcccctcttctgcaagggggatggactccttagcactgcttggcatcaggaagccctctagccctcctgttaagagcggctttgtttctggcatgtccaaagctgctccacactgttatacttacacaaacaacttgccagggagattcccaccactctcagcatctttgcattgaattagcaaaactaccaattagggattcttcctaacgtgaatttaaatgccaccttctcatttcatactccacactgcatgccccattctcttaaatatatcttaagtaagattcttttgaggtttgacttactatggctctgtaaaattcatactttcagagtctccatggagataacttttttctttatctctccttaaaaaaaaaaaaacgggatacatgtgcagaacgtgcaggtttgttacataggtatacatgtgccgtggtggttggctgcacctattgacccatcctctgagttccctcccatcacccccccaacccccaacaggccctggtgtgtgttgttctcctctctgtgtccatgtgttctcaatgttcaactctcacttataagtgagaacatgcggtgtctggttttctgttcctgtgttagcttgctgagaacgatggcttctagcttcatccatgtccctgcaaaggacatgatctcattcctttttatggctgcatagtattccatggtgtatatgtaccacatattctttatccagtctatcattggttctatgtctttgctattgtaaatagtgctgcaataaacatacgtgtgcatgtgtctttatagtaggatgatttatatttctttgggtatatacccagtaatgggattgctgggtcaatattttttttaagtctaatgccccatcttatgaataataaaaccaacacccaagtggtacccacctaattagtgtttttgctactatctgttttactgtgggacacaaggattttaaaattaactaaggctttttttccattacaaaataagtatgctggttgtagaaaaatttaccaaaatcacaaacaataaggacaataaaaataagctacaatgaaattactcagagagaaccactgtaaactttcagtatacccatctagatttttttttttgactatatttgccatttattaaaatgattccacatattgtttacgctgttttatgccttacttttcattgcacaatatattacgacatctttccatgttttaaatatccttccataatttaatttttaatagctatatattattacattccttggaaaatctagttaaatgaatctcattttttttgcattgttttgattttttccgagatctttgcattaacaacaaaaatgaaatgacagatttattgtcggttgttttttagttgaagccaaactaaaaactgcctcaggatgagaggttgagtaatcttcccgaagtcactcagctcacgagtatcagactacagattgaaatcccagtgtctttactcttagccttatattcttgtcaccactcattccttcattagttgtgccattttacatggaaaactctgctttctctcatttcctcccgctcttgaatgagcacatttgttttctcaccgccacctttgccttcctccctgtcttgctgaggctgttgacatttgtagaggtacactgtgtcttgggacctgaagctacgcagctggagaggaaacatggccagttcttccccactccttactggctcaacctataagcttggaagctggttttaattttacattttctgtgtgtatgtgtgtttgtttttaaaacttttttccacttaattctttcaaggagacctttatttgaaatcatgcactttttcccgcaaagcgaatctgtgcctcaaatcttgatgagattactttgtttggggatattgataaattcatagtggggtttttggtttatccaattaaattggtttaaattatggccttatagagagaaagggcctcagaaaacttagagggttttaaggcaattgaatataatctgcttctagggacttcatcctgggtttattccacaaagaaggtatgttctgtttgtttccttttcatttcacttacttcattgcatgctctatctcagaaccctttttgctatgagaaattgtgggaaaaaacagccttgcttggctaggggcaggaagagaaaagggacctgttattccaaccccttcatttgaatgattgagaaaatgtggatcaaaaagggaaaataatttgccaaggtcatacggtaaaataggtttaaaaaagtatgaggcataggactcatttttccttgctcttctgataacttttgttatgagaagttatagtgcttttctcgtaattttgttgaggaaggcagagagtgagggggagagtgaattatgtcccctacccagtaattaaagtcttaaccctcagtaccttacaacatgactgtattggaggcagggtcttcagagaggtaattaagttaaatgaggtcattaggatgggccctaatccactctgactggggagttttataagaagaatagattaggacacagacacgcacagagggaagaccatgtgaggacacaaggattaggggagtttgatctatataccaaggagagaggattcagaagaaaccaagcctgctgacaccctgatctcagacttctagcattcataactttgggaagataagtttctgttgttaaaaccatcagcctgtggtactttgttatggcagccctagcagagtcataaagggagaaagtgaagaacaaagaatgaaaaaattaaaaacttaaaacttgagaagttctcagagagcagaaaagggagccccaaataaaatttataagaaattatggcaggccagagcccatgctaactgattttcaaccataattgtgtatatggcatttcattcaattctattaccatgccgagatcatagttattattaacccactttacaaatggggaaattgaagctcagaaagttaatttacctcaagttacatcattattaactaactggcagaactaagtccaaattcacctcttgtcagccttgaaaaccctcacttactgtactgttctatctccttttaagaaggttaatgtaagctgcttaggaaacattacttatcaagttatttaatgttaggagaaataaaaaaatgtactccaaagtctcagtgacctggaatccacttaattgattagacaggaaatatttggcccctgattttaggataaaaagagagattggggaaatttaaaaagatagcataattagatttcagtacagtcttccccatggctgcactttcacatgtctaaatgaacagctacacataatgaagaattaatgttcatagtgatgtgccgtgggccgtgaagacatctgatccatcagagagaatcaacaactgtcactaggttgcatttgctaaagcaggaaaccagatccataaatctataacatgaggagacttggaagctgtctatgtcagagttttacaaagacataatttcagtgattagatagataaatatgcaatcaatccaaaagaataatcaaaataacctgagctgctggtaaacccagatgttatgttttttgtttttatttttgaggtggagtctcactctgtcacccaggctggagtgtagtggcgtgatctaggctcactgcaagctccgcctcccaggttcatgccattctcctgcctcagcctcccgagtagctgggactacaggcgcctgtcaccatgcctggctaatttttttgtatttttagtagagacggggtttcacagtgttagccaggatgggctcgatctcctgacctcgtgatctgcctgcctcggcctcccaaagtgctgggattacaggcgtgagccgctgtgcctggcccacccagatgttataatatgggaactatgaagcactttcaatattgaatgcagatggctctgtcgaagctgccttctcactgttttaaagttgtgaagtctatcaatcctgaaatatatagattaaatttacttggatatttagtaatgacacagtcaaggtaagaggtggacaggcattgttttcaacagatactgggatcgagtcccagctaactgtatattagctgtgcatatttgttggttctacctttagagtagaatattaagccaaccacttctcaccatttttcatcactgtcatcaccctcactcaagcctctgtcatcttactccaagaactcttctaacttttctctgtggtttcactttgcctacccctaaattcgttctctattcatgataaccaggtggtcctctaaaaatgtaaatcaaaccaagtcactcccctgctcaaatatctcctattacacctcaactaaaacccagaccatggctcttgaggtcccatgtggagtggccctgcctacttctctggtctccagtcctgccactgactgtcagtgactcagcatcagccatcctcccattatgacactttcatgtccagctcaaagcttctgtacttgttgtttttttttttctccctaggactcagattattcacatctgttcaggagacagctccttagacatgccctctttgaaaatgtaaccaaatgtcccagactctcttcccagcctccaccgtccccttatcctttttctaaatttcacttatcactgttgaaattacgctatttatttagtaacttacttattctttgcactttcagccactgcagtgccttattttattttgttcactattgtatcaatagtactgtgaacaggaggcatttacaaatattagatgaaggaatgaatgaattaatttagactaatgtttctttccctgggttaagtggtttggcgagaacagttgtcaaggaaacagggttatcaaaaggctgttagtctgtctgctccatgatcctagggactctgtgtcataccccactgtatcaccaaaacctagctcagtctacccctgaatgaatggaatgataaatgaaagatgaagacttggggcaacaggggaagagtgataacacataggtgaaaactggctgtgtctgagatgactgacaaagatgataacttgtttgctattttttggacaaaatttaatacatgttacaacatacatcttgctttgatagacataaaacatgtaactgtaaacttcagtctgaaacatttctgagcagagacacatcacaaaagagtagactattccaaaagaagattattcacctgttgttagactcatagaatgttaaatagtgatcattgggaagagaagtgggcagctttatggctttgcaggtaagggatgaagtcttggaggttctaagcacagagaatgtattcccataatgttaacatggtctttgccgatagtaagcggtcttgaatacattccaggaggtgcctagtatgagtaaagccttagatctttattgaaggcgaagaaaccttttgttctaggattaactacccacttgtctctgatttttgagttctgataatttttaagtggtgtctcgtttgtatttagttcaagtgtttgtttcattcaaggtctgcctgacctcttgaagtccttgttctcagagcatctgcagttttatctatcaatacaacttgaagaagttcagggccaaagaatcaaaaatagcctctgctttgataaccacctctctatccaatgaaagcagagttgcgggtgtataggtttttagacagacagatggaagcctgtaaccaagaaaatcagtcatcaccattgtctgctttgtcaagaaggaaccagaaaaaaagagcgaactcttccctttctttccttacccatattcttttatagaaggtgtgtttgggttgttgtagaaaggtagttaagatatgtggtatgaatcaaaccaacctaaaaagaaatgaaaagtcaagttacttttcagggataaaggagagggaaggtaggcactaggtggaaggctttgacctgagaagatttagggagattctagcttctaaaggaactcacatttattgagaatctgggcttcatcctcacagcattcctttgaaaaagatattattttcctcgctttacagtcaggactccaaagcccttctctttcccaccattccatcaggctaactggcactgattcatcacttgaattcttggactgctttaacaatgaggaccctctttgcactcctgtatgatagacctaatctttgaggtctggactacaaggcagagcaaactggaagacatctgtggtctttgagacaattccttccttccacactctccatggggccctcttcatggccgcctggtgtgactggagcaccacagctgagtgttctgttagacttgcacaccacggacagttttaggaagttacataagccagtggttgtgtgcttatgaccacaatccccaagaagctcccacaagctttaaaaatacaatgtcagacttgaagaagaatccctgtggcctccacaaatagatggggagctattgcctgtcatttgaaggtgcttctcacacattccaaggcctgagcccgcattcctcctctgggagttgcattttggcgggctttcagatttggtgaaaaggtttcttgtttctgagaagcaatagggtgggaattcactcgacgtctttgtcattgtaaaggccctgtcaaagccagctgtcagtcagaaaagatgaaaagagagagctgcttcttaagagggagctgggtaccattaacggcacagcctcttggaaaggcgaaggggatcacagaactttgaccggaatccttggctcccgactcccattctagggatctttccacccttcttttctgcctttcagttggcacagccattttcagcgtggcattaactcaagcccgtccactaacacctgacctttctcttaaatcccaggccaccatttcagtgacctgctacattgctgtatggttgaccagtacctcaaaattattcttagtcttacacttcaattttgttagtcctttttctgtttcctgtgtctattaatgggtcctctgtagacatgctgctttaaaactcagtctggtttggcacgtctgcatctgcgtcactttcccttcctcttcagttacttagttgattgacactttcttctgcagtatgccattgcattttctaatccatattcttcctgtcacactggaccacagcaattaccacattcttttacttttttataattttctttattaagttccttttaaaagttataaagtacattacgcatatgcaactagagaaataatgtaaataaatagaagagagagaagaaaaagtttaaaaggacccctacaacctctctctgcatcctttccttctacaacatccaatgttaataatatgatgtgcatccttctggaactttcttccagatcagctcacacaaaaatataataaacatatttacatacagcattttttgtttgctttgacaagaactacatcatattttgcatattgctccagaacttacttattttagatatttcttcagttcatgatatagatttaaaggtggccataataatcataatccatatttgtggtgatatcatagtttattaaatcacatcccattgttggctattcagggcctgggctgggtatttcctgcttgcatccccagatatcctctccacctttgtctaccctgctccatactccgtgtatggtgtgccttagttggtttctttgcccttgggcttctggttgcatttagctcttagggcaccaataggagattagagggagagtgaacaatgaagtcggggtattttcccctgattccttcctatcactaggtcattgtggggcagctgcatgtctctgctgaaggttacggctcctgccaggcagccctctccatacagctacagtctccacttccaataaccactccctcccctttccctcttctggccttggcaatggctccctgatgctggtaggccctggatgctgcatatccatttatttgccctaaacactgcccacactttgttaagtaatttctttgttaaattctccttaataacttcttaataattttatctgtttcctgctggcacccagcatgctaaaggtcttttcttattttgttttgttttttttccccctgccacttgctgtttctaagtttttccttcctttatctccagcatgggcctctgtcagcttgattttttgaccctatgattgactattttacttattttttgaagatccttctagggctactacatagtaaaggtcaaacttcctagttggcagccgtttgcatcccttattccagtatcttaagctttggaagaaggagggtgcctaactccacaatctcttatagagatgcatttcttgcatcgataccattggttctcccaatgattggttgtgtaatattggaccatgagctaacctccctaagcttccatgtcttcatcaatgcaataggaatgacagtagcatataattcatagcacttgaagattgattgaacaacatgtacttaaagcttctacctgttttcagcaaataagaagttttcagtaaatggtaattatgaattattgtaacacgctgtgatcataattgccgttggccatacccacgtgtacaaatcagctatttaccttagattcacttaggcaaggcctctgtggatcctttaatctctgccagacaaaagatttttctgcctgcctctctcctctctctctctcttccccccacctttcttaattaatagactttgttttttagagaagttttaggcttacagaaaaattgtgcacaaagtacagagagctcccatagactctttctcactccctcctcacccccaagtttcctctcttattaacaccttacattggtgtggtatgcttgttacaatagatgaaccaatattgatacattgaagagagtccagtttacattagaactcactcattgttgagtagttctacgggtcttaacaaatgaaaaatgtcatgtgtctatcattgcagtatcgtctaggacagtttcactgctctgagccacttcagtgctccgcttactcaccagttcatcccctccctgttcccctaccccccgccccaactggtaaccactgatcattttactgtctttctatagttttactcttcgtcattttaggtcacattactatttgcgatcctggcttacttttctaactgttttatctttacttctctattcaccttctgtattcaacttcatggctagtagttacactagcatatgtttcaggaatgaattattaaactcgtttacccttagaataaagacttaggttgaatttaggcacttcttcctgatggaataggcatttggcttttgcacaggcccaggggctcaagggacaagagatcctgtttgattgaagctggatgtcacttctctagtccgcatatgtaagagagcttccacccatggcacgtgtatttgaggcctaaaaaggaacaatgcaaagcaaaacaaacaagtaataaaacacaaaactatcatataaatccagaccaaagagggacatgaattagctctctaaagcactgacttggctttaatctgtactggactttatactctggtcctgagctacagatttctcaagcagcttgtataaaatggtaatagctgccttgtatttgtactgtaatttggatttgattttaacagtacatcgatattacaagagcagtagaatagaagttgtagcaaggtggtaggagcagtagtaatatgtgtaatacctaccacttaggagtcttttttttttttttgagacggagttttgctctgtcaccaggctggagtgcagtggtgcaatctcagctcactgcaacctctgactccctggttcaagcgattctcctgcctcagcctcctgagtagctgggattacagggatgccaccacgcccagttaatttttgtatttttagtagagacggggtttcaccatgttggccaggatggtctcgatctcctgacctcgtgatccgcccgccttggccgcccagagtgctgggattacaggcgtgagccactgcgcctggccaggagtcttttgtgagtaccaaccctgcatcatgtctttaactctcacagtagccctgtgaggtaagcattattatctatactttacagatatataaatgtacctttttagaaagatttaccttcactcagctgaagaagctgaggcacaaagaagcatcaagttagttgcctaaaaatcacagaataacttaatggcagagatgctaatgtagccctggcttctggactccctcagttgctacctacagttctgggggtagcttcaaaaactgctattaggctggttttcttcccaggcaggaacctttctattttttccaaccaaaagcccagttaaagatttgccatatgtcttcacttacccatatctggtttcctgttttctgataaggcatctttgttcctacacctgaccctaccccaccctgcctctttccccatccacccaagcttcggacccagagcatggtccccagtaatctcatccttctactgtactgcctgatgtgggtggtccccgtcactctactttgagtcctactcttgcttctcacaggcccatgtggacacatatggacctatacttcaatagcagagatggttccagctgtttcataagatcattttagggggttgtggaagaaggcattaaataacatggaatcacataatgacaaattttgtcccttttctagttctttttcaaatcttctgagtagatcaaggaaaaagtctccgtttactactagtttctcattaacatctccctgatccgtgataatcttcctttttaacaaaataacagatccaagatcatcctttagagccctctcgaaggcagcagaatgtagacaaaatttagtgatgtttttattgtattcattcctaggttcactgtttagttttggcaagtaatactagtttagaatttatgagactaagatagtgttttcttttaaaatacatttatataaggataatattaagcaaataacagcacagtttattgcaggctgtgtcagatatcatgcaggtagtgcacaaatgactgaggtttgagctacacagacccagctgacctttctcgttgagaatggaatctctctagggctcctcttgtccagtgctgtccctctcctccacattctcttgcttctggcgtgttatctatttgtacttatctgtgtctggaacgctgttgaagattaacagaccattatcgggagctaggattagggtgctccccacagtccattcccccatccactgtgacccagggcaggccacatcacttgtcaggccctttgataatgacatctttaaaatggttaacatgaagttctggggagggaagaatgcacatagctggctttgattctccagttcagacaacagagcagccactctgccctgattaatgctgccctgggctactgctgcctccacattgctgtttttcctaccttgtgtctgtccgtctagggctaaaccaaagataataaagaaagtgaagacagtgctttccatgtgttatgtattctgcttcgtgggttgcattttgaagggagtgccccaggttgacctacttccagcacacctcagtggtcattaagtatgtttaggtgatgaggaaagggaggagtgtttgagactctcatctgtagcagttcagaggtttggaatagccaaccctggtaaactatgcccaatttcaatgaagactcggagccaagaaactgcattgctcctcaagatgtctatcttctcccaggcctttctgtttgtctcaatggcatgcttgtcatcgagggtcctagaaacacacccatgtactggagggagcgtgggtgggaggcagctttaagaccttactgccctctctacagtcctgctggaagagtgtagattgttatctcctcacaagggcttatttccagaggaaaaatgacctggaggggccatgggaacttgccctgtggggttgggtttaaaaggggaagtcttggctgaccttggctgctggtggcaggagctgagaacagttgctgaggcttagctggggactggcgtctctggaattccctttatggcaaggtctgttatattttgattaacaaagtgttagttcagtccttcttgagtatttgtgagagaggagttttacaatggctggttataattgtaagaaataataatgatgatggtagctcacacatattgagcatttatagtgtgccaagcagagttcaaccctttatatatagtatgccccacaatccttgtttgcaccctcagaaaaaggtatcattgtccccattgttcactgatgaggtaactgaagcccacccagagaggtgaagtcatttatccaaacacgggtagtgttggtgctagaagtcaagctcatgtctgcatgtctcacccaaggcaacatatttaataacagagccaggatgagaacttgagtctcctgagagcatatttagtaccttttcctaaataccaccttgagtcaactggactatcttagaatgtctggtttttcctctcttcttgaactgatgctgctttggggaagaaaaacaagatttcatccatgcagtctatccatcctgatgttttcttaagagtgaaagtgttttaggaaatcaaatctaattgcccaaatgggaatttattttaaataaccacctgcaccttcatctggattttaaaaggatcttgaatccccactgagaaggtcacagtctgtgctttgttaatgcaggtaacaaaatatttgattttgggagtctcatccttcattttatatcctctttataggattatagtttttactctgagctgctggaatgtctgcggagtgtggaacagatgtgtcttaagcgctgttctcagtctgactttattgactgggaagaagtccatggagggctttggtttctctgagaggcatgttctcattacctcagatagacaaaggtggtaatttatgttctctaagttgaagactaggggaggaaaactaaaatggagaccaacatctctagtaggcttttagctcaagattctgtcttttcattccctattttactttgcatctgtcattcttaacattccttatagcatttattacatcttccagttctctctccccgccctttcctctctttctccttttctccctcctttccttcctttcttttttctttttccttttttttctttttttttttttttgagaccgagtctcactctgttgcctaggccggagtgcaatggtgcgatcttggctcactgcaatctctgcctcccaggttcaagtgattctcctgcctcaacctcccaagtagctgggattacagacgcctgccatgatgcctggctattttttttctttttctttttgtatttttagtagatacagggtttcaccatgttggccaggctgctctcgaactcctgacctcaggtgacccacccgcctcggcctcccaaaatgctgggattacaggcgtgagccgccacacctggcccccatccttcttttttcttccctcctttcctccctcccttcctccctacctttttccctccctctcttttgctttctctctctctttttacttccttcctttattcatttctttgttcctctctctttcattctccttctcccgcactgagttttttatggttagttttcctaatcagtatcataccctagtgaaggaaaagatgttagacttatatcacactttaaagtcctgtgccaagctggattgcaaagtagatccctttataaactacattaacacattcaggccattaaggggcaggtgtattgcactgattttatcagtagtggcttgaaagttactgaattcctaaagctacctacctgagagaactggacgcagtttggacactggaacgaattcagtatcaaatagagaagagagccctgtcagaaagagctgcttgtcataaggtttaaagacacttggtacggtgtcctaggagaaatcagtgatgtgccaggagatgggagacatgggtttacttcaaattggaactaatctactctgtcatttggagaaggtcactcacctctctgtatatatctccccatttggaaaatagaaatagtctctcaccaacatacttaaggcttaaaaacattcaaagtattataaataatattaatggaataaatgtaatatttattagctatttacttgtgtgctagattatacacgcacacacacacgcacactggcagccaccctgtgatgtgagctaagtattactatccactctgggctgatgaaaaaaaacgatgctctgagaggttaagtcccaactcaagatcacacacgtagttaagtggtgtgtctgattctcccagcagtggcaaaacctagctggacccaaacttgccagctggtatgcctagaaccctgctgggctgcaagacagtgacacacgtagctcttggtagctgtgcagggcctaaggcaggtcagtggcgggttgcttcaggctctgaatacgttcattttgggttccagaaacccttcagattaccacagcatgccctagtggtatcatcattctttatatatatacataattacattagaaagattgctaactttgtagacaagaccatttaacctcctcagacatcagctcatggacgcttggcagtcttggctgccaggaacagaaggtgaagaggcccactgagccatattcatcactgagggaacttttattttattttattttaagttctgggatacatgtacgggatgcacaggtttgttacataggtaaacatgtgccatggtggtttgctgcatctatcaacccatcacctaggtattaagcccagcatgcattagctatttatcctgatgctctccctcctccccgcaccccacccaccgtgacgggccccagtgtgtgttgttttcctccctgtgtccatgtgttctcattgtatgtagtgtttgattttctattcctgtgttagtttgctaaggataatggcttccagctccatccatgtccctgccaaggagagagcaacttttaatcagagatgttgggtttgttcattttgttggcttttgatcttagcatgtgttaatctatcaggctcatccatgaattcatagacaaacacttttttgtgtccagtggggtttgattttatgtgacctgggggtggtcagtggttatgtcataccccacgctcacattccccagtgccaagcctaagaattgcctttcagattcctctttgttgatgactgatttgcctaggccgccatttatagtggatcccccttccatggaaagagttaaaattggggaggatagcagggcaagctgaagacccatagaggaagcatttatttgagctctttaagttcaggttttgatatttttgctctgcatggtgaaaacaaattaataatgttaatatttgtagcccatggagaaaactcttcttaatctcttctctgaaacctacaccaggcctatgattcatctttgggctctgtttagattcctgattattgagccagaaagattttatttaattactatttgaaaagtttccaatgacaccatctcaatggtgttaattccacttggatcagtgcttactatccccctgatgttcacaggtctggatatagcatttgcccctttgctgacatttcatgcttgttgaagggagtgatgatcacaccagtggctcagggctgcgtgtccttaggctggtcatatttcataactggtctcagttcagacagaaactggcccctttccaaaacccagtttagttcagttctttgctgggaagatgaagaaaatcaggaaagcattgagttatgagagggagggtactcttacagttaccaagattgttattattatgaagttcctgttgaagatgttctgtcaccttcctggacacacatagaactgtggggtggggttgggggcaggcaggagggcagtggttccttgtgctggtctgtgacttggtactgggctgcctgatggctgcataaggagcttataaaatgcagatttggtgatgtagagcacagcctgggaatatgtatttttctaatgtgtacacactagtttggaagcacagacctaggactgcctcatataattttgcagtactgttaaaatagtatatcacaaagccatcatttattttctcaaaactctaatttttggccgcttcccacaatattctgacccagacacctttacatcatgtggatataatacaacctcctgtgtcccacccttcacctattcattcaaccaatatggaatagctgtctaggatgagctccaggaactaaggtagaaatatcaaaagatacattgttccaggactaaaggagtctttggtttagtcaggagatagcttgagtaataaataaatcagctacagtagaacattgttatttttccaactaacttgcagtgggagcaggtgaaatttgctggaaggtcaggtcacacatcgtggaggaaaagccctttggagccttgacaaaggagatgactgctagatgccaggtgattatatgagaaggcagagagaacatttttgtaaatgcctagtggacagagagcctgataatgtgacaagaactgcatgttctgtcattttaaaatataggccacacatgatagaaatgagggtggacatattaacagaccagatcatgaggggcttgtatatcatgtgtggtggacctttgtatttgacctcataggcatatcttccttgccacatatgtagtttgttttggaacacttcattgatctgtatctttaaaaaaataatttcccctgacaatatgatatgatgaaatttcttcttatgcaataccttagaagagcagaggaagctaggtggtaattttctgtatcccagatggggcctaccttcaaatctcattctctggccctttcatttctgaagccagaagtcagctggttttggggctccgtcctccataaactttatatcctctttgaaagctgacgttctcaaacaggggctacagaatcagcatcaagggaatgatgaccatggttggccctgcatatgatgtctccctgcccttgaccccttaatcagtgactcttaatcctcatagtcaaatagccatggagaacattggccctgagcagtgcattctagagctgacttctcaacacaggtcttcacccctctgcttgcaatcctgacatatgtctcagtgtattttcattcaaactcaaactcttaccaaacccagcatgagtagcctgcctacctccccaacctgatttaatgccactttcttccttgaaccctaagctccttccacattgagctttttcaggttttcagagaaacaaaacttagtcctacctccaggcttgtgcacatgctattccttctacctagagaagttcttcacctccacctccatctaaattgctcttccctgaaaagacattttccagcctctaaacaagcccactcccctgtattttgtgacacgtaatataattttagattgcttgatttgttttgtttactttatttctctattgccagactttccctttaagctccataaaatcaatgacctgggaatgaatggatggatgaatggatggatggatggatggatggatggatggatggatggatggttggagttgaaatatctttgtgaagctgaattcttcacaaagtccaccctctcattctttattcatgctgtagctacactcagccagactcctgggaattgttttctcctccatgaacccaacaaagcttaatccatccctcatactccagcctaagctccattcatttaatgaaacttgtgatctgtcaggttgacactgatttgtccctctcctgacttatatataaagtatatatttactttgttaataacttcattaactttgttaataacttgcattgtttcctgtcgggtaactcaaatttcatctaagttatagtttttaaaaaggctttatttttctcataattaaagcaataaagaaatgcactcagaaaatgtgaggaatattgagtataatgagataaatataaatcctgcataatttctccactgtaagttaaatactatagatactttgccttttccccttctagcggttttattacacattttacaacattgtgtgtacttgtgcatacatttgtaagtatcctgaattttagacataaccatgatctgagcatgccctcgtgtaattgcaaatacttctaaaagcttctttccttgtacgcctaaccataagttctatttttgagaatcaccattgagtgtcaacagagtactagagagtgcactagccactgaggcatatgttatcccactttaaatatttagtgcctactgaatcagaaaatataatataaaggatgtctcccttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaagtatgtatatggaattcttctctttattgttttgcacttcctccttcattaatggctcataaaggaggttggattacatgaatgtagtgaaaaaaatcttaatttaatcaacagaatgaagtgagatactgagggcaaatttgggcagaaagtattgatgagcattctacgggtcatggaaaagtggaagatgtggccatcatccttaaggatactggaaaatgtgcacaaattacagcaccctaaaaatataaggctttgtgcaataggtatcaaaggagttgaagtcgggataagtgatttagaagtacaaagaagaagaaatttatttagaagtaatgctttggggtagagagagtatttaatctgaaccttgacttaaggataggacttagatgggcagagcacagataggacatagatttcatgcaagatttgcaaataaattcattagggatgtataattacattctaaaatgtatactattggatgcctgtaagtggcacagccaggtaagttttatgtgtaggtttcctacatagtgaactttaaaagaagatttgatttacatagtgtttcatcacaaaaaacaaagtacactaccctgcaaagatgttgtaaaagactgggtgtatccaacccattctattagccctgtctggcctcttttagttttatttttatatgacttaacttcattgactagttaaagattttggttacaagagatctcttgcttctctttgaaaaattggcttacatatagttttctgcaggcaaactttttttaccagcccccaagtctaggctagctttcccttctgtgtgctttcaaaacagcttgcggtcggccgggcatggcggctgtaattaagtgcctgtaatcccagcactttgggaggccgaggcggacagatcacttgagctcaggagtatgagatcagcctgggcaacatggtgaaaccctgtctttactaatacaaaaattacccgggtgtgctggtgtatgcctgcagtcccagctactcagggacctgaggcaagggaatcacttgaacccaggaggtagaggttgcagtgagccaagatggcgccactgcactccagcactccaccctgggtgacagagctaggctctgtctcaaaaacaaacaaacaaacaaacaaacaaacaaaaccagcttgtgctttcatcaatcatagcaattctgacactgttagtctcctttgagagtaaggagacttacttactctcatatcttacatatcttgtttattccacatcccaattcttaacccaggacttagcacaaaaaattttgataagagctactttttattgagtgtgtagtatgtgccaggcacaatgttaaatgttttgcatgctttctctcaatcagccagcagccctctgaagtaagtactgtactattattattctgtttcctgagatgaggagaaagcagcacatagagtgtaaataacttgctaaaagttaatgtattagtcaaataacattgaatgaatgagtgagtgaatgaatgaatgaatgaacaaatccaagaaccaaaaatatttgttcatagttaccttgccaatttacattattactttcttatattggaagtaagaaaaatggaaacaatgggaaaaccaaaatatatgacaataatttcttcaaaatataagccacaattgattttatgtttttctattaactaaaaaattattatatatagttggctctattcagaggtagcaagctctctcatttggagagaatgggaaaaatttgttaccaaatgcttcctcatttcagagctcatcataggcagcactaattgttcacagaacttttttattattattattattatactttaagttctgggatacatgtgcagaacgtgcaggtttgttacataggtatacatgtgccatggtggtttgctgcacccatcagcctgtcatctacattaggtatttctcctaatgctatccctcccctttcccccacccccaacaggccctggtgtttgatgttcgcctccccgtgcccatatgttctcattgttcaagtcccacttataagtgtgaacatgcggtgtttggtttcctgttcctgtgttagtttactaagaatgatggtttccagcttcatccatgtccctgcaaaggacatgaactcattctttttttttatggctgcatagtatttcatgatgtatatgtgccacattttccttatccagtctgtcatcaatgggcatttgggttggttctaagtctttgctgttgtgaatagtggtgcaataaacatacgtgtgcatgtgtctttatagtagaatgatttatattcctctgggtatatacccagtaatgggattgctgggccaaatgctatttctggttctagatccctgaggaattgccacactgtcttccacaatggttgaactagtttacactcccaccaacagtgtaaaagcattcctatttctccaaatcctttccagcatctgttgtttcctgacttcttaatgatcgccattctaactggcgtgagatggtatctcattatggttttgatttgcatttctctagtgaccagtaatgatgagctttttttcatatgttttttggccacatgaatgtcttcttttaagaagtgtctgttcatatcctttgcccatttttttgatggggttgtttgtttttttcttgtaaagttgtttaagttccttgtagattctgggtattacccctttgtcagatggatagattgcaaaaattttctcccatgcctgttcactctgatgatagtttcttttgctgtgcagaagctctttagtttaattagatcctgtttgtctattttggcttttgttgccattgcttttggtgttttagtcatgaagtctttgcccatgcctatgccctgagtggtattgcctaggttttcttctagggtttttatggttttacgtcttacatttaagtctttaatccatcttgagttaattttgtacaaggtgtaaggaaggggtccagttcctgttttctgcatatggctagccagttttcccaacaccgtttattcaataggaaatccttttcccgttgcttacttttgtcgggtttgtcaaggatcaaatagttgtagatgtgtggtgttatttctgtggcctctgctctgttccattggtctatgtatctgttttgctaccagtaccatgctgttttggttactgtgaaattatagtgtagtttgaagtcaggtagtatgatgcctccagctttgttctttttacttaggattgtcttggatatacaagctgtttttcagttccatatgaaatttaaagtagttttttctaattctgtgaagaaaatcaatggtagcttgatgggaatagcattgaatctataaattacttggggcaatatggccattttcattatattgattcttcctatctgtgagcatggatttttttcccatttgtttgtgtcttatttccttgagcagtggattatagttctccttgaagaggtccttcacatcccttgtaagttgtattcctaggtattttattctctttgtagtaattgtgaatgggagtttgctcatgatttggctctctatttgtccattactggtgtataggaatgcttgtgatttttgcacattgatttttatcctgagactttgctgaagttgcttatcagcttaaggagtttttgggctgagatgatggggttttctaaatatacaattatgtcatctgcaaacagagactatttgacttcctctcttcctatttgaatacgctttatttctttctcttgtctgatttccctggccagaacttccaatacgatgttgaataggagtggcgctacggccataccaccctgaacatgcctgatcttgtctgatcacagaactttttacaattgagccttaaatacaggtttagaatccatcttcacatggtgcttcagggatctacaaccagggttgaaggtgtaagatgattccttttcgccatttctattagaaagactgaaaggccacttgccaaggatgttgtaggaggaatttaaccatcagatgtgtgtgttggtggtggagagaaggttgagttaaatgatcataattcaatcctgaaattttgtatgtctccaacaacattcttaactcacagagcataagaacagaaataacctcctctaactatcacatagttgtttgtctgtctgtgaatatttgtggaatacttgttatgtgccaggcaattttttgagatattggactcatgctatgtcacacggtatggtactcattatcaaggcccaaatcatcatgctgtcttcccccgggaccttttagtcttttaggggaactgagatatctgtatatatgcaaaggacctagcattaccaaggagtggcatatcaagtattatattcatagaacaggtgagattcagagaagggagtggactgattattaattatagtagctgacatttattgaattcttagttacctaacagtgttttatgggcttaacatatattcacatttaatctgcagcacaaccctatggaggaggcatctttattacattttacagaggaaagaattgaagcatggtaaggtaatttggccaaggttatacagctagtagctagcagagccaggattgtgaatccagatagcccacatccagtctcactcattattagacttggattttgctagaaacttgatgaaggagggaagatggaagctgagccttgagggattaatgcggccttcgttggtggagcagtgacgaagggggaagccatttctatttcaggcttggtattaaactagttgtcaaaatggatgaaaacacacacacaagccaggcaactcttcatgcccttggttctcaattttccttaaaggagaacctgtgagagagaaaaatgagaacagaattggccagtatctgaactagaatggacttaggatcagaggctgcattttaccagtatattttgaattatggtggctctggaatggcccagtggtgatgtggtaaagttgaactcttagagatgtcaggaatactttattttagtcgcagaacttggagtttgagaggccagtggtagacttcttactgccccaagagagtgtctttcttggctgtccgtggataaaaggggaaaatattcatgcaatggacagtgaggtacagatatcccaaggtaggagatttttaatggtcatatagaggcttatgaatcataggtctccctgttatccatagtggacatgtttaaccagctattttaatcaaaaatgtgataccacgtataagccaagcaatactggctgatctataagcagcattgtgtggggactagttgtatttgtcactttccttggaggcttgcctttgagatactcattggcttccttctgcctgagtctcccccctattcctccctaagatgctctgaagcttcctgggcgaagccgtgtctagtggcggttctcataatcactcagctcggctaaaagcttctactgggacactgaccatgtcataaaggcagctggtgctggaggcatctgcatctttgacttcctcctggtgaatctgccatcagctgtgattggctgataaatggtcaggaaagggtggaattgggagtgaagacttaggtgggaaataacccagacagaatcttttgttaggagcaaagatgaccccacttaaaagatagctgagttcccatacctgttctttaaatgatttactattatcttcttcagtctcttctaacagtgcactattttatactctttagattcttctccaaatgttatttctcaccttaacttaaagaacaaaatgaaaggaataataaaaatatttatatgaaaaaagtattacacacactatattctagacactatcagacccctggggttatagtactaaaccaggacacgtggtcccaccgaatggcatatcagatcattctgtgactataaacattgttttctgtgtatatctatctttgtttatagattgctaagcttgtgagtcacttgcaaagtttaatttgataaatacaagtaacactgtttaaaatccttataccactatatttgtcttggaaattgcacttttaaatgaccaagtgtttgatcatttttttgtttgtttgtttcaccagacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcagtaagtcttcatattttacacactcctgtttctcagaagtgtgtgtttaatgaatgtgttatctccagaactctcttactataacttgtatacttgtcccagttcagtttatagatgtgttgcctgatgggacctgagaaaagcagattgagctgaggaaatgggcagctccctgtaactaaagaggagattcatgaggctcttggtcatggcagcacctgccctcttgtctaccttagcagcaggcgctggctcctgcaatgagtggagaataggaaatagcatctctgggctagtaagaggtgaaagtagacttaaaaagttatggatagaagatgaaacattatttcaaaactgcccacttgggtctgagaaaggagggcagagcagcgtgaatggagctaaggagtatcacggagagagggattatggagaattacatttctcggaaattttgtaaacttcagtgggtaaagctgtgtctggtggaggttttcaaaatcgctgagcttggtttaaagcttctactgggacgctggtcatgtcataaaagcaactggcgctggaggcatctgcatctttgacttccacttgcatttagtgcttatggtctgcgctgtattttgaccaattcatatctttaacatttggcaagctgtaggagtggtttctcttgtttttaaattttgttttgttttgttttttctattgcaattccaaaaaaaatctagggagttgcatgccattggattactgaaccaatagcattccagggcagtccttcctgtcccaaaggaatcctgatgaattgggccccatcccagtgctggccccaaacttggtcaggcagagagcactgtttattttaacaccatatacatcccctgagaacacaggacagcctgagctgtagaattattcactgtcttttacttccttttgacaggagcataagcagggttcagcttcagctagttgggtgtggaagcccagaaaaattgcaccaaagccataaaaggtgcaattcagggtgcaattctccagctgaagggtggaagcctgctgacttctcagcagctgcctgctgatgaaagtcctggtgttgccccagacattagtaatgtagctccacgcatttgctttccgataagtgcactcaggctgcttttgatagaagactacgggaatgagtgatcttggcttggctttctgccatctgggcaaggagttggacctgtttggcatccttgagatttgtattatgcttggccatctgcattagggaagtcagattccccgtgacgagagtaaaacttacaaagaaccacaaaagcaattgtgtccttcatagataaattaggaaacctagagatgcaaaaagaaaataaacctcctaatcccacatcgctgttagagtttggctgtatattgtacacatttttaaaatcctatttggccaaactaggatcacagtatatgtattatattttaaccttccatttttgctaaataatatgtcatgggtatctttgcattcatttttgttctaccccaacatttaaagtggattcctagtcatccattttataaagcatttatgtatttaacctaacttctctattgttaacaatttcaattgtttccaatttttcacttagataaataagtagcaaacatccttggaaccaaaattttgtatacagcctcatttatttccctaggaataattcgtaggtgtgggaataaatgttgggttaaggtttgaaaaatgtccgggttttttatgtatatttcagagctgctctctggaaagttgtccttagctgtactttgtccttacttgtactttgcctcagctgttcaggggaactatgaaagtgtaacttttgccttttcttcatcaactgtagatgccattgtttaaaaaaaatgtatccatggttgtgggtgaaagagtagatttgggcctcaaagaaaccagattcttgacaagaagtttccatggaaataagatctgcgggcccagtatcaggtttatgtaactgacaccagctttgtcctatagcagagagcctcaatgtcttatgccctaacttagctttaaacctcgctttcgcccttggaagagagtctgacctttttcactagcagtgacctccccacagtactagtaataatgacacatagtaggcactcattgatggctaacatttattgagcacttaccatgagccaggcattagatgaagtactttacatgcattttcccatttaatcttataaattcagaagaaaggcactagtaacaccctgactcccaccccacttggcaccaacttaaaggaaagaaaactgagatttagggaagctagtaatttgccccaaatcacatagctttgtgacatttaagtgatcagcattcttgaaactatcagggaaccccttcaaaagttaattccatgctcaggaaatagagattctgcagtcacagctaagcaagcaggagcaggcctgggcagaggggagcaaaggctgtgtctgagagtgactcatctggggtctctgtcattcagttgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggtgagcccggacatgccgtcctccctcctctcttagcttcttcttgccagtccttccaacaccatccactcatttcagtcactgtcttttacttggagcctggaaccttgagtgtgagcactggatgtagggataacacaatgttccaggcactttatttacttcttacaggatccccatgagatagtgattgttttccccactttgcagatggagaaactgaggctcagaataagcagcccaagatcatagcattagtaagcagtaggtgtatccaaattctatgctcttcacctccatgcaatattgcccattctgaagaggaagaaactgaggttaggagaggctaactaatcttacataaggttgtatggctagtatgacctatgagattagggatttttaacctgtatcatttttgctgtagagatcaaacccttactatcatataacaatggcatccttagacaaggctaaggcatttctaggagcaaggatgtattggtactcaggctgggagcttagggtgtgaaaacatgttcatgtatatgtatatatgtttctgtgtgtttgccagcgtgtgtcctctcagtgagtacatgatttaggttccactgtcttcttagattcctccattctctgcttctttttgatcaacagatattgcaaacccctcccccccacatacaggcacacatatgcacaatgtgctcagcattgtaaggcggcctgggggtcttagagaagtgtaagtaatggcctttgctgaacacccaaggcaaaagaaaacaggctcatgaagaacaacagaataaatgtcatagtgtgcaagaaccattaccaaaggagtagtctagacacaaatgctaggagtccactggaagagtgtgccctgggatggcagggaaaggatgaccccctcagaggatgatattttctttccatcccctccttaccccacaagccctgcaaaatctttggtgacacagaatgtgagattaactccttctttctgtatttgcgtttatactgggcatctcaaccggcgtagaaaatcgaacggctttaacactcacttctttatcaaagagcctggatcattccatggataatgtagaggcttttgggaagggtagtgtttgggaagactgccctgagttgaaccactctgggtagggaagttctcaaattacaacccagttttggcccagaatactgtgggctgagaaggctctaatggttagagaccaaaattatccccctttcctcaaaatgattctcagttccccagtcccacctatttctgtaaatcactgtattagtagtttatttggggagagatctaaatagatctttacatataaaccttacaacttaagatatttaagcacaaggtaaaacctgcccattagttccctaagggtaggatctgtatcttagttctcctttctgatccaacaccctgcacagtaaaatgaactgatcccaggagatccattaattggaaaccaaatatgtgccaagcctggtgctaagagctctgtatgtattctctcctttaatattcacaaccactttatgaagtagggtattgttatttttccatttaacaggtgaggaaaccgaggtctggagaggttaagtatcccaagctcactgaactagtatgtggtggatttcagtggtgcagcccccagggtatgaacacaactggtgtgctagagtgattcttaatgccacctactactgccttgagcaataacaaagtttattgaccttctgggctaggggatgctggacaggggagtttagaaagaggcacagaagaagagaccattctgctatgacatctgttaggaattgttgattttatggggcaagggtgggcagagcaaaatgctcttgaagaatataaatatctgctttatgttggacaggagcccgggtaatgcagctgggtgctatggtcgatggaagtgggagcaaaggatggaggacagtcatgataatgttgtctttctcttgtttttcctcctgtccctcttttgcaggggttaactccttcatggtttatatggcttataaggatttgtatcaagtatctaacacagaggtaacaacccatttgctatgtggtttggggtatctggatgggtttcctattgttgttgatgaccttggcccttgtaacatgaatcactgtggtcactgtgggagaccactgggccagaatgcttcttgaagcctttgcagtccacgctacattttaaataaggtaacaggcagggtgcccatggcaagacagacagggagctagagtttccactggcagcagctttcttaaacggcaagaggaggaacatgcctaaatttccatctaccaaacaagctccaaacccctcataagcccagtgaaagtgtgaggctcttcgcctgcaggaccaggagggccttctgctgattggaataatcctactgccttgcctctgactctccccctaagaaattcatgacatgcgtttgctttagacagaggctatgttttcagaggaaatacaagaaatgaattcccatgcctcctgcttagaggtgaaggtatgtctgccttcacaggttaagagataagggtttcagtttttgtgtttgtttctggcctggctgtagtggttttctagagcatttgttgagaagaattctgagactgtctctcagctcaatgggaaaataattccattaaaaatgtgtgctagaggcagaggagaggagttggtggtactttattatatatttgctctgccagcctagggaacatggtaggttctttatatagtcagagtttcctgggatttctttggactagcactcctctttggtcatgcctatgtaatatatatttctgccctagtgacttatttcctctgctttatcccatctgttttagcttgggctctggtaattggcccttctgtggggctgctaaaagtgcttgcaagagtgacaaagactcatttctatttcagctctatgagatcttcacctgcctgggagagctgggggccattgctcaagttcatgctgagaatggggatatcattgcccaggtaacaccgtgcagctccctggagcgtgctttgggtctgcattccattttcttcttcatttcttcagtgctgcttgagctctcaatatgtgcaaggcaccatcataagtaccttgctaaagacagaacctgctccaaggtacctcacaatttaggtggaagaaacagaggggaatgtagacaagcaatgaaactagaagatgaggtaaaacagaaagagggctggccattgttggagaatcagaaaaggcatcctggaagaggaggatttcaaattggaacatttaatgggagagcatttgctgattctcttctgaaaatgtgtcaaagctacaagacattctctgtcataaagaaagaccgtaaggcagcatttctcagaagccagagattggatccaagtctgtggaactcatagccttagataatagagaatttaggtctcatgaggagcaaaggtctcactggattcctagaaatcatattgagaaacttgaggaaagagtgacgaaagtgagggccccaaggcccaaattgatcatttgtaaggaagaaggaagcagttatctctccatctcctgggctgcttaatggaatagatggacagatgtgtcttaggaagggttttgtttctcagaaacatctcaagattggcctttgctaggaggagacagcccgaaaaaaaaagagtgagctttcttcatccatttgataatgttggcaacaagaaaccgttattcattccttcaaagagtatttcctgagcactttgtgccaggcagtagctattgaagtgagccaaaacagatgcattccatagctcactaatacttgggctgtgcttttattttagaagttgaccagaacttggtgaatgtggtcagcaggggtgtaggaacaatgtctaggcctcccctcatctcggaccattagtttcctgatagcaggtgccgtttggtgagcactgactactgtgtgccaggaactagtaaattttctggtgtattctcatttaattttcacccaaccctttaaagatgctatcatcctccctattttatacatgagaccatccaggctcagaaagattacgtcactggcccaaggatcacagcaaataactaggaaaacgaaatctttgcccctaaggtgatatacctcagtgggtatctttactcagagatggcatatctgggatcccttgcctcccaagcccagctgcaggcttgtgggcaggcagtaccccagccatgcagggctccagctgttgtgatttcagactctccatgttgtcttgctggtgggggaggtgaggtaagtgtacagtttcctctcaccatgaccaaggaggctaattagtcaggaccctgacagcactttcgcccacttccaccacacacccaaagataatgaaatcattttctttagagagcccaaatgccttggtcccgtgggaggcaacccagtgatattagaactgtactcctccctttatccaagttttcagggcagcagccagaggtcccagccctgctttcagcttccctggaaaccaaactctctggcagttaattctagcccctgaggaggcagatggacttcaatccaaagtctgcgttctcagtttatttcctcttgtgaatccttagagtggaagtttctctggtttcccctcccgctgctatttccctaccttgggaagatctgttctcagtcaggaaaagagtaggggcatttttccatttggatgagtttattgtgtgtgtttattaaattcagcttgagcagaaagatttttatcacattgtttaaatgaaggcagctgctatactcagaatttcttgctgcacttattcaaaagtgagtatatgagagaggaatctttgcctttgggtacaaacaaggatgattttcaagaatttcaagttggcaaaacagtctaagacgacagcatctttagccattcgttcaacaaatatttgttgagcatctactatacgccaagccttggacggggaagatgtaaaagacagggttcctttcctcatggaccaagctacagttgtgtcatgacccaaactgtgatgtaactgtagctgtgatgaatgccacaacaggcccactgctatccccatgtaaggtagcatcagtggggctttactgctgttcttaatctctcagctatagggacatcatggcttcagaataggacttcctagcctgaacagtgcattagaatcaccaaatttttctaattccaggtattctggaattaggaaaagtcagtagcagagttcaggcaagtgtattttgaaaataatcccctggtgatttaaatgtgcttggaagccacctcttgagcttagctttgtcctgtgcattatcctggtgcactcaaacaagacagaagcacaagtgtcacctaagacagagattctttagttggagaccttaacccttgtgtgactggaggcaatttagagtagaaactcactagactttagaagaaatttaattcagttcaagtttcaataagtgagaatggtaagaatgaaaagtggaggtgcttttctggaaaaataagcctgtaacctttctttgttttctgtagagctggagatagtgaccatttcacttctcatggttgcttttagtatgtgcattttcctttctactcctcttttagagatttctattactaaaaacaaaaaacagaacgttcttttccaggtggtaagaatccttacctttctaaatgcctcacagtttcaaagtgagactaggcttgttgcattcaccatttttcctatgtgtctcacacattaccagagtactcccaggtcactaggccaggactgctggtgcagaggttcatagggaccagtcttaataatttcagagtgaatgccagtaacgctgaagaaatggtggcttgggatttctgccagttccaatcagttcatgtgtgtgtgctcactgcccagctacctgcttcttccataaagaggctagaagtctgaggaattttgccatcaaccacaagggacatgcacttcttctgccatgtccacaacttggttaaacagaatttcaccaagacactaacttaggtaatgctgtttggaggcactattttgtttcgttaaattttgaatccattcatttaagccatagatttaaaacatcaaaactcctgagtggcttattaaaatatgcatttctaggattcaacctgacatcttctgatatgttaggctaggatgggtgagaaatctgcatttctacaaaaacaattcaggcaattctgatgtaagtgatgagtggcccacacttcgggaaacatagcactaaattataagccccgtgaggtcaggggctaacattgctttaatgcaggtacttacccagagcctaggaggaagcagttgctcaatacattttgttgagtgaaatggcttaaagagcatgagtgaataaacaaatgagataagcaagtatagtttcagaggcagctgagactgagagagatgaacaataagtgacctggtatgattcttgaagggcagtatagacaaaaaatagtctaacagacaactatctttcttctaataaaaacaaatcacccttgaatgttttttctttttatccttttagttgagtctaccctatattgcaactccaaatataggattaatacatctgttcaacatacgcatatttattctttagatctttagatcagaacataccagcgtaatttttccaaatctcacttgagcttattgaagaactattttcttttttcatttcaggagcaaacccgcatgttggaaatggggataactggcccagaaggccatgtactgagcaggccagaagaggtaagttacaggggatgaaggtgcacacacaacgcatgaataaacattgttaaaaggcgacgagaatgtgagtaccaggttgcagtattggaacatttcttccaaagaccacttctgattgactctaactcaggagcccgtgagaaaattagaaaggaatgtaagagacatgcttatttctgacccctaatctccctacagataacacaagttggagtgtccttcacagctattcaggagtgttaaatttctaatccctttcttaaggaaatctcagtgtgaatctcatagacatttccacttattcccttatttcgagtcctgcaaaatattggcatatagataagatgttgaatgggttttttatatacattatactcatcaatttgtataaggtgatgattatgtccaggtatggaagtttctcatatataaaatgaatgcttatttatgtctgtacttagcagccaaacaacaaatcaaaggtgactagaggctggttccatgtctccgagatgtcagcagcttcacctactggcacggagcacagagctgggaattggctgcccatgtacctgaaagcacattggctttggaagggcagcctgggtctagcacctagagcaaagtcaaggccctccatatcagtgaagcgagtcctgtttctgtcctgtcattccaaaccctacaacagggagaagaaggaatcataaccagaaatgattcccatatcctgtctcttttagagtcttatttaaaatataaatagaacacatatagaaaaaaatgtttctatcctaaggaggcaatgaattttcacaaaccagatacacttagctagtgttacactagttatactagtataactagcacccatagaaggaaacagattatcagcacctcagaaactcctttgtatctagtgatatttttattgccatttaaataatttataattttgtgattagggttccagtcacatacagcatccctgaagtctgtctccttaataatactaggtcacttctatggaatgcattcatctggtatgtgctgattgcatacgttatctcagttctcgctgccgctgctctgtgtggttggcattgttgcgcaggtaaagaagctgaagctcagagaggttaagcccctggctgatcacacttgaaggactggaaaatggtttactcatcgtgaagagaccagggtaatcagcattgtttttgaagtttttcttaaatgctggtcactgtggagatgtgctggcaagacggatttccagcagcagccaggggatttcagagcaaagtctatttttgttccttggtttgttttttcaacctccccttagccttaccaccccaccctcctccttattcctgtctcctttttagtaaaaaagcctctcagccgcaaacctctatagccgtggaaggccatttgggtgaagttggagggtgatgtaaccttccaaagatagtcatgttgtcaaagtgctgaaaaacctgtagtgcttgggaggaatgagatcaaagggaccaggacagaggtcctgggggagctgaagtggtcagcatgggtgtgaagtgggaggagtgatcataggaggagccagcccctgttcaattcaagcatacccagacaccacctcaagtgatgctgttcagagagctgggaccccaggcatagagacagccgctccagagtacaaaattctgggtgcttcaggaaggtgtccatattcacatatgaccaggggcctccaaggtcccatccacatgcaataaagtgcagcttgggggaggccagctcagccagccaagttcttaggtctgtctgctgagctacacccacaatggacagtgactggtttgcattatacagccattgggcatctgcaagctatttttggtattttttttaagtgttgggctccacaggctaaccagaatgtcatatccataaaaaaatgaagtgttgccaattgaatggaagaatgtcaaagtctctgctctgtgctgaattggactaacttacacaagttgagagtagaccacttgagagtaacacagaccctcaactggttagaaaatattatcaacaataatatcagtagccaaccctcaaggggcacttaccttgtttccccattaggaatgagctaactgctttataaggatgaactcatttaatcctcaccacagcccaacatgtcagatcctattatcctcaatttacagacaaggaaactgaggctttgggaggttgtgcaatgtacccgaggtcacctagcttataagtgtcagaaccaggactcagaaccaggccatctgagagagcctcagctctcagaccctgctttgttaataaaataagggaaaacttctaatttcttaataaatgccactgggttggttagcatatttgaaaacatgaattctacattagggtaagatgggagagatcaattataaaacaagtctttgtgttgagaaacctgggaattattttcgtaagaaatgcctcctaaaattaaccctttgctgaccacttactgctgcaggaaaggatttgaggaaccatgatgcctaactgccttggctggttattttagacataatggtttgctattgtgtttgcccagagattctgtcctgagaagattgaggagcaaaggctttcattcagatgtcacctttgtgataaccacagaggctaaggaaaaagtacttaccctctgccagacattgctctcagatgacaatgctgtgctatactattttactagtgagggatagaggcactgggaagctgagtaaagtgacacagttaggaagtggtagatctgagatgtggatataggctatctaattccagatcctgccaaaattatccataacctttgtgcagcactgcatcctcacagttcgtggaggtgggagccaccagtttgagaggttcatgtttctattgactcctggagactttttcttgcagctggaagctgaggctgtgttccgtgccatcaccattgccagccaaaccaattgccctctctacgtcacaaaggtcatgagcaagagtgcagctgacctcatctcacaagccaggaaaaaaggtgatttgtgtttccaagatctcggagcccctgatggcactgtgtggctccttccctctctggttgtcctgtgtaatataaatggtgcctactttgctcattgccttgctccctaggaagccgctctccacatcctgtgtggatgggaggatcctgggatttctcccacttggcatttaagtaaactgaggctcaggaaggttagatgagttgtccaagatgacacagcttgaaccagttcttctgagactttgtgcatcttacttctccccttgatctttgattttcagttcaccttgtctgagttttataaacggacatatcagtcaggattaaattgggtgcaaaattcaaagatcctgctcaaactggcttaaacaaacacaagtgaataaccgattgtaggtgtttcaggtatggctagattgaggggcctcaacaatggtattaggtgtttgtcacgcttactcctttcttggctctctttcctctgtttggtttatgttcagtatgaacagttacagaatagatgctgagaggcccctgttgtcctcaatttttggcagagagcatgatgggaaagtaaaatacaccttttccagcaggtcaagcaaaagtccctaggagcactgtgactggtctggcttgggtcatgtgctcatccctggaccagtaaacaccccggggatgatataatctggccaggattgaggccacagtgcagatgcaggtcacacctcctgagccactgagactaacacaagttattttagagaaggggttgagtgggtctccaaagcatattggccaccatggccttcatgaccctggctgtgtccctgctccctgttgacttctgcttcttttctccactggtgttaacttgggcttcctttgcttgccttgtgcttagctaaagttttcagagctttcttttctgtttctggttctcatcctcagtgtcagactcgtgggctcagttgtgaggctgggtaagggacgagtgcaggtgagaagctgcagatgtgtggctctgtgttgggttgtgagaggatttaccaggcccagtgatgtggttgctactgctgcgtgccagtggccattctggtagtagagaggcccaacatgggtgattcatctaccaaactggcctgtgaaactccacgtgtgagtgattgcagtagctaaaaatagtctcagctgacgctgatggctgagtgttcagatgcctggccttctggcacagggtgaccctatttttcttacaagaggggaggctttcacattgtctagacactcttcctagctgacagattctggggcacctccttccttcctctgttcttcgtaggcctgctgttttctccttagcttttagaagtttcaactgacatggagtggttgctccactgggtatgagtcattgggcgagaaccaggaaagcagcccagtgctcctcactcattcttggagaaaagcaaagaaaagaaaaagaagaagtgtgtaggaactccttgtgccctcacccagtgccgcacacacacacccctgccaactgtgaccacccaccgccctcatgccctctgctgaggctgcattctgcccgggacccattcttagggtgacctagggccgctcgggacagggtgttttagttatatgctggtcttattttaaacttcatggacaaaaattcctaaccctgagccttttggcacataattctctggcgagcagaactagtacagctgtgtctccggggtggaatgggggtattatttcagggatgaaaaactggctgctgagattgaagtcagtaaacaactcatggaccgtcattctcagggaaacacccaagagcattctttgcaagacaaagtgtagcagggtttgcacttccctcctgagcaggatatggttgaagtctcagtgtgtttagtcaccaatcatcagggctctttaactatatggctgctcagaattaatattagaaagctacaatttaatgaggaacagctatgtgccctgcactgacataaatactttaatttttttattgtgtagaattctcaaagaactctgagaaataggcatttctcagaaatgccttttttcagatgaaattgcagcacaacttgtccaggatctcccagctgggagagctggtattcaaatctaggtgtaattactatcttagcttcttttactcttccatgctaaacatagtccagagggagatttcttccacttttaagattctatttctttcaatagtagttgagtgcttgctgtgactttcatttcttcatatctttatggtcctgtatcctttagtgtgtaagtatttttggagagcccttgaattctcatcacttggatttttttttactctcacccccaaaagcagggctgtccaatgtgaatcattgccatcgcttccttcttttgcctatggcagacattactaattaatcatgagtcttttctactgagaccccgcgcattattagaatttttcccttcatggaattctaggcaactattaccagttgaatggagttgaaacaaggcaaaatctatttgtgatcctggccatagagtgcaaacttgtggagaatttaactgtggaagttggaggaccaaagttaaagaagtgcagggctgtatagggtagctttggccccagattttggcatagagaaacttggtaccaaccacctagctatgagctagcatttgctttctatatcactattccttcttcttaaagaagctaaacagcttagatcagtgtatattccaatagcctttatcccctctccatggtttgggtagttaggcctctaatttttgaggcagaatccaagaagctagtctcatatttgatgtgtcctaggttattgggtgacttttaccaagtcatcatgttaggagtaacaaacatgataaaaaaaaaagtcataggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaagaaaaaaaaaaaagtcatgagagtctctaatccacaggaatggattttactttgtggaaccaaagcatatcattataatgggagcatctagcaattcccagtggtgggtgcacatttgggactttgggcccctactgtgggaaggcataacaggtaaagaaagcgatatttaccaaacatcctctaggtgccagatgcttcacgtatgccatatcttttcattttcacaagcctaagaagtagacatcatcttgtttcatcaatttcagaatatatctatttcagccttggtatacatggaacccattactagagcaagaactggagcattttagtatttctgaaatgaggatgaatcttgaaatcaatatgtatattttattttcttttgcctcaaattttaatttgcctcaaaatttgagaattaacactgcatctaacaaccaatggcttcttttaatctagagaatacaaacttggtcacatttagcagataggaaagcaggggctttaaaaaggtgggaacatggacttgaacccaggtcagtctgactctgagacacagtcctgggtaggcttaggagctaaattaaataggcttggcccagtgcagcatatactttatgctaaccccttgtctgtttcctgccccttctaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccaggttggtgcaggaatgcccagcagcaggcgttttgtgaaaacatctcttgagtccagctgggggttgaggacaggagcagtcccatctataaacttgaccagagtctgcagtgtgaacagtgtattgggaattcttttacagtcttgagcgtagaaagcaggctcttccccatcctgttttaaacattaatacagtcataatattaataatggtaatagtagttaaaacctattatgtaccaagctctatggtaagactacactcacaatctcatttatttctcctaacaactttatgagtgaggcactcttatcagcatttacatattaagcaactgaaggtcagagaagctaaatcatttgcctaagttcaaatagttggtcatgatgacaatcaaaattatagggagactcctttgttgctgccctctgcagacatataggatcatgacattgctcatttgagtacattttattttgctacaaaagagatgagctaatcccaccccctcactttctagatggggtaactgagcccagggaggggaagaaactcatccaagctcatatatctagtaagaggtagaggaggcattccaaacccaaatagtcagagtgcaaaccctcacagtaaacacaagactctaagctcccagtgtgcctccagccatctcccctgttcatgtggagcttttctcctttgccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggtaaggcatggaggtcatgggagggtggccagagccaaaacatccatgggccagatcagaacctcctgccaccagttgggctggtgacactgcgagtgcagatgggatctcgtacttgctgagatgtctctggaaccatgtggctctggcagtgtggaaaatttccttctagtgtgatgaatcctaaggcctagcattctgaaggaggcttccttatctagactgttaggactaggaaccagacatgcaactccttcatctgagtgtacgaatagcctgtacttaaaataatagtgagttaattctttttgtttggatagttttatgacttcttttgaaagaactggatataatcctttgaaatgataagcaatgagtctgtgtctagaccaaagtcatcttgcttatcaaggacgccctgtactgagggcatgtggtcattcaggcgatacaagtgattgtctctaaatgtcttctggcaagtggcctgttttattttccttgttcacatcacaaggactgacgaaagaaatagccattcaaattaagactctttcaaagattttagtaaaatcaataattatctcattattaagttgattactgctctatgtttcatttcaaaaatcctaaaaacattcttatcaaagttatgtatactaaagcctcattaatctacacagtgtaatttcactgagttttctttttcttctttgctcccaggaagctcagagctaggttttaaactcaattctttccgtaaagaggctttttggtttgaaaagagggaaaatataaatattgttgtctgttctctcacatagtgtttcctttttcatatactgcagagcagtacgtatgtatttatcctggcactatttggaatagttccaagataatatatatttttaaattaccaacatgacacatgctcagtaaagaatatttggaaactacagacaagcacacacttgaaagaaaacaaaaatatctcaattccacaacccagggaacccattgttatcatttgggtaaggttcttttgtatttattctatgcatacaacatatgcaaacacaaatacatatctaaaggatgggattataatcacatttgtttttactgtgaactctccataatcctttttgaaattagaagaagaaaatgagtaagtaaatgtaagaacatatagaaaaaaatgcatacttcaggggcagtaacttctatcttaaaccatgtgtttgaccattttacctgagtagtcacgacagcccagctaattcgagcttgctgagtgaggttctgtagctcaccagcttttcaggtggctcctttttgtatttctatgcctttgtgggttgtctttctctgagttcagaagccctgaattgatatatatgtagctatagatatagatataatttcttatatttcaataggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgtaaggcccgctctggtgggagtggagtagaatggagaatgcatgcaaggaacttggtcaggagaaatgtgtttatgtggtgtgccagggtagttagactaggacgggttgcaataataatccatcccctaaatctcagtggctcaaaacctcaactgtgtttctcctgctttccaaagcagatgggctctgcccattccagtcactcagggacagaggccaatagaggcttcctctctacatatgttttcatgattgctgagacaggggaacatgacctggtgaatggtctactggctctgaaagcttcccctagatgtggtgtacgtcactgcctctcacatggcactggtcttagccagtcctgtggctatacctaacttccggaagtcagggcgtgcaatgatcctttgtgcctggaaagggaaagaataggaaataactggtaaacagcagtgatgacttcttcacgatgagtttcacatggaggatgataattaaagtgcagtacctaacagaaacgggctcgacactgttgttaaaaatagttaatatttttaagcacttatgtttcaggcactgtgctttgaattcactggatttccatagtagtcttctacaggtagggactattatcctccgttttatagattaaaaattggaggtacagaaaaattaaataatttgtgcagcaagcgaatggtgaagctagcattgaaacccagacaagctgactctaaactgatgttcttaattattggcagtacagtaatgcctcttgctgattgagtaaatgaaggaggtagggagaaatcccatttttggtggcaatggcctttgcttaaatattgtgtcatctcatgttatttaatttggagctagagggacctaaaggccacataacctctctgcccacctgctcaatacaagacagtgatgtacagcatcctggatagttatccagcttctctttgaacactacccaagacaaaagttgacttccacttgaggaccttattaaagaccggacacttctttttgctaggaagtttagtcttgtcttagtaaatctgtctccggtgccttctacccactggatgcttgcagatgcatggtgagcttttcctggcttacctggtgaatcagcagcaaatgacactgaaggtctcaaggagagaaggtacgttcctctttctctacccttactgtggctttgcttctcacccctgcctctaggcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaaggtaaaaagcattggagctctgaggtggtgcaggagctttgtgttccactcacgctcagagatagtaaccatgaacacagggcactgtgatctctagactctcacagagaaattcagtgacagtcttgtccccaagaacaactacacagacttaatgtactattaaagagggtgttgaaaatttttgttcaaagagagctttttttcccaaatgacttttcccacatttttatagtactttattaaaaataatttaaattcgaataattcaaaataaggccagtgtatttttttaaaaaataaatgactcttcaagtctgaaggtgagaaccgagaatccacaccgacacatccctgtgtcattctgtccagtgctgctccacaggggcaaacacttataacattttagctactgtattttcaataaaactttatttctctgattttatatataaacacacacagagatatgtgtgtatatatatatatataggtctatagatacatacatgtgtgcaaatgtatgcatgcgtataaaaaatggaggtgcagagaaattaaatatatatttacaatatatgtattatatttatatatacttaatatataaatatagaataatatataaatatataaataaacatttatatatttatattgtattgtgtattgtattataacaatacaataaatataattaaaaacaaaaatgcgtataaataaatatattcacatatttatatttattgtatttattgtattatactttctatacacacactatatatatatatatatatacacacatatacagatatacgtatatatatgtgtttgtatatatatgtgtattagccctaccctaggattgtggaatttgagctccacactccagtttgggcctaatagagaaggagacttccccaatattgaccctttatttctatgagtgtgatttagattctgaaaccagggaagtgttgatgatgtagagttcttggttttggggagtacagatacagtcatcacatcactagaatcattagcatctgcacatttgatgggctcggcttctgtgctggcatttgagtcactaacagggaaggaggctctgacaggacttcttgtgatgatccatcctgcacggtcaggctcctctggcagcgcgtcctcattgcctcccctctggccaaagttaagaaatgggtggaggttgtgtgccgctgccatgggtggtcttgcagtgtttgtccagttgactgtaagcccctttgcaggaggtaccgtgtttcccatggccaaaggccctagtgcctggcacaaggcctagcagagcatgtgctgggtggaagttgctggctggctccacagtcccagggcaagttcacagccacagacagaggtcagtgggtcagaccacagacactcacttcaaggcctgcccaccctggtgtgtgctgaagagtgtgagggtggagctcccatgtgatcccatcctggccaggacctgcgacctcgtgtcatgacctacccttcctatccctctgctccagctgtactgctgttcttctatttcataatcactcccacttcagctgtctgcccttgctcttctctttgctggcttctctgtcatccacaccactccccggtatccctccaacctcctccctctggcaaccccaaccccatagcaacgtcctttgatccttctgatcgaagctcatctatttagaagggccttcactgaccacatccattgtcactctatcatcacatcctcctttatttattttatactacttctcccttcctcaaattatctttattattgttaattcctagctcccaccacacactgtattcactaatatatttatgatacctagaacagaccctaaaatgctgaatgaatgaatggtgacatgctcttctctggctgcagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggtgagtgggacaggctcatcaaaagataagagaagggggaaggggaagatcaatgttctgaggccacagggtgttcctcagaactcaacctgaaggagttttccagcctagcactggtgtcaactttagggagaaggttactggggcaagcaggaagggtccctgaattgacaaggggtcctggtaagaaagtaagacaaggcagtcaggccgaagaccaggtttaagtggtaactgattctgcctagagatcagccctggttgggggcagggtcggggagctggtcccctctatgaattgatagtgatttccagcattagcctatgagcgctatgcaacatagtatgttttctttatttgtccagattaaaagatagcttaaattatttttatgctcaaattgcagtagcgtcttctaacctaggatttttattatattctcccattcctagtaattataataatgctaacactagctaccactgattgaacatctactatgtgttagccatgtgattagtcttacctattctttacgaactctctgatataattagaaaataatcattcagttgctccataaccagtagtcttaaaatggagaaaaataaatgtagattcgcattcctataatgaataatttaaatgtgaaggaagtaagataacaagaaaagaaagacatttaaaggtaaaattacagcatatgaggaaagggtatggaatgggagaaacagaaacatgggagaaagaggtaagggagacctaggggaagaaagacaaaggaaaagagtttaaagtttggaggtaactttgccagaggtcacattctgctagtcataagcaatttttttcaaagtttttgcctttttttttttgttgttgttgttctctggctaccttaattcttaagcttttagaggctcctttctgaatagacccaagcacacattgaaatttctttttgtgctgttgtcacaaagacctgaccatcactgctttgcactgtgggatcttgggcaagtgacctaacctttcagaacctcagttatctcctctgtaaaacagataagggcacctctctcaaaccatggtggtgaggattaaaggagataatggttaagcacggaaaacattgcctgccacaatgagtgtcacgtctttgtcattgttcttcttcccagtattattatcatgctctgggtcagatgaaatctagataagaacttggcttttcctaccagaggctagttttcggggccataagaaaagtctagaagacctgatagactggaatggaagtttcttgggaggtgaggccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattacc

SEQ ID NO: 35872 - DNA, 62888 bp, Homo sapiens; identical to SEQ ID NO: 35871

SEQ ID NO: 35873 - DNA, 33115 bp, Homo sapiens
tgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcccccggggcggcgcttggagggactgtaccgcggctcactgggcaggggggatccccttcggtgcagacggacttttacattcgccgaagcaggggaggggggtccgggtagtggggcgcgggactgcaggctttgttgtccgcgacaggctcgggtggttgcttcagaattttgcacttttgccaactgggacagaggtcgcagcttgaggacagattgagggctcatggggaaagaggcagagagctgcagctgcaaggaagtcagtgaggggagaagtggaaccaggctctaatggtgcccttcttgaaatactgtttacacgctttcatagttgtggggtcccagcagggcagggattgtgttttacaatcttgaggtctccagcaccagtcacagtgactggtacgtactatgcacattattaaacgactaaataaaagaacttttacattcattgtctcatttgcacttcaaaatgtcaagcctagcattttagagctggggggtgacattagggattgattaatgcgtttattctattctttgagcacctgtaggtgctaggcactgttcggggcaaggtgtacaaattccagtgcggcaagaacaacacccttgagaagctgagagtctagtctgggagacgagacacataaacagatgattacactccagcgtggtgagggctctaatagaggttatctgtagaatgtagagggagtgaccaggtgggccggacaaagcaggtgacatttgaacaggaatttttttaaatgagtaggattttaacttggtggtgggggaggcattcctggcctgtgcccacggctgcagagtctcagagggcatctatgaggaggttggattagatgagaccacatctggtctgagtctactgttggcagattggcccagggagtctaaaggtcttgccctgttccctggctgctggttaatggtagacagaggactgcagccctgttttccctattctgcctagtgctcttgctcaaaactcaggttcgtgaactggggtattaatgctaagtgctcatggattgctttaatggttccctgtttgggaaaaggctgccattctcctccaagggcctggaaaatctcccctcttggccctgttctttgttatataccattaggttggttcatgagctcttaaagtaaaccagagagaggtagagtcttagtaaaggatgtgccactacttactggcagagacaaggttagaattcagcttcttggacccaagactctttccttacccagtgggtgcaaatcctggttcacactgaagttttcatgaatactcggtgaattgagaaaagtgtggacaaagtagtgagatttttacaaaacaaaatattttctttttctttttcttttcttttctttttttttttttgagacggagtcttgctctgttgcccaggctggagtgcagtggtatgatctccactcactgcaaactccgcctcccggattcaagcaattctcctgcctcagcctcccgagtagctgggattacaggtgtccaccaccacacccagctaatttttgtatttttagtagagatggggtttcaccatgttggccaggctggactggaactcctgacctcaggagatctgcccgccttggcctcccaaagtaccgagattacaggtgtaatattttcatttttaaaggactcccctttattctgagactagctgccttcttccttgtttgggagaatcatgaactgttgaagtccctgctgttgatttaccttacatagttgcccatgtgagaaatggctgactccaaaacacatctatagttgggaggctcttaattgaaatacagccatcccctttgtccatgacatctcagggcactgtgtacatcgtcctgattggcagtcacattgatgtcttactgttcctcagttttagctgctcttagtaaaaaccgcttacttcttttaggcacttctccctccacccagggccctccaaaaggaattatgcatatgccttatagcctatataattttcaaacactttttttaaatgaaaaatttcaaatattcagaaaagttgaaaaaattttgcagtgtatatctatatatctgccatctagattctacaaggaacattttgccctgtgtcttttattacgttactccatctgtctgtccatcctttaattcattcaagttgtttcatgtattagcagtttgttcttttcattgctgagtaagattccattatttgaatataccaccatttggatatcctgttgctggacacctgggctatttaattttttttctattgtaagtaaagctgctgtggctgggcatgaaggcttatgcctataaccctaccacttttggaggctgaggtgggaggatagtttgagctcaggagttgagaccagcctaagcaacatggtgaaaacccatctctacaacaaataaaagaagtagccagacatggtgacacatgcctgtagtcccagctactcgggaagttgagttgggaggattgcttgagcttggggtgtggaggctgcagtgagccatgattacatgactgcactctagcctgggtgacagagggagaccctgtcttaaaaattaaaaataaataaagctgctataaaaattcttacataagtctttttgtgcacaggtggttttatttctcttaggaaatacctaggagtagatttattgggtcataaggtaagtgaatgtgttatgagaaactgctgagcctttttccaaagtggttgtaccattttatacttcatcagcagtgtatgggagttccagttgctccacatcctaccaacttttggtgttgtcagtcttttacatttagttgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattaattcatagcccatattttaagttcaatcatgtggaatcatgtgtaggctaagtgttataataataaatctcaacatgtatcatggtataaacatattagaaatttatggccgggtgcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataatcacttgaaccctggaggcggaggttgcagtaagccgagatcctgccattgcactccagcctgggcaacaagagtgaaactccatctcaaaaagaaaaaaaaagaaatgtattcctttcctacatgaatggcccaaagtggtttgaggttgaaggaggtgggtgggtgctctgcttcccacagttattgagggcaccaggctgaaggaagctcccccttggtcaaacatggcttttatgggcgtcactgtccagcacagaaggctcaagagcgtggagaagggtatatgagtgtgggaaggtttagggtccagggtcactgccacttacattctgttggctagaactctgttacaggccacacctggggtagtctaccccctgtccaggaagctgactctactatattatccaaagcgtacatttcatatttggtgaaaatctgtccagccattttcttgtgatgcggcaatggacatgcaacataatttctttttaaagaatatgtcatttttactttctgacattaagatattctgttagaaaattatgacagtaacagatggtattaaaaaaaaatctccccttgcttggtaaatgcttttatctaagtgggcagctttgtgctaatatgatgtcttccacttcccaattagttgtgatgctttactgatctaggagagctttatggtttgggactactataggcgaacactctgttgcctcctctctcaagaatcagagtgtcctattttggaaacacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgggaactttattgctcactgcttagaatgccatgggctcttcttttgagatacttacctttaacccatttcctttttttttttttaagtgcagcttgctgccagtgctcttttcttgggggtaaatgggaaatgttaataagtagcctctgatccctttaaaatgggagaatttgaacatttcaaaccttacctttttatacagttctcttattacctgggagagaggttaagtcttagactatccatttctgtcagtgagttgcctatgcattatagcctgtgagggtctatatttttttagggtaatcctggtaataactgcattgatgttacactgctaacatttgggatggagaaggggtgactgagtgacttaacccttggtccacatgtgctttcatttctcctgaaatatacctaggtatggaatcgctaagtcattatgtgcagtgggagagactatgggagatgggacagaaatttttaaggtttcatttcttttttttagcttttgcatggtgggtaggtctatgcaaacctacccccaaagtctgaggaagctgagaggccaaagaaagaggctgacaaatcaagtttctcagaaagaaatgtttagtagggacttaggaccagaaaccatgtctgtgtcttgcgtgttggcgagacaagatggtggatcccataccattacccctcagacccagggcttaataccatagggaagggcgattcagaagggaggtatggcatgactgaagtatgataatgtcaaggttgtttgacctcagggcaggatttatagtaaataggggctctttcacaaggaataatagataaactggaaatcttaaaactggagttaatcagaagtcagcatggtggatcagtatctaagacggaattgctttagcttccacagcagtcaatatctagaccacccttattattttcccacagaccaagaaatttgaaggtcaggacagtctttggtttcctgtacgtgggtgtatacgttgtaggcacttgaatctttgttgaataaatggagaatgttaggcagttatttgctagaaaacgctaggcacattctttatcacagaatgaaaagacgtcattatgactcctctgggactgatgggcaatttgcattaaccaatcttttaattaaaagtggaagaatatgtttaggttcttgaaacttctgtgagtgaagggaactactaagtggaaagtgtaatatgttgataaaatatttcaccagatgaagccaaccttactcctcccaggaaaacttcttcatttatgtattagctctggccaaaagaagcctataaaggcagcaaagtcaaaatagaattttactttaagtccctacttctaataattgtgctagtttttagccaagctaatttctgtggcagttttcataacaagtgtgtctaaaggtgtttgatcagaatttataaattaaaatatttctctcattttttggaggggcgatgcagggagagggatagactgttgctgcttcctcctgcttgttagaaaggctcttggccatatcatattggtccgtggtttagtttatttgcatgctgaatccacacacatttgttttatgtttgttagtatattgagcagtgtattagggatcaggtatatagatgtaaaaggagtacacagtctagagaggaaaaatagtgacaggctgggcgcggtggctcacgcctataatcccagcactttgggaggccaagatgggcggatttcttgaggtcaggagtttgagatcatcagcctggccaacatgatggaaccctgtctttactaaaaatacaaaaattagctgggtgtggtggtggtcgcctgtaatcccaactacttgggaggctgagacgggagaattgcttgaacccgggaggaggtggaggttacagtgagctgagaccatgccactgcactccagcctgggcaatagagcgagactccatctcaaaaaaaaaaaaaaaaaaaaaaaaaaagaaaaacagtgacataaacaggcaattacaatattttgttatatggggcacaagaagatgcccttggccctgcttcatgagtggtgtggggcagggtagagagagcagttcaggagaggtacgtatggatgtcatgggagctagcagccaggaagatgtaaacatgttaacaaggacctctccagagagaggtcttaaaattatccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccgttttctagccccaccctctcatttcatctagtaaatcttcattgcattaattattttcatcttaaatacaccgcatcctgctcctcaccttctaatattaatactctatctttcagtttagatcagttcctcttatccaatgttgcgctaaacatcccctgaagttgggggatcttttcctttctagtttttgctccctggcttcccttttctgttgctgactgttgaagctttcctgccccactggctttgaaggtaaattgtatatacatgagcttgtggggaaagctgttatataaatgaggacaattgatctaactgttagagtggggaaatggaagagattctgaagcctccatttgtaacttaaaaactcaggtttcatttcttaacaggattgatgttaaggaggggattccttcattgggcaggagggaggactgccataattccagcattcccactcttaatagtcagtgtcatcaggaaagaccacctcaagctttagtactttattcatttatccaactctgcacctgctgcctttgggtgtggtatttattcttgaccatatcaccctgacccggtaaccagaagggaacatgtgatgtgctctcatctctgccttaggggcagctccctccccacgttaagaatgctggcatgtaaataacactctcatctgtttagcgttccttttactgagcttcttggtatcttttctcatacttgtaccttttatgggatgtccccccctttttttttttgagacggagtttcgctgctgttgcccaggctggagtgcaatggcacgatctcagctcaccgcaacctccgcctgctgggttcaagcgattctcctgcctcagcctcccgagtagctgggactacagtcacccctccactgcacctggtactaattttgtatttttagtagagacagggtttctccatgttggtcaggctggtctcgaactcctgatctcaggtgatccacctgctgcagcctcccgaagtgttgggattacaggtgtgagccaccgcgcccagcctggatgtccctttattttttaaaggcttccttaaataccttgtttgtaagttgaaaagagcatttaaagagtgaacagatttggtttgctctggctctctaattattttaactttgttatcacccaatagttctaggttagtggttttcaatcctagcttgaacaggagtcatttaaaaatagcccaggcctcacccagggcacttctatcagacatctctaggggggatggcccaggcatcaggaggctttaaaaagctcctcaggtgattttagtgcattgccaaggttgaaaaccaaggctttaggtttaaactaaaggtgaaattgctctttttctggttcattttctactttagaaagtagaaattttttttctggttcattttctactttaaattaaaaataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgttgaatgtgtggcttgcattttacatttaactcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacggtctcctttattcaatatcttttttcaaacagctcacagatcttttgtggttttgtaagtgcctactccccaccgtattgccttctagagaagaggcaggaatttattttaatgtacaggacagacatgcatggggagtaaaactacagactccactctaggtgtgtggaaatactaaaaatagtgcttttctctgtgtgtgaagttggtctgttgagttttgtcatagacagcgttgagttcctctcccaggtggaggtggcgtagctttgcgtcacttacgtgtctctcctgatttccagtgacccggggaagacactgcagaggcagttgtctgtggtcaaaagtattctctgaccatggaactagatgaagctatgagcttccaggatcatgtggggctagaagaatgccgctctaaccctagaggagggacagctgagtgtcttctgatgtaactgaaattggagaatcaggtggattaaaattaattatttattacagtaaaataacctatcccatttcagagacatttgctatctttaaaacattaatactataatccaccttaccagtaacagtttacttttagtgacagtgaaagccattgactttttttttttaattgaaaagagatgttgcaaatagctggtgtacatttcttgagatgcactaaacaaggtagcgcacttgaagatcgtggcagtaataaagcgtttgtaagttctgagtaaagtattgaccagcacagcttccctggagaccgtcttctcattgctggattggacatttcactgttaagcttgtaggacgcttttgggcacctctctgactgggagctttgcagaacccagtggctttctctggagcaggtgctgagcacattttcaggctccaaaatcatctttctgctcttcagagcaagtttcttagcagattagtgttgagatttgtcaagggtttctggggcatcactaaaagtttcaggcaatggcccatcctgtcagattttagtactttggacacaggaaattaaaaaagagggcagatggtataaacattgcaaagctatgtacccgtgacagtgtaaatgaaaggtttgattgtgctaactctcctgcactttctttctgtgttcctgtagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggtaagtgctgtgtttatttgctgtaaaaagattgtttcacagcacctgggtcaagtgttatttcccaaaggattggaagacctttaacacaagtgtcaaatctccatttgtgggagaaaggaaaaacatccagcagtagggaaattagtaaataaatgatggttatttcctcaggttaaacattatatataaaatagtttcttttaaaaatagcagtcttccatttctcccatcattgaaggaataaaaatacaataagtcctcacttaacatcaataggttcttggaaactttgactttaaacgacatgtaatgaaaccaattttatgataggctaattgacgtaagcaagagttaagttcctatggcatatttctgattgataaaacatcatcaaacttctaaatagagactcaaaatacctcttatattaaacattgaaataaatgtgagccatacatacctttaagaaagattagtaaaataagatagttatttactagcttattccagttcaaggtggtgggaggccagagcctgtcctggcaggttggggtacaaggcaagagccagccctggacaggatgctgtccattgcagggtggactcacactgggaccattcagacatgccagttcacctaacacgcacatctttgggatgtggggggaagctggagtaccaggagaaaacctatctagacatggggagaacatgcagactccacacagatggtggcctcagctaggaatagatttttttctcatcaacgttataatgaaacaacgttgaacaaaacaatgttgtttgaggacctgctgtacagaaatacagacatagacacatgcactgcaattgcaactaagtttaaatgatgtacttactgggtaattactggaatgagctgcaaaatttggggtagttatgttagggtggtgggtttgtgatgatttttcctttccttttttccaacaatttctgtaaaactttctttatcgctgttatatcagacacaaaagatgggggtggtatttgaaagaaagtgaaaaactcagttggaaaaagagctccacagaaaggaagtttttctcttagcttgctgacttggacttccagttaggacttctgcatttcttcatctcttcttcctggataaggtttctccccatcttctccagtggtttgtgtgtatttttccatcttgacttgtttagtttattgcttgctttgtatcatcgttgctaagtgttgaaaagattctttctcttatgttttcatctcctcttctctctgttcttcactttctctcataggtcctacctgtacttcaggcccctctgagaccctgtgtccttgggccaaccttgacgacttctagcctcactcacctccttctcttggctccagctatgtggcattcgacttagcactgaatgatagaatagggctttgcatttcaccctctttattttgtgtttgggcatttccccttcctccaacatactggaagctcccagaaggctggtgctaaccatcattttctcttgtcacccaggtgcctgttgaggacctgaatgtctgagtaatggtctcatggtaaggatttctgtgtctttctcgttaggggcctttggctactttgaggtcacacatgacattaccaaatactccaaggcaaaggtatttgagcatattggaaagaagactcccatcgcagttcggttctccactgttggtaagttggtttattggcgtgattggtatggcttaactcaacttcaccttttggggatgtttataacttaaagaaaaagttattagaaaataggaagcaagcacttctccaaattatgtcaaggttttacagtagaagacatatttggagacacataggaagttacttgtatttctgtttgttgaggtcttaggaaatcacacttacacagaggctacctctgcaattctgtgacatttggaaagagctttcctaaaagtggttgcctctaacagaagaatagagtggaaatcttatttaataactatgcctacagctgacctttattgagaattaattctgtgccaactgtggttaggtgctttacagatataatctctgatttgtagatctactttgcagagtgggattctttttatttttgagaggctaagtgatgtttctcacgttacagagatagtattagatctatcatactatatttcaacatacctagtgcttcactagttccgtttctgtgtcagtctctgcattttaaaaatactgtggaatgtaaaaataaatgaaattaagaactaagaaccaatattttaactcattttcttaatgttaacctcatcattttgacaactcacttattctgtttgtcactactttaagcctcataattattttcttcccttattttaattaaaagttcaattacctgtttgaacaaagttatcttattatggtaaatgaatgacattgtcagctgttattacatgtgttctcttattgctctcaattaattattttgtttgatttgtggactgaattagctggtgggtagaaataataacccgggcacttaaatacctaatttagttcttggaagtggattagaaaggatggatccaggtgcttctttatgtctccaggcttcttggatgcaaagtgctgtggcttatgcttcctgtttccatttgaatattgtagctggagaatcgggttcagctgacacagttcgggaccctcgtgggtttgcagtgaaattttacacagaagatggtaactgggatctcgttggaaataacacccccattttcttcatcagggatcccatattggtaggtaatagagtattttgcactcaacaaatgtttgttgacttaaattgatttcaaataggttggcatttgaggagaagccgtgggaaaggcagaaagaaaagaatgcgagttgtctggactacttttttcaacacatttttctgtatttaataagataaagtaagaacagttaccattggtcttagatttgtcattttaagacagattgacttaatgggaagtgagtttagttttccttgcagagcatcgaagattagtaaaaagagggactttactttggaaacaagcagagggtgtctctacatgctctgagtcagcaggagggggtgtgtgtgcgtgcgcgcatgcgggagggtgggtatattttttccgtgaagaaatactataaatcccagcactttgggaggccaaggcaggcagatcactggagtccatgagttcgagaccagcctgggcaacatggcaaaaccatatctctgcaaaaaaatacaaaaattagccaagtgtggtggctcatgcctatagtcccagctacttgggaggctgaggtgggagatttgcttgagcccaggaggtcaaagctgcagtgagctgtgatcatgccattgcaatcagcctgggtgacagagtgagaccctgtcttaaaaaaaaaaaaaaagaaaagactatagttttgagtatatttgaaatactttagggtatcttagatgctagttgtctatgctgagtaaatttcatattatggtttggcagtttaaaattctaggattgtatttagaattataatccataaacctagtaataggcatatataatgaaagacaccataattcctgtaaacttagtttttggatttttttctctcttttttctatttagtttccatcttttatccacagccaaaagagaaatcctcagacacatctgaaggatccggacatggtctgggacttctggagcctacgtcctgagtctctgcatcaggtatgaacccttttttgccattgtattatatcacctgggatgcagtgtttaattatgcctcttcataaagtgtctctccagttttggctattttattggaatcagcttcctcagatttcttgatcgtgaagagttttgtagtaactggctttactaatcatcccccattcatcggccttaaatgatgatgatgatgatgatagatagctagcaacattgtcagttgatatttagcagtagtaaggatgaaagtctgtagtgtaaggtaaagctctgtattaaggaagtggggggaaagtagtaccaaacaaatttgctatgcaaataaattttgaataacaaattaggccagttttcaggttgttttggctttccttcatagaattttgagtcatagtattagtgatttgcatatcattttgatttaaaatttttctgtttgttattttctacaagtgaaataataatggtaacccttcccatgggaaattggctagtatgttttatgtcattaagggactttctggaaactaaggaatatcttaaaaatcaaggatgttttgatttaaatgaaaacattttaggctttatatttctgttctttaggtttctttcttgttcagtgatcgggggattccagatggacatcgccacatgaatggatatggatcacatactttcaagctggttaatgcaaatggggaggcagtttattgcaaattccattataaggtatgtgttacctttggggcagagggtacaaggctcctaccgcatacctccttatttttcctgaaggattgagcaaagattaaggcttctcccacttttccctcacctccatccccaaagttgggaagtattgatctcattgatcagtactgattttgttggctaccatctgaggaccttggagcgtatcccaatctcattatcacttccaacatccaatagtgtctttccaatatcatttcttttaactttttaagtcatccatctatttacttagcatttattgaggttttattatgaacaaggcatataagtaaaatcaattacaaatgtcagaaaacaaaattatactgtttttaaaaatttgcattcatatagccagatcaaatcagttacatctggggagggttttgagaatgttttaatcaactgaaatattataaagggccctcttttggtataagcatggcatttgttacaatgagcaatattgccagtgaaccctggcatgttagtgatattcccagagaactcccaagggctagtcagaaacaagcctgagaacctctgtttccaaatactgctgctaagataagcagaaagaagtgggctcgtgaccagtactggataatctctctcttagtgacatccaaaagccctattttcttctatcctgctttcttctttatctgaacaatttaatgtaggtatatcaaacaggaaaactatcacctctttttatattcataacttggatctataatatttgacaaggaaaaattttatgaaacagttgacccattggcttgtaattgccaaaagggtcaatgtagtattacttagaataagactaagtggttgtatctaggacagccagtctagttggtagccttggagttatgccagcctgaactcaaatttctactctcctagataattgtggccttgggcatagtattaaaagttctttgagctccagttcttttcactgtgaagttggcataatattaccagctatacaagtcctggaaagattggattgcttgtgggtcttttatcctagggccctaaggtagcctgagatctacatggattcatcagtctggattattctgacctaagattattcttttctaaacctaaaggattcagttaaaatcagaaaggtattgcagtgttattgtactacttaatatattagctctttgggcgatctgtacatggtgaccttcattgttttaatcctgaaggtggctttacttcttgttcagtagtaagagttcaaaccttttcactgatgagacagttgggatttctgtggtagaaatagaccagcgttcagagttgatttttgctaaggaaatctttctgcggcacttggcttgttgggaggtctttgagaataagatcacatggtcagtccatcaaagaacagtatgatatgataacaggagcacttatgaagtgacacagcttctctgggttttaatgtcttgcttggaaagtcagaatattaattttgcctgctcatagtcagagaactagttccaggtggctgtactgaagttcttttcaactctatgagctatgattctatgatttattaaaaaaaaaaaaaaaaggaataggacaggggtgaagggatactggccgagcacagtctcagtaattgatttgagctgtcatgaaatggaattaaaacattacttcatgataaaaggcaagtagtcctttaattttattaatcttttgcctacttttaagtatattttgatttttctgatttggaaagtaacatgagtgtaaaaattcaaataatagaatacataaagggaaagataggactgattttaaatatgaaatgtgtagatgggattcccttgacatttaaaagtattgggataatcaagtagaatttcttgttgataaattcattagtatcagatttgaacaatagaagtattgttgtaaagaaagttcattctttgggcagtgttactcataatccttcaatgaattactgatgaaattttgataactttgacaataagtttccattggagcttctttctttcattttgtagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtgagtcagtaaacaactatattgttttcttttttaagtctcttcttacctaattagaaaaaaaatctagtcaaacaattataataatggggaagtcatatacaaaatacagagggtaccacttcagagtgtcctaagctgtgaatgagtgcttaccagcatcttacttccacgttcctgtttgtcatttcattgagtatgtgtatgtggcttcatatattgttattaacagggaacagattatgaaaagctgatgtactttttcctggggaaactgtcagtatttaccacttactattgtgaaagatttaactaaggcactcatcttaaattcttatgttttattggatttaaaaattattttcattggcttgattgtatttgaaatctggtatttttgtgggtagctttgatttccttcagttgattgcctggtaattgtgaatatgacatcattttcaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcaggtgagcctggtggattgagatgttctgaggcaggtgtccatgtgagcatgcacacacaaaatatgcagcttggcatgatctttatgtgaggaattaacaagaacattacttaaactttaatctgggtgcttggttaccttgtgggattcactgaggtgaactattcttcaatgagcattccttgagtaaaccaagtataaacaaaagtccatggtaagatccctacatatgtgaagacaagaatacttactctcttaattaaaaaaaaaagacataatagaaataccttaagtattgatagagtgaagcatggtttgttctgtctgtagctgaagtatggttaattaattataataccttggtaagcctaactttattttcttgttcttttttttttttttttttttttttttgtgacagagtcttgctctgtcgcccaggctggagtgcagtggcatgatctcggctcactgcaacctccgcctcccaggttcaagcgatcctcctgcctcagcctcttgattagctacaggcgcccgccaccatgcccagctaatttttgtatttttagtagagacggggtttcaccctgttggccaggctggtctcaaactcctgacctcaagtgatctgcctgcctccgcctcccaaagtgctggattataggcgtgagccaccgtggctggcctcattttctgtttcatggtgatgcttgaatttttccatttgtaaaaagagatctagggatgatctttatgaactacatgtatgctgccagtgataaaagcagtggattaaccattcaccttgctaatgttaagccatcagtatgttttacatcactttttaatatctctttcaagagtaccaagagtgaaaaattgtactttggatcagaatcagtaagaaaataattggcttaataattactgtataaatcaatcttttgtggttttagactgtgaccttgaaacaaaggttaaagattgtaccctaaatcagaccacagcgactgaaggttacttcttatgtaagtatctgattccagttcaggtttcagtctgcatggaggacaagctaagattccgtttttaaaaaataacttttttgcttatgacattggggaacatctgaggcttttatagaaagtaagtttttcattagtttttagtccaattcaactgttacaaattgagtacctgtctgttgtgtatggtggactgtcttgggtgccataatgtaaggcagaatgccatggtgatccagaaagcaaaattttgtctgataggaggtcagccacgaagtttcatgaacgaggtagcatttgagattgttttgaagaatagataggattttgatttttagtaggtaaaatgcggcaggagaaggacatgagtataggcacaaaggtgggacatgttaggtgtgttgaaactataaacagtcactctctcctgaatgagaagaatagagtttgggtaggttcattgagtatatgtcagaggggaccttaaatgcttgagtaggagtgaaaagctttcttcagttttgagaagtgtggtctgggatatattgagtagaatcactcctcttggtgataaatagaaaaagcgacaactagggattgggaatagcaaaaggaaagtcaggcagttctcagaggaaaagcagaagtttgcattgaaaccagggagtagaggaagccaaaacaaggtaatcctgggccctaaaactccctacctggtggctgaactgtgagaggatgaggctaatgggatttgccaaggcatgaaattgtcatgggcagagcagaggctgcataaccctggttacccagggagggaacggattgaggaatacaaggttacctaaactcttttcacaagaatccaagtcaccatgggtctctggaaccacagtgggaccgtgaggcagtcagcagcactgagtcatataatttgaagaacaatgaagatttgaatggagaactaggcccccgggaaaaggactgcaaagcaaatacgtattctctacattcctaagaaagcaaatgtctaaggcagctattcaaacagtggggaagagagttctgaaaaaggatgacaagtagaaagtaatataatttctgttagtattaattttagttctggcaaatatatctattttaaattcagtgtactctttataggttgttttttttttaaatgagttttagaaactgttcgaaagagctttcataagtttgtcgagttattgtttctagcctagctttcccccatccttcttaggtcatttagctatcagttccaataccatggagcctgtgaggagccatacagttggggaaggactgttgtactcatttagccatttggtgaccattaaggaatgatttgagattttttgagtaggtgagtagggaatatgtagattgtcttgttggacaggaagtggaaagccagttaggggggctttggggttattcctgctgagagctcatgagtattgtagcctaggcagtggcggttgatatattaatgggcagtgtttacaggtgccttttaacaaggtcatgttattaagttttataactttatccaaagtggtgagccacaccatggtgaaatggacaaataatataatacaagtcatagagagactgtcctgtcccctgagtacctgaggacacaggtgcagcctttcttgctctcattctctgcattttgccaagagttggagaagttgggccggttgcttgggtgggaaaggctttcccactcacgcaggtccagcaagggagttcaggcacagggccttggggaaggcctagattcaagctggtgtcagggtatggcctcactgtgcccatttcccaacctttgttggtctccacccataggtggggtaaggttgcctgataaacacagggtgacacaaaatcagaattaggtgatagaggctacatccaggagctgcccatggcaggattgtatctcctatcctgttgatggagtcaagagcacaactttttgagccaaaggagacaaccagcttccaacctatagctgagttttggtcatggccgcatggctagtcatctaaatatgaccttaggctatttgaaatgatgataagagggagtcattcagccaaaagcaaaatattgacagaacactgggactggattaagtctgttggtatcagtgatttggaacaaagttattgcttaagttgccctattcaatttggtttttattttgcctcatagaattagggatataaaaatacttttaaggttcaaggccaatgataaattcaatggaagaaaaattgctcatagaaaaggagtatgaataatgagaatagttcaataattagatattaagattaatgcagaatttatcataaagcttttgtttgagcattaactgaaagaaatttcaagatgcttgccatctttgccttgattaacatggaacataatttaatcttagattgattacctttggcattgtagggctttcattttgaaccacagattttttgttattgttgtttatatctagaaagtctcagagctcaaagtgtttctgagataattcagaaggcagcatgggagtgggcggtactttttttttttttttttttttttttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactcctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttccttccctggagtgggggaatgaggaggaatagaattaattcaatatttcagttagttaacgttctagcacatttattttataatgcaatacttccttgggaataggaagtaatactgtataagacaagacactaacttgttatgcagaaggaaaaaaaaaagatattattaccaaaaacagatgtgaagatttatggttggccagagggcctgggaaattcagaactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtaggcctaaagacgttgggctccccctgcgtgggcagagggcacgtggagcagatgggcgggaggccaggccagtggctctcaagctggccccgcaggacctcctgcttggtaaaggtgctccccaggtgctgctaactgggcgcttttttgcccagcagtgaagatttaggctgcctgaggactctccatgctttttatctattttatatattttattgagcatttccacctcagatgttacttgtatccagtagttaaaagcagggagaaagatctttcacactggctagagtacagtaacatccagcttgggagttaggttttgaagacacttcaccaaaatggacaattccttaactcactgtgaaatcaccaagacttagacccttggaagtgcgaaagccaagagttggagtcttctgtttctctttgcagttctgctgtggccctggaggagcaggtctagctagaatttggaggggagctagaattagcagggaaggctggggagaagagagtaggggaggcagagcaagtcaaaggattcccctcccttcattttttcctaagtgaataaagttaggtgaatcaacttaccactttttgttttttggaactcatttatcaaacttaggatctttttcttttaactactttttttttggtgtcgtatacaaacagcctctggttctaattactttttctaataagtcaagcagaatgcttgattaaagttttttccttttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggaaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtatggtgttcttccttcccctacacacacacttggtgtcttgatgaatgtcatacataggcacctcttgattatccactgtggataatctattacggcagtgagctggctaaaattccaaccccagattggtttgctcaaaccacttaatatgtttctgggccactcctgtttaggcagtgtgtgctcgggtaatgaaagcttctgctaatgtcagccaaagcatagttgagaaaataaatatgctaaaacgaaaaaaaagccttataatttatttcaaaagtcatagaaaatattttgattgtatttgtcactgtttcttataagtccagataagtaagtgctgatatacaattaccacattttaaaaaattctttgtttattggtctgtggagggtatgaaagtgaagctacaatggaacaaagtcatcattgtcagtaaaggagagataccctgagaatcctaaaaacactttacggaatagcaaagtagagttctgtaatggaaatactgtatatgctgggctggaggagacaaaaaacccagagttccaaccccatatctaccactggctaccgtgtgaccttgcagcagtcaggtcccatcacagagctccatgcttgtgtctgtagattcaaggagcagaaccagaactttcagatttccctcaagaattttgtgatgcagtgtttgaattgagcccaagtccaaatgacacaatttttcaagtcaattttgaaatgtgtctttgagcctcatccctatatggtggccaaatcaagcctgtataaacttctacatgtgctgtacccctcagaagacttgatagatgagaccctttgaagtgtcaaaagggactttgagattcattcataaagtgcggcagcctgtgcaagcatttagcagatggcagcgttccctaagaatcttcatactacctgtagctaaatgcgggaaattaaaaataatatgtgtgcgttgtgtttatatctgtgtatgtgtacgtgtgtatttgattaccacttgaatttatttctcatcacagtgattatttgcagacttacttgacttttcttattcctaagtgcatctgggtggttttgttttgaaggtggtgctccaaattactaccccaacagctttggtgctccggaacaacagccttctgccctggagcacagcatccaatattctggagaagtgcggagattcaacactgccaatgatgataacgttactcaggtaatgacttctctttatctgctatggaagtcacctgctaattctccttgtcaatgcctgcataatccccctccctgcaaatgccccaactgtctgatgtatcttaaattgaattcaaggaagactcatctgtaatagtaaattgggccccttactgggtggagttgaagggttatattactctggtcttttgcctcaaagcatgcagactccgtctcagtttcttcaaactttattgaagggatatggggagggggcattggggaaacagttatctcatgggaatttaagaaatgagcatgtacagcttacgtggagacaaatctaagaatctgggcaggacagtccaggttcaaggactagaactagagatccaaaatagctccaggagcctcggccacaagagtgtgggcgtttccactgcagggctcgtccttcacgtggcttattctccatctgtctgcttctgcttgccaatgctaattgattatttttaccacagcttcctgttttctcctatctgcgtcagagcttctgttttatcatggttgtggctcttccacaacaatggaaaactctcctttatggcgtctttctccattattactttttttttttggaccaccttttactccttctctcaacatgtctatctctagattctagagagatggaatcctattgacttggctaatcttttcaccccaggttgcaccattggccttggtcaggctctagttaaccgccccagggcaaatgctcatcctctttccagttgcctatggctgccctaagagctgtttcagcacatgctatgaaggaggcccttggacttggaagggctgtaggtgggcagctgcctccttaatgtgtccagtgcaacttataccacacacaataaaataataaagttaaaggtatagttgttctagagctctgtttgagcagttagtgttaaacttagtatttaaattagattagaacctatttctagtttctcagtttgtgaatgtgggttccaagtaaaaaatacttatacatgaattaattcgctgtgaggatatctttgcttgaaaagcatttacgtatatacatatatacgtatatataaaaaagaaattacattattgtgggatataaaccatttttagatgagcttaaaacatttcctgcataccttttatgtaactgcattatttttggtgatgcagatgacaccaagtatattacagtacattccctgcctctcaaagaattttgcctatgtgaggtcaatacaggtattaaaccagctcatacaacccctgcaaaaattaatgaggctattgcttacacatgaaaatttattatgtgctcattcttattgagagaatttcttatcactatataggatatagtgtggtttttaagtaatcacaatactattgttatagattcatagcataattctgtgatgatgtatcacatgggaaatacataagaaggtccagatttattctcttaaaaatgattcacttgggcttgcatctgtctatggcagactagcttgtatcttacttaccgtttcatggagaacattgaaaaggtaggtaaaatacataaagcacttgtttgaaggctttggagagctaacaaagcaacaaggatttaagggaccaagatcaaagatggaaaagaagtgcaggaaaaaaaagtgcagtgaagtaagcttgacatttggtttcctttcctcttaaggtatttgttaatttgtaagcactggtccagaagctgagtggtgtttacagcagtctcatgagtctgaagggacaaaaattggaattcaaggtctgctaagaagcagagcctctagttatactcaaggctttcagttgaaatccttaaagggccatgcctaggaataagggcaaacatgaaataaacttgctttcacaatacaggaaacataactttgcctctgctcagtctcagattggattaaggtgatctctttctacgccatctgtcagaagcaaacaaaattttctttggtggaaaatagaaactcaaatgattctagacctttttatatggaaatgttcagcattcaacaataaatgaccaggcacctaacacattaagaccttatgactgaaaatcaagagggagaaaaaaccccctacaaactgacagtagaaacaaacctaatggaggcttaaataatggaactgtcagatacaggttttaaaatgactgattaataggtttgagaaaatagatgggctgggcgcggtggctcacgcctgtaatcccagcactttgggaggctgaggtgggcggatcacgaggtcaggagatcaagaccatcctggctaacacggtgaaaccccgtctctactaaaaatacaaaaaaaaaattagccgggcgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcacgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagctcctatttttcattttaatttatggatatttattttagaggtcaacccaataatctagcaaaatatcactattaatatgtcttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaaaaaataaactagtaatccccaaccaacttctgattattttctttccatgttttatctggtctggcatatccatcgtccttagctgtttgtccagtgtgtactaatttagttgtgttcagactgaattttgtcctattctgtttaattcagctgcagccaagttctgtgcaagatagtaaatgtgcaatatcaaaatgtgagtcctgctgcaattctacttaaactttggatgataataaatatatcagccggtgtgatggcatgcacctgtagtcctagctacttaggaggttgagatgggaggatcgcttgagcccaggaatacagggccagcctggacaacatagggagaccctgtctctaaaatcagtcaatcagtcaatcagtctgtctttcttttttgcatttttatggtttaaaacctgcctaaaggcttaatgtcataatacctcgatcctccttcagatgcagactagaaatttgcatgatttctggaataagaactgcaatgcttccaaaaggcaggctagactttcatgctaaggtgctggggtatttctgatggccgctcatcgagctgagtgaagccctctcacttctggtttcctggcctgtcccagagctaagctttttgcaaatctagaaatccccctttttccttggcccctagttgctgcttctcagttcctaggggcagctgggctagcagctgtctgggctgtgtcccagagcctgggttccagtatcagcagagagcttgacaggcgctctgtgtggtaggcagggcaggatttatctccttttactggagagaatggatacgacagcttgtaaatagcagaactgggctggaacccttggcattctcctttcacatatgctgaaactgtaaggcttttatgggttcccaatgccctgcctcctcttgctgtccactggggaattcctgcctgaagtgtgtggagttgtgctgcatgtaccagtgttcttgtatccttcacattaactttaggctgtgtctgggcccgtttctcaatgtaaatcactgtaatttgttaagcgcttactctgaggtcagctcttttcatgcagtaaatgcacctcacttctcagcatttttctcacagcatcctgtgaggtaggttgtgtgggttttttttttttaagatggagtcttgttctgtcacccaggctggactgcagtggcatgatctcggctcactgcaacctctgcctcctgggttcaagagattttcctgcctcagcctccccagtagcttggactacaggcatgccccaccatgcccgactaatttttgtgtttttagtagagatggggttttgccatgttaaccaggctggtcttgaactactgacctcaggtgatccacccatcttggcctcccaaagtgctgggatttcgggcgtgagccactgcgcctggcctaggttgtatgggtttttttccccgacaataagcaattctgtaattctttgacagtaactgtgtgtcctataactcaattcaattctaacagtagctcctggagctagagtcagaacccaaagatttaggggtcatttcccactttagataacaaatgaggtaccctggctatgcacacttctgcagattctgactgcaaatcaaaccctttcctcaggtttgataatttgctggaaagactcatagaactcaggaaaatgatttacttatgattaccaatttattataaagaatacaactcaggaatagacaaatggaagaggggcatgggggaaggcctcggagcttctgtgcctccctgagtggaccacccttctagctcctggatgtgtgcactaatccagacactccctgaccttgccagttgtgggtttttctggaggttttatgacataggcatgattgatgaaattattggctatgggtgattgaatacaatctccagcccctctcccatccctggaggtttgggggtggggctagaagttctaaccttctgatcgcgtgcttgttcttcctggtgtgagcctccatcaggaatctatgtaggcccccatgaatcatcttagtagtatataaaagacagtacattcgaagggttttagatctgtgtcaggaatgggggacaaagaccaaatagtatttttaaaattatactgattaggtgtcattttcttgcgcatttcggcagagggacataagctcagtaagttaagtgacctatccgaggttgctcagccagtatatgtcagagtgttcactggacctgcatcttaactctgaggctggcattgttaaacacctgtagtactgcctcctgctgaaacgtctttcctcccctatggaataaacactgggaaaccacagtccctggggagtgatatagtagggagttagagtaatgcttgcatttattttcctttggccttaggtcaagaacttcactgaggtccaccctgactacgggagccacatccaggctcttctggacaagtacaatgctgagaagcctaaggtaagctgggagcagcctggccatgcagaggctgtgtgtgctgggttggagtaggcatgacttagttaccacttagcattacagtctgcaggggccattacctgccactgttagatttcttaggcagctgtgcagaaattcatttgagagataaagaattcactggcaaaacacatactcttcattttagcgctgggcaatttaagacagttaaagtgaatgaattctgaattattattttcatttgcatacatattaaaactgagtaaatatcacgttgctgcccatgaggtgattaacctgctcatcttgttcttttaaaacagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaaca

SEQ ID NO: 35874 - DNA, 50576 bp, Homo sapiens
aggcacaggcagcctgcatacactccttttcctggtgtcaacattatttaaaagcatgggaaatagtaatgagacagtgtcttcttcattagaaccttaggagtctactagatttcttcatctctatttgttgttattagtagccaaactgtgcaaaaaacacggtcttgagaaatgacagcacagtatcttagagggaaaggaaatgtaggatgccagtgtggggacaaatttctgattgccagtgattgttgtgagcataacaataatttcatgaacattaaagcctctattgagggcagctgcagttgtaaaggaaaaaaaatggtcctgaacatttaaaactacactggtgtacatcataatcaaacaaagtaaacagaaaaaaatttaaactttgctaaaaaaaaaaagcagaagcacttgatctttaggaaggcacgcagttgcttattatgaatcatttctagagtccgatgcattttcaaagccggttacagtcattacgaagcacacccttgtgaggtaagtgtatcatcacctttggttcataaataaaaaagctgagacgccgagcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaaaaaaaaaaaaaaaaaggtgggggagagactccacttcccagaagcctctcgttactcacgcagccgcagtcttgcgcaggtgccgccagggccaaacggacatatccgtcacgtggccagaagctggccaatccggtttgaatctcatttttttcctcttacccccccttctggagcggttgtgcgatcagatcgatctaagatggcgactgtcgaaccggtgagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgaggcggcgtgtagcgcacactttctggtgggggcccgagaactgggggagcggtgtgggggaggggcggcgtggcgcctcctgcggaaccgcgaggtgtctacagggtggagggtagctggggttctgggctgggtatgcgaggatggtgtcttcatgataggaaggcgcagggccggctcccagcgagtactgggatccgcaggcagggtgggcggcgagccggcctggagtgagatggaggagggagccctggagcagcctttccctccctgcagaaccccagctccggggctcgggtgcggggcgcgcgcacgtcttccttagaccggtggactggggagctggtgggcgagtgttgccggagggtgggttaggcgggagtggtgccgcggcacgcgcggaggagcttcgacctcgcttaggggagttgagaggggcgagcgtctgttaatccagcgcgccggagagttgccggtgtttgcgccaggggaagcgagaaaggtctggggtgggaaggaacactcgtgtgtcacggtgaagctctccaagtagaatgagggatggtggtggtgagaaggggtatcacattgtcctcgcccctccatgcttgggactgggctgtcatggaggagggaagggggaggagcgaggcctacagatcgctgtagccggtcggcttgccggccggacctgctgcatttcacacgcgcccgtcttccattcattcatcctttccgcgtagtgcgcacgcctcagagaatgcgaatgggtctcaatccctctgttcttccgagtctttatctcctggaagatttctgagacgcagtttattggaaatagaaacttttaaatttacttttccatttgactttttttttctctttatctatgctacagactttcatttcaatttaggcaccattttaaacttaactgaagcaagctggtcccagggtaggtttgtagttaatctttaagcagagggtatatttttcataatttgggtttgccaggactggctcactgaaacttctgggccctgttgcctttttagaaacgacacagctaagtgaagatatcttgtgtgcataatggggtttattagcaatcagaaaacctttcacactctggaaccagctctagaccttggttgccagatacttttgtgtatcttttcatggtagcttgtggttttgctaatggtttaccagtttgctttgacttttaaagacttttttttttttttttttttttttttttttttgagatggagtcttgctttgtcgcccaggctggagtgcagtggcgtgatctcggctcactgcaacctccgcctccgggttcaagcgattctcctgcttcagcctcttgagtagctgggattacaggtgcgcacaaccgtgcctggctaatttttgtatttttagtagagacggggttccaccatgttggccaggctggtctgaaactcctgacctcaagtgatcctcccgcctcagcctcccaaagtgctgggattacaggcgtgagccacagcacccggcacttttaaagacttttataaaactatttcaaaaactcttatagactacacaaaggcttatttttcattgcgttggtgtaaactatccttaccttgtcaaaattcaaggcagcttctctgcttgcttacttgtttttttattggcaccagttttcatttatgttcctgggaattaaattgactgaaaaactcataagttgttgctacagttaactgactttaggacattaatattacataacactaatgaagaataagtatgtaaaatatacattttaaaccccttgacaggttctgatgtccacttttgtctagatctgttcctaccccactacactagtgtcagtaaaaagcattacatctggtaataggggcaaggctacgagactgtaaactataaaacaataaggagttctgtgaggtttctgtcacatttaggtcccttgagttttgcagagtttatgcagttttgtttcagcagcacagagcggaactgcaaagtgatgaaggactatattttgagttagtaaatattaatagctcctgatatatccagggtgttgtaccaagtgttctttaggatacaaagttatacaagatgtgagtcttgttgaatgtaaacccttaaggaacttaattcctagggatgtggttagtgatacagtatttgttctggtacagactttgggagatttggatgttatgtttaaatttggggagtaggggaacctaaaaacaaagtgtgtgaagctggaaactaaagtattttgagaatatatgtaaaatagtatcgaagtgtttagttttagtgagaaatgaattttttttttttcgatactgactttcactcttgttgcccaggctggagtgcaatggcgcgatcttggctcaccgcaacctccgcctcctgggttcaatcgattctcctgcctcagccttccgagtagctgggattacaggcatgtgccaccacgcccggctaattttgtacttttagtagagatggggtttctccatgttggtcaggctggtcttcaactcccgacctcaggtgatccgcccgtcttggcctcccaaagtggtgggattacaggcatgagccaccgcgcctggcctgaaaatttttagtacttttaatatacccttgtgcacaggctagttatgtggaattatttttgacagttttaaatagttggattttgtgtgtaggggtgcaggatcttgctctgttgctggggctggagtgcagtggcgcgatcatagctcactgcagcctcaaactcctgggctcaagagatgcttccatctcagcctctggtgtagcaagcactacaggagcaggccaccacgcccggataatttttaaactttttgtagagatggaatctcgcgatggttacccaggctggtctcaaactcctggactcaagtggtcctcccaccttggcctctcaatatgttgggttacaggcgtgagccaccgagcctcgcctggatttttttttgaagcaactgattagaattggattgtacttgagatacccctgctgaaggctgcaaaaatcatgttttttcttacttcagctagtttgtgagcttccataatggttttctgctgtgcataatcataaacacttaaaaagagccatgggcttttcctgcttatcccatcatgcataggtatctggatgatttttgtctatggacattacataaaatatcattttcagtttgatattattgtgtggttttctctttgtatgagttgagttacatgaagatgtggcccacaaatattaaatttgttgagaagcttgaaagggaaaattaagggaaacattttacctcttaacggataatttggcaaaaatttgaacgttagggcaaacggtactctgatgttattctatcggcatttgaattgtggctgggtcaaaattaggtttaatattagtctgtgaaaatggcaaggccatcttacctccagtaggtcgtgtttctttgtagctttatcttcattctacatcgttcattattagaattaaaaaaatttttttttgacttgtagttccttttgaggtaagagattaattttgatttctttagcttaactgaaagtgtataattttacttgtttttacattgtagctcttgaattttttgaaaccacgctaatttcataagtgaatcaacttggacaatcagctaatttaatgcttccttttttatactttggaaacatgctctgtactacacagcttattaataagagtaaataaggtttatatacatattgacaaatatttgttgtactatataattcatattaatgaacaattgaatgccaaccagactatgcaaattagtggactttttgcttaatgaaagaacccactatatcagagttcctcgataatccacgtaaatttggctctggggttcatattccagatttcttcaattaaaagaaaaaaatatacttgctgagtgcggtggctcacgcctgtaatctcagcactttgggaggccgaggcgggtggggatcacttgaggtcaggtgttcgagaccagcctggccaaaatggtgaaaccctgtctctactaaaaatacaaaaattagccaggcctggtggcaggcgcctgtaatcccagctactggggaggccaaggcaggagaatcgcttgaacctggaggtggaggttgcagtgaaccgagatggtaccactgtacttcagcctgggcgacagagcaagactccatcaaaaagaataaaaaaaaaaacagaaacaaatttcacacttcattttataatctgagttaatgagcatgattattagacttagagaaattcaatgtagacacacagtttatacacagaagttgcagagggataatatgcaaaatgaattatgtaagcttactctagtttggacagaaaactgtaggcaaaaaacatttaagtaaaatattgtttaatttacataaagttaagaatatgggccgggtgcggtggctcatgcctgtaatcccagcactttgggaggccgaggtgggtagatcaccaggtcagtagtttgagaccagcctgatcaacatggtgaaaccccacctctactaaaaatacaaaacttagctgggcgtggtgatgcgtgcttgtaatcccaaggtactcaggaggctgaggcaggagaagctcttgaacctgggaggcggaggttgtagtgagctgagattgtgccactgcactccaacctgggtgacagagcgagactccgtctcaaaaaaaaaaaaaataaacaaaagaagtttccttaatctattagtaccggtgagttgcaccatcttagtcatagagacttttttgagaagtggaaatgagcatgggttatagtctcatcttaatatctgagtgatcttgaagactgaaatttctaagtcagctgaaagtcggaataagatatattacggtgatttcaatttttaaatgcagtattcaaaggtgacagtttgtcaactgtaagggactaaagttgacattccatgaatgttttatactcatgtatatccatgcatttacatactattttccctcttttcttggaaattcacattgctgctttttaattatcaatccttagccattagcaagaaatgcaaagcctgtgattcacaatcctaagatgttcttcccactcctatccctaccataaaaatcactagtgttccttcaaaagtccctaatcatgtctccagaaaaagaaaggggctgggcttggtggcccacacatgtaatccgaggctttgggagacaaaggcaggaggatcacttgagcccggagtttgagaccagcctggccaacatggcgagaccctgtctctccaaaaaattaaaaaattagctgaatatggtggtgcacacctgtgtcctagcctcaggaggctgaaatgggaggatcccctgagcctgggaggtcagagctgcagtgagctgtgatcacaccactgcattccagcctgggtgacagaaagagaccctatctcaccaaaaaaaaaaagaaaaagaaaatgattttgcgtgtgtgtgtgtgtgtctaaaatactaatagtcatttctgggcacttctggaacctgagaatgtggtcagaaatataaggggtttttttttttttgtttccccagttggaacttttgatacattattccatagaaacagtaggaaaatgggccgggcgtggtggctcacgcctgtaatcccgacactttgggaggctgaggtgggcggatcacctgaggtcgggagttcgagaccagcctgaccagcatggagaaaccctgtctctacttaacaaaattacaaaattagctgggtatggtggcacatgcctgtaaccccagcttcttgggaggctgaggcagaagaatcgtttgaacctgggaggtggaggttgcggtgagcctatgtctgccatcgcactccagcctgggcaacaagactgaaactccttctcaaaaaaaaaaaaaaagaaaaaagaaaaaacaggaaaatgaagtttagtcacactatattcagtaaatttttgtggaatcattacaaatctaaccagcattggatttatagggatatggaattaaggatatggatttatagttgtaagcaactaactaaaaaaaccttataaacataccttgtttgtaacagctatttttaatgtagaaagatcgttatttgtaattgctacacatagcacttattctatgttaagtaccacactgaatgctttacatatattaactcatttatttcttttttttttttttttgagacagcgtctcactgttgtcccagctagagtacagtggcgcgatctcggctcactgcaacctccgcctcctgggttcaagtgattctcctgcttcagcctcctgagtagctgggactacaggcacgtgccaccacgcccggctaatttttgtatttatagtagagatggggtttcaccatattggccaggctggtctcgaactcctgacctcgtgatccgcccacctcagcctcccaaagtgctgggattacaggcgtgagccaccgcgccaggctaactcatttaattcttaacagtacagatgaagtaacattgtgtgactaacttgctccaaaatcacacagctattaagtggtggggtggagtttaaattaaagcagccaaagtgcagagtgtatattcttaaccgttgcactctttcaagtaggcatgtaatgtgctttgcttgggtgacttcagaaggggagatgtgttttgataagcttactatgtgttttgctacagctataaaataaaacgtgtgggcatttatttttaggccctgttatattacaatgttagataacaaaaatatataatcttgaggactaaaccaagcaattacaccaatcgtgttttagtaactaattgagaactttgtggatttctaaagaaagtggatggacacttaaccttctccccctttctaatttgatttctggcatttgctagttcgtatgatttcccagttaaaatattttgctagtgaaaaaagttttagtacatttttaaaagtttgtgaattttggatttattctagacttaactaccttagtacttttagtaattttggtgataagtctggcaaagggtaaaacagttgttttgaaaaagtttaagctaaaatgtacacatacgtgtttcttggtgtattttaagcttgttactacaaaatgctatacagaaattagttgtaatatttttttctgtgctctgctcattactgtcattgtaatctctactaaaaatacaaaaattagccaagcgtggtcacgggtgcctgtagtcctagctacttgggagactgaagcaagagaattgcttcaacctgggaggtggaggttgcagtgagccgagatgatgacattgcactccattactgtcattgtaatgagcagagcacagaaaaaaatattgtaactaattttgatatatatgtctacatatatatgtcaacatattagtattgccgtgaaacttcttatggggcagtaagcctatgttggcacaaaatctggtcagaagtattaactaaggcaagaaagtttgatattttaattgatatgtgaaatgtatattttttcttatagttctttttctgatgaataaatgaatactttataggtgaggaattcatatttcaagtgatttttaactttctaccacggtcacatagttccttaagtgttacatacaaagttttggtgccgcaaaaggaatagcacttgaatataaaatttttttttaatttttagcaaggcaagttatttttatagaactcataattaacataagtgagagagaactcaaacctgagtgtcaagctttattactatcttgtgtaaaaagaggaacaaattcaaccaaaactaaagtccatccttcagtaaaacttgtatgttagggttgatactgatgcgtaggtacacaaataagtgtaaaattctaactgaaagaatatgccagatggtttatggatggtgggattaggagggttaaatttttttcatttgaacttgtatactttgttaccatgttgtggattgtaaaatctgttttggatgttggtttatacatcatggtatttagcttttctttattttttgttttttttctttgacttagttacatactcatggtccaaaatagcaatttggtaaagcctatagcccctatcttagagtgttttaaaatgcaggccaggcacagtggttcatgcttgtaatcccagcactttgggaggctgagatgggcgaatcacctgagatcaggagttcgagaccagcctggccaaaatggtgaaaccttatctttactaaaaatacaaaaattagccgagcgtgttcatgggtgcctgtagtcccagctaaggctgaggcaagagaattgcttgaacctgggaggtggaggttgcagtgagccgagatggtgccattgcatccagcctgggcaacaagagtgaaactccgtctcaaaaaaaaaaaagaaaaaagaatgttttaacatgtattacataaaatgcataggtttacaaaggaaaccaatttatactgaagtacaacaaggattgaattagcatgagtcatattaaggacattatctggcacaggctaagttctgtctaatgtggaaaacctatctcctgcctatcttccccaaccacctcattcccctttccaaattgcccaattacaattttttgaggattctactagaaaaagtctgtccaggagaactttctgagataatggaaagggtattttttactgtccaatacagtagccactggctgtacatggtaattgagcatttggatattgtggcttgtgcaaccaaggaaataaattttaaactttatttaatattaataattaaccacatgtaggtaatggctacctaattgtgcagtatggcctcagaagctagaaattctggccgggcatggtggctcacgcctgtaatcccagcacttggggaggctgtggcaggtggagcacttgaggtcaggagttggagaccagcctggccaacatggtgaaaccccatctctactaaaaatacaaaaattagctgggtgtggtggcacgtgcctgtagtcccagctactcgggaggctgagacaggagaatcacttgaacctgggaggcggaggttgcagtgagccaagactgcaccactgcacgccagcctgggtgatagagcaagactccatctcaaaaaaaaaaaaaaaaaagaaaaagaatctagaaattctggtgtgtgcaaatgtatgtatacatattgtatttagttcaactttataaggtataactggatatgtccagtttggttagatacatgattctatcctagaaaagcttgtcgctctgtattttaaactttgaaagatagttatttactcttgtatagaattagaatttttctgtgggttaatgtttttttttgttttttttttttttgctagtctttttgtttctgtttttgttttgagatggtgtctcactctgttgtcaggctggagtgcagtggcacgatctcgggtcactgcaacatccacctcccgggttcaggtgactcctgcctcagcctcctgagtagctgggactacaggtgtgcgccaccactgccaactaatttttgtgtttttagtagagacagcatttcaccacgttggctaggatggtcttgatctcttgacctcatgatctgcctgcctcagcctcccaaagtgctgggattacaggcatgagccaccacacccaggctttttactagttttttaaatgtgtgtgtaaatagacagtactttacagtgttcaaaactcaagttttatgcaaaagtacacagtctcctgaagctgatccctatccaggcagatgacctagaggcaaccagcattgtcagttgtttaacttttaatagagatttgtgcatatacagcaaatatgtatatttataaaaagtaaatagtagccagctatgtgcacttttctggcacattgtgttttttcacttaatatgtcttgtagagcattacatatcaacacataaagttttcacttcttttttctgatggtatatgttacactatttggttttaacataattatttctatattaatatttaggtcatttccaaccatttgctatttcaaacattactgggataaataaacttttccctgtatcattccatacacgagataatatatctataaagtagatgttttgacaacggattgaaaaattttaaaccctgttggtcagataaaacactttttcaaatatagttggttttcaggctgcaattttttttttagtgctcctccctttttcaaaataaatgtttatatgtaaaaacaaagtataaaataggtatgtacgttttcttttatctttaatttttttttctttctttttttttttttttccaagacggagctttgctcttgcctaggctggagtgcagtgacaatctcggctcactgcaacctccgcctcttgggttcaagcaattctcctgcctcagcctcccgaccagctggattacaggcgtccaccaccacatccagctaattgtttgtgtttttagtagagacagggtttcatcatgttggccaggctggtctcaaactcctgatcttaggtaatccacccactttggcctcccaaagtgctgggattacaggcgtgagccaccacacctggcaaaaaaaaatttttttgagacagggtctcactgttgcccagactggagtgcagtctctgctcactgcaacctccgcctcccacgttcaagcgatcatcctgcctcaacctcccaagtagctaggaatacaggtgtgcgccaccacgcccggctaatttttgtatttttagtaaaaacggagtttcattatgttggccaggctggtctcaaactcctgggctcaagcagtcctactgccttggcctcccaaagtgctgtgattacaggtgtgagccatcacgcctggccaggttttagagtagtaaactgaagacacatgtaccatgacctaggacaccacagcagcatttcagcttttttaatactcccgtgatcacattcttgtatctttggcccctcctccatcttcttttctgacttttgagtcaagcattcccttgctttttgttttttctacattaacctcccatgtatgtatctttcagctatgtgttgtttagttttgaaaaaactaaaaagctagatgtttaagggaaagatggtattgccactattggatgaaggctcataaaaatgataatctgaacacagtttttggtttatagtttggcttcagcttcctagaatttctactagagccctttttcgggaaaccagtgggcatgatcatggacatgtcctgggaaacataggatttatagttgttatctggtgaggctgttttgtgggccaggcaaagaatcttcagtaagagagtggtctttgggaatatgctgctctgtatcttgttttaagattggattaaagctgaactcttctggtgtaaagttacctaatacagttagcagggcataaaggagagaagaggaacttcatgaacacatggtcaagcagaattaagtagagataaaagtctgggctggacacttgagcatttgggttttttttgtgtgtgtgtgtgtgtgtgtgtgtgtgtgtgtgtgtgtgtgtgtgtgtgtttagaaaaggtagaataataaaaataggcattttaatcatagcagccattaaatcacattgctccagtcacattcacctgaatcacattgctccaatctggactgctgccctttatatatggtaaacatttgtcttccctggatctccttttaccatgttcctgattctttcatttgacttttgtgttccacccttccatttgctgtgccctttatcttcctgttatttggtttcttatctcacgttggtgggccagatctccagcagttttttgagaaaaagtacatagtaaaaaaatttttgaggccttgaatattaagtgtcatacctgtagtttggctggacatagaattcttcaggattctgaagtcaagtttcatggtggacttctgttgtagctgctgatgagtctgaaattattctggtagctaaaaattattttttagtgtgacctgttgctctctcaccctcactccctataatttgtagattctttttcttgtccttatttcacaataatataccttagtataagtctgttttcatccattgtactgtgtactcattgggcatttttaatatggccactcatgtccatcacttctcataggtttattggtaattctcctcttttttctctttgaaacagttactcagatattagatctcttggactagttctctgggaaatttcatttatttttcaaccttcattttaagtttccattcattttgaatttccaggtatttattttctccctcccatcctccttctcttccttttttttttttttttgtcctctgaatgttcatttttatagcttcctgtaattgttatatacatgcaaaatcttaacttattcctttgaggaagtacgtagactttttttttgagacagagcctcactctgttgcccaggctggagtgcagtggcaccatcttggctcactgcaacctctgtctcttaggttcaagtgattatcccacctcagcctctcgagtagctgggattacaggtgcccaccaccatgcccagctaatttttatatttttagtagagacgagttttcaccatgttggccaggctggtctcgaactcctgacctcaagtgatccgcccgcctcggcctcccaaagtgctgggattacaggcatgagcagaagcaaagttttaagaaggaagagcaaaggtgactggggaacttactgtaccatgaagaaaagtattattaaagataacggccaggcgcagtggctcacgtctgtaatcctagcactttgggaggctgaggcaggtggatcacctgagttcaggagttcgagatcagcctggccaacatggcgaaaccccatctctactaaaaatacaaaaaattagctgggcatggtggcgggtacctataatcccagctacttgggaggttgaggcaggagaattgcttgaacctgggaagtggaggttgcagtgagccaagatcacgccattgcacttcagcctgggtgacagagcaagactctgtctcaaaaaaaaaaaaagtaatttacaaaaatatgatattggctgttggcccatgaggggatgggcagattattggaatacactgagcagtccaggagtagtttcagatgtttatttgggctttaatataactttgttataatacattttgaacatttagatcattgtgaaaaaataatctgtaatctcaacaactaggtgttctctggtaatattttggttcacttgtttgtgaacttctctttttttttttaaccatatccttcttcgtaccttttctttttcccttttaaatacttaattttcggccgggtttgtgtgcgtagctcatgcctgaaacctgaagcactttgggaggctgaggcaggtgaattgcttaagcccaggagttcaagaccagcctaggcaacatgatgaaaccctgtctctactaaaaatattaatacaaaaaactagctgggtgtggtggcatgtgcctgtagtcccagctactcagaaggctgaggcgggaggattgattgagccctggaggtcgagacttcagtgagctgtgattgtgccactgcactccagcctgggcatcagagcgggaccctgtctcaaaaactaactacttaattttcttagagcagttttaggttcggagcaaaactgagcagaaaagacagttcccgtaacttactccttgccccggtgcaggtacagctttcccagtgtcaacatcctacaacagaatggcacatttgttagaattgatgaacctaaattgacgttattgtcacccaaagttcatactttacattagggttcactcctgatgttgtacagtctgtgggttttgtcaaatgtaaaatgacatgtatctgcggttataatatcgtgcagaataattttactaagccctaaaaatcctctgttctgcttgtttataccctccccaccaaccactgatctttttgtcttttccagagtgtcacagagttagaatcatacagtatgtagccttttcagcttagcttctttcacttagtaatatacatttaagttccttctacgtctttttatggcttgataactcattttattttagcattcagcaatgtttcattttctggatgcactacagtttatttaggacttcttaaaataggtcaaaagcaaaaaaaaaaagtgctttttttttttttttttttttttttttgagacggagtctggctctgttgccaggctggagtgcagtggcacggtctcaggtcactgcaacctgcaacctcctcctcctgggttcaagtgattctcctgcctcagcctcccaagtagctgggattacaggcatgcgccaccacgcctggctaatttttgtatttttagtagagacgaggtttcaccatgttggccaggctggtcttaaactcctgacctcgtgatccgcccacctcggcctcaaagtgctgggattacaggtgtgagccaccgtgcctggcctttttttttttttaagtgctcatttttatatggttctgtaatctgcttttctccacatttgtattagttttaaagtaatttttacaaacatgtttagtgcttacatcataaacgccgtggtttgtttatctgttaccttttggttatatctgttgatagatgtgttgtctcttagaagtctaattactaggttaaagaatgtagatgtttttattttaattttattatttttctattttcccatttagttttggcttggaactcagtagatccttttacgtttggaagcttgatagtttaacttaaattaagtaaaacttaaactaagtaaatagaaggttgtattccactctgtaatcctgggaacatatgaaactgatgactatacctggttttgtaaatttttttaaggtatatatttcttcaaaatattttcttttgaaaggtgattttaaaaccttggtacataaaaaggcaggtgtggtggctcatgcctgtaatcctagcaacttcgaaggctgaggcaggaggatcacttgaggccaagagtttgagaccaggctgagcaatatagtgagacctgtctctaaaaattagctgggcatggtggctcatgcctgtagtcccagctattcagtatcgtctcttgagcctaggagtttgaggctgcagtgagctgtgattgcacccctgcactccagcctaagtaatagtgataccctcctctgaaggcaagaaaagaagaaaaaaaaaatttgttggataagaagttgttacagaaaacaaaatgaccttattaaagctacagtttacattgaaattataacctttaacttttgaaaatgaacacatagaattttttttttttttgagatggagtcttgctctgttgcccaggctggaatgcagtgacactaccttggctcactgcaacctctgcctcccaggttcaagcaattctcctgcctcagcctcccacgtagctgggattacaggcgcgtgccactacacctggctaatttttgtatttttagtagagacgcggtttcaccatgttggaccaggctggtctcgaacacctgacctcaggtgatccgcctgcctcggcctcccaaaatgctgggattacaggcgtgagccaccacacccggcaaaacacatagaattttaacagtaactgctcatttgtttgaactgtgacatgtaaagattgatttttttaaaaaactagaatttagtatcatgaaattttagttatgttttctaagttttaaaatgtataaacgtttaaatagcagttaaattctttaaaagatttgcctttcaaatacttcttataaagctttaaggaataattgaaatggaaattatcatgttactgcagtcaacagttttgtgcactggttgtaatgccattttagtgttgatatattttgaatcatttttttacttttgcataatgttcaacgtatgtaaatttttcttttctttgtggttttttttttgagatggagtcttgctttcgctatgctggagtgcagtggtgcgatctcagctcactgcaatctctgattccctggttcaagcgattctcctgcctcagcctccttcgtagctgggattacaggcatgcaccaccacgcccagctaatttttgtattttttagtagcggctgggtttcactatgttggccaggatggtctcaatttcctgacctcatgatccacccgtgttggcctcccaaagtgttgggattacaggcatgagccaccgtgcctggccgtatgtaaatttttctttttctttttcttctttttttttttcgagacggagttttgctcttgttatctaggctggagtgcagtggcgcgatcttggctcactgcagtttccctctcccgggttcaagtgattctcctgcttcagcctcccaagtaactgggattacaggcatgcgccaccatgcccagctaattttgtgtttttggtagagatggggtttcaccatgttagtcatgtgggtcttgaactcctgacctcgtgatccgcccgcctcgacctcccaaagtgctgggattatatgcgtgagccactgtgcccggcctgtaaatttttctagttattttaaattatgaatcttctggtagcctttggtttaaatagtagtgacatttaaattttatcattagccttgtcatcctagatcacacatctgttatttcttgtgtctgtgttatcacctccccaaacccagactgaatttgtgatgttggcttaagctatataatatgtgcaaagtaatttgatcagtaggtacatgttagtgctcccttaagaatgttctttaaaaaaatttattttaaaatgttaaaaggtgaccacaagtcttctttttttttttttttttttttttttgagacagagtttcgctcttgttgcccaggctggagtgcagtggcttgatctcagctcactgcaacctctgcctcccgggttcaagcgattctcctgcctcagcttcccgagtagctgggattacaggcgtatgtgccaccacgccctgctaattttgtatttttagtagagatgggatttctccatgttggtcaggctggtctcaaactcccaacctcagatgctccacccgcctcggcctcccaaagtgctgggattacaggtgtgagccagtgttcccagcctcctacaactctttctagtagttaagaatgtgctgggcgcggtggctcacacctgtaatcccagcactttgggaggccgaggcgggtgaatcacgaggtcaggagttcaagaccagtctggccaagatggtgaaacccctgtctgtactaaaaatacaaaaattagccgggcgtggtggcaggcgcctgtaatcccagctacttgggaggctgaggtagagaactgcttgaacccaggagatggaagttgcagtgagccgagatcgcgccactgcaatccagcctgggcaacagggcaagactctgtctcaaagggaaaaaaaaaaggattcatccaagttttaggcctggtgcggtggctcatgcctgtaattccagcactttaggaggccaaggtgggcggatcacttgaggtcaggaggagttcaagaccagctgggccaaagtggtgaaacctcgtctctacttaaaatacaaataattagccaggtgtggtggtgcatgcctgtagtcccagctactcgtgaagctgaggcaagagaactgcttgaacccaggaggtggaggttgcagtgagccgagatcatgccactgcactccagcctgtgtggcagagtgagaatctgtctcaaaaaaaaaaaaagaatccatccaagttttaaaactgtttatttgaagatcagaaatgcaagtgtagactgttgggattttttttaattaataaaatgtgttcaagtatagcttgctgagtatccagaaatgtaaatatttagctatagcccaacaaacttaatcagctctattcactcatgagttagtgctacttattttgatcaagtatttaggttattatttaaataaacagctattgaatttttgtagtatttttggacactgcacaatttgtacacatcatcacaactctttagtaatccagttactagtgattttttgttattgtttagttgccattttatattaattgaaaagcactttaagaagtactgtcttttgaatcatgattgatatatgatgtctcagggacttttacatgaaaaaattttttccatgtgagcagtgttttaatgttgaaagatttgtattttgctaaatctccatgtgttttttatttcaactttctcggttaagggaggagtataaaagtcatagttttgatcctttattacagataaggaagactgcaaaatccacagccacactttcatgagtgatgccagattagctggtattcctttactgtaaatagatgtttgaaagctaaaaaccaaaacagtttaatagcctgaggcagtttttcagtgttttcaccaaattttttatttcttacaagacaggtggtaagactatatttgttcttgtgtactagttaattaattatactaatttacatatttgagggtgctgtgaggaaatgcatggtttgttgaaaagaactgaggactgacagccgcctcctccatgattaccctggctctctgtcccacccttctcatggcgcttgggggaccatggctgatcctgtcctgagacaaattaagactcctgtggtgaagcagttggtcgagaaaaagtgatgcatgaaaaagaagcaaaacaagaaggaaagaaaaaaaatgagagctgaagatggtgaaaatgatgccattaaaaagcaggcagaaagtctgcgagaatcccaggtgataagccttgtttgccagcacaggttggaagctgcatatactgttctttggcagattttagaaagtgaaaaggacttggaagaagctgaggaatataaagaacatttagtactggattcagtggagttagaagcctgaaacttttatgtacagggtgttttttgcattaaatcatggggtccagtttacatttcattatttttgaccactgctgtgtgttcaagtgtgagaacgtgattctttttatgtgattgtgtacatttctttgcctgatttaatttgtcaaatgaatgacaaaactgagaactaacagtagatactacaaggaacagaaacgtatgaagtctgtttacatatttgtattaaataatgttctcattaaagttatttgtacacataaaagaggtttttacttacacttacctgtatatgtgagatatttgaccaatgggtatttagtgtcctgctgtgcataataatacaaactcactatatagttgctttttttcctggtagtgggtttttttgtgtgtctgggaggaagggtgaggtgtaccattcatgccttttttactagtttattggcagtcacatgcattggcaagatgagcaaaggtgttgagcctgaggctgtagaacagagcacagtatatattatagatttatgttgcctagaaagagaatctttgtaaccatataatttattattcagtcctggccacctttgggagtgagagttctgttaacaattatactgaaacaacaaacaggtagaactaggacatgtggtgttcttagccgtaaaccctggtagtcctggatttaaatgacatgtttacttttccaggacttcagatttgtctgaagagtggagagaataatggttgtttcacgggattatgaagattgactatattgagatgatttatagtatgttgagataatatgtatgaaaataatgtagcacatggcctggtagttactgcttagtaaatgttccctatcaagtaaaaactcatagtttggatgaggtgtgagcttttcaaaatcataaagcaccatccttttctgttcttactgtgtctgtccttctgctcattatttcatacctttatttaatatagtgacttcaatttactagaatgttgtattagtaccttgtagaaataattgcagctgtctttgccatatgtagcatttacatttctaatatggacacagctggttttccagttcagctacagaaagtgaaggaaggggtaatataaggaagcactactggatatgagtcaccaatcatgttgttatccattatttggtgctgtagcattgaccgaacacgtttatatttttgtgtcatcaggaagggggagagtgttggtatcagaattatttaggtgtggtaacagtaatctgggtaattatttctaacttaatcacgagttctttctcttttcatatccctacttactgtgtgtatgattgggggtggggtgaaggtggggaaggtctggtgtaaggatctgaggatagatagaaattattgagccaggacaataatttagagagcataccctaggtagtttaggttaccactccttgttcagatattactgggatatgaatgttagtgatttatcttctattgttcttaaaattttttcctcatcttaaaatttaaaggactggaacttctccagagtttgaagtctagttcagtatgccgcatttactcagctcttacctttctaaactcttacattaatgtcatctcaagtactgattgctcatggtagccgacagttatggatcacttcagtgccaaactcttggattgttgatgaaaacccacacggcactttttacaagggaagaaactgatccttacagggattttaaggacttaccctagatcacttaaatccctatggtactctgaaagttttctcctatcatactcatcttaagacttaaaggactcatcaagttggggttagaggtggatccaggctgtcttgttgagctacccattttgcagtatggctcctagtgcatcagggactgataaacctgggattgctttttctgttatgagaggaaaactgtagtagtgaagtcagagcctgatatatacagactgtcagttgcagcattatttggaagcacagaagatggtatgtgaataaatgtgcctgatatagaatgtctttctccctctagcccccttttttgtgccttttttgatgcttgatttcaatgtcctttatgctgttccttggtaatagatagttgcagctcaatgctatattttagccattcatgaggccaaagatatgatgccttcagtacagaaaaggggaaatagggtatctgggagtacctttaaaagtaggaaaagtaggtttccttacttcaatttactttaaaatgactttatattgcattaatcattattgttctgggaggaatacctatatctacatatatcagaaggaatttaggaaggaggaaagtgataaatataatttaaaaaatttttttctttctaaaacaaatcatatgaaacaactcagcatagtggctggtcatatagtttgctctgaataaatacttggagaatggcaagccaggtaaccattcacttaacatttttagctactttataaaaagcaacccttattttgcatttcccatgtatcagacagtttaaatgcttttattttttaattcatttaatccccattgtgatcctaggagataaatgtcacaatgcccattttaagatgaggaaactgaggccacggaagttacttgctctgaattttacagctgtgaatggcagagctgggattccaacatggggaacatggctctagagggtgtgatcagaagcagtgcatctcatattctgatgacaatctggtttgtgtttgtttttaaagtttcatttcatttaattttttagagacagagtcttactctgtcacccaggctggaatgcagtggtgctatcatagctcaccgcagccttagaactcctggactcaagtgatgctcctattttggcctcctgggctcaagagattctcctgctttggcctcccaaggtgttgggattacagggatgagccaccatgcctggcctttttttaaaaatttctaatataatacttttgtaaaatgataaagatgaagacatgcatacaatatgtaagcctgaatttgattagtttcagcagatacaaaattgtcaaattgctacagattttcaaagtgtttactttgcatttctatacttaacctcactgtcaaccataaccagtttgtggaccagcagtagtagtctgtggactatactttgagttactggttcaaaccattattagtgccaagagggactactgattattccatacttcaaataaggtgttgggtgatttgtcttaacctggaaaaaaattttttggaagttcctgtgagtaagtagatatttgttgaatgaaggtaatggaggacacaaatggggtattctgaggggaaaggctcatcattatttctagaagtggtttatatgtatatttaggttgagagttgctgagaaatcttgaatgttcaaaactatggaaaagcacatcatggttttggaatttaagcaatgtagacttgaacatgatgaggagaacctaaagtttagtcagatttattgaaaacaccacagaatgatgctagatctgggaaatatttacctctataatattaggattgtcctgtaagattaatattatacctgtgctaatttttgcagaatgtagtaaaaagctacctgacattctttgcagccagttgttagacttttctcacccttgcttgctttttttcttcgctttcaactttctcttgttgctatgacagtttattcagccctgggtttgctaaattacaatactgaacatttttatttgaagctgataaactcagcaaatcttaaaccaggtttaatactttgctctcaaattggttatctttttctcttccctcacttgccatttgtatttaatctctttgaccttctagttaatggctttcattgcccccaagatgaaaggtacacttttagcctgacctttgaggcctttaacagtctcactccaacctaccattctagctctttggtttcatgaaccctctctttcagccacattggtcactacctggatgaacacagcaccatcccatggcctcgctcttactccctattctacccacctaaaattcgttacacgatgctttttcaagggaagattgcctattttagggtaaaaatgtgtttgactactttgagattagccataatctgctaaattagcctttacttttttgtccaagtagtttataaacctagaaatactggtcatttaattttttttccttttttttttttttaaattccctgatagaacctgagatcggtcatttaggatgtaatttccagtgaaatttgctcattgagagaacactagcctaagagagtagagagaggaatatggtaggattttgcagtagagttttgtttttaaactgaatgtaaacttaaaactatttagtgtctataggaagcaatcttaaaaataaggttagataccttaaaatagaacttgtttcttgaaatattttttagttcccatatagatcatacgaaaagatgactgtctatgcccaataaaaatttttatggtatttcacatcattcgttttaaaatctagtatgtttaaaagtgaagactaaagattttaaattagtatacttactgattcatacatacacacatatttaaaaatgtgtagctccttttttaagttgttggaaaagtacaaaatcatgtgtccttttttgttttgttttgagactgagttttgctcttgtcgcccaggctggagaacagtggcacgatctgtgctcactgcaatctctgcctcctgggttcaagcaattctcttgccttagcctccccagtagctgggattacaggcgcgtgctaccacgcccagctaatttttgcatttttagtagagatggggtttcaccatgtcggccaggctggtcttgaactcctgagctcaggtggtgcacttgccttgacctcccaaagtgctgggattacaggcgtgagccaccatgcccggccgattatgtgttcttgatatgaagactatagtaatcagttacttacagtgggacttttattttaattcaaaataacactttaaaattctaggaactgaatatgtttttcctgagtgataacttgcttttaattcctgtatgtccaaagacttgagagagagagagaaagaggattgtttctttttctttcttcccctttcttcactgggtctcacttgctgaggctgttttcgaactcctggactcaagcagtcctctcgccttggcctctcaaagtgctgcaattacagacataagtccctgcacccgttctgcttacgtttcacaaatactgggcagttgcaagttttggcttagctgttcttctctgttaggccaaccagagttacgctctgaaagtgccagtttaggagttagccaaaaacctgtgagggatttttacatatattgaggagcccacttctcatctacagcagtttttctctggtaccctgtcccccaaagcctacctgcctgccagtctctcattgttttcatcgagactcccactgtctgcctggaaacccatcattaattttaagctagtgggataggaaatgtcattcagtaattatctgtttgaacacttaaatttactggtaagtaaatgttgataaaaatgtttggttttaaggcattacttactgtatgtcaattttcaggccttaatcattctgtgtaaacatttaaatttattcagttaagtaatcaagttaataagttcctgttgggttaagtactgtgattattgagtaaaatcaagacatggtctccgttctgggtgactttataggctaatagaaattcttgtacatgtcatatgttgataagaaaaaacatatcccttgggaggccaaggtgggaggattgcttgagctcaggagtttgagaccagcctggccaacatggtgagaccttgtctctactaaaaataaaaaagaattagccaggtatcatggtgcctatctgtagtcccagttaccgtggaagctgaggcaagaagattgcttgagccagggagattgaggctgcagtgagctatgagtgagaccccatctctaagaaaaataaaatacaaaaaaaaaaaaaacccatattctttcaaataaatatttaccacctttctgctctgcattcttttagacaataaatatttgacttacatatcttgttatgttaacatagatctctgttgtttgctgcttcagtctgatatccaaacacttgttgcattgccctttttttggtatcagtctttgtcctagtgcctttctttggctctcttcttttgttgacaacaatttatgatagtatgaagagctacatggaagaatgtggtgaacacctattttaaattactgcccccagactacttttctttctgatatttttagatgacagtgttaattttgtctagcctaaaagaagatttaagttcaagccaatgtccatcttgttaggttccattgaaaatattaagttgccgaacttttaggttacgatagggtaaacagtatgccatgaaggtaagacctgcgcatcattggcttgatcactttacaaagcttttttgtcatcataatgttgttttgttttgttttgtttgtttttgagacagggtcttgccgtgttgcccaggctggtctcaaactcctgggctcaagcaatcctcctattaatcctcctattaatctcccgagtagctgggattgtagagacgcaccacagtgcccagtgatacagttgttatactcttgaaactttagtttccatcctgtatccttcctgatacccccttcagtaccatatgcagtatcttaatatgatggtatgttaagaaagatagaagattttcccaactttgttgcatagtctgtgacagtcttcctgctatttaaaaaaaaaagtgcaagtggaaggataactataaatactgttatattttcaaatttgagaaaccgtttgctctttgctcttaatgaagagatatgagaatagagaatggttctttagagtttggtctgtggtctgttttatgaagcaatctgctttaattccttcttcttaaaaaatactactagtgccgggtgtggtggctcacgcctgtaatcccagcactttgggaggccaaggcaggtgaatcacaaggtcaggagttcaagaccagcctgaccaacggggtgaaaccccgtctctactaaaaatacaaaaattagccaggcatggtggcacacatctgtaatcccagctacttaggaggctgaggcaggagaactgcttgaacctgggaggaggaggaggttgcagtgagccaagatcgcacgactgcactccagcctgggcaacagagagagactctgtctcaaaaaaaaaaaattatcagcatatcagttcaggtttagttagaatattgctgtcatagatgtgttaagacatttaaaataatgttttatattattttccactaggaaaccacccctactcctaatcccccgactacagaagaggagaaaacggaatctaatcaggaggttgctaacccagaacactatattaaacatcccctacagaacaggtaagctttctaacacctaggttttctgagttaggccacaaggtaaattgtgaatggggcaagtttgaagggaaagttagattatgagactagttttagatatgctaaggttgagggttctattttcacttggatgacccatgaccagcagacagttttatgtgtgagtcttgagttcaaaaggagctatgtgagagattagtttgaaaagtattggtcataatggaagccacattagtaaataagttcccttaaggagaagtgaacttgactcaggacaaagaccggggatactagcatcatataggaggcttttgttgaagaagaatgcctatgaaggatggacatacaaagacagtggtggtcgcccaacgcggtggctcacgcctgtaaacccagcacttcaggaggcggaggcggaggcggaggcgggcggatcacctgaggtcaggagtttgagaccaacctggccaacatggtgaaaccccgtctctactaaaaaatacaaaaattagctgggtatggtggcagacgcctgtaatcccagctgctcgggaggctgaggtgagataattgcttgaacccaggaggtgcaggttgcagtgaactgagatcgcgccattgcctgccagcctgggcaacaagagcgaaactccatctcaaaaaaaaaaaaaagagacagtggtggtcatggaaaccaagaaggtggtttattctaagatagggtggtttacagcacatgtgctaaaaaggtcaaatgaagcaagatgtcaaaatatccattggattgaacacttttaaaaaagtccgtgctgacttgggaaaaagttttttagtaaggttccatagagtagttccataaaacatggaaaaagagattagggcagtttgaagagtgaataggagatatacagatgtatagagtaagaacaggtgacttgaagttggactgagaatgagaaacgagagccagggaatgtggagtttgaaggttggttggtttgtaagtgagagactagaaaaggggacagattaaaattagttaagttttcatagttaatagtgtaacaggaaattgagtattagttcattatatggcttttcccaactcttcccactcctttccagtaggtttgtttttatttattttctggggtatatgagaattaacttgagttcactgaatgctgatggtgggaagaaaatggcagttcagaaacattgtaacaatctagaggaaagtaaattggaattaacttctgaggttcttgaagtatttcagttcatttcttgtctttttttgtttttatttactttttttagggcagaccattcactctctacttaaaagagtccacaagtctatttataattgtttcatttattaaaatttttttatgatctcaatttttttaaatgtttcctttattcatcatggaagacctactgaaataaatagttcaaatatgctgtatgcagttttctcataggagaccctttggttcagtatatcctccagtgaggaacaaatcagttttttagacaatggagattctcagctagtgggacatcagaggtcaaacagtctataaaggataaaatccttcctcagggaagcaatgtaccacatgtattaggttgaacaattcgttagaggcagtcttatatagtttaacctaatagtagcaccaaaacccacatttttttttcatttttttcagtgatatgaaacaaactgtatatcttctagctgtctgtgaacctagttcttggtgtcacttttattgtggggagaagtaaacaaggcatatatccctcacagcttgaatggagtctaagaagggattcttaagtgtcctcatcagtttaaaaaaaaaaaaaaagtttaaatcttaaaatgaagtctctggggacttcagtttctctataaattctactttttgtgtaaaatagcaagtatcatttggaaaaatactatgttttatggctccaattttggcagttttctcattatttacttcttgcattttactttcttcactccccagagtagtcaatgttaaatttggtttgtattccagaagtattaaatgcacatatgtatactttttaatacatacgtctatacagttgacttttctgtttgtatgtgcatattttacctcattgttttaaaccaccgtcttgcattatattgatataccaccatatattttattaggtttacattaatggctgtatagatttttctttttacacacagtgctgtaatttacatccttacataattgtgcacttgtgtgaatatatagggtaaaatttcagatctcctagaacaaagattaccctttaacaacctttgcgcagatactgccacattattctgttttattggcttagacttaacagtttgagagttcctggtttctatatccttgctaactcatgtgattagtcttttaagttgttgccaatcagattggtcccagtctgatttgggaaaacaatttcagtattttcaatttgcattttaaaattgaagtttcaaaatattttcatattgatgatttgtggtttttatctgaggacagattattcagttcttctattttttttcttttggattatcttttttttcccctactttcaagctaacaagttatggaatatcttttcaagtttatttccaagcattttatattagagtgctaactcacccaaggcagggaagttggaggagtattaagtcagaaagaaacaggttatccatatcatttgtcttctaacattgtctgtggaattgtatggtttttttttttttagaggtctttaattttcatgtaggcaaatactgcttttcctcagtggtttctgggtttcatatcaattttaggaaaactttaccacacagttaagcttttttttttaaactttttaatagttgcatagtagtcacttgcgtggatgtatgatattttatttaaatcagcagtactcaagtatttggtctcacaattcctttacactcttaaaaattattggtgactctacagagctttatgtggatttttatctattgttatttactatatttttacagtaaataatgctaagatgttattttatttttcacatttaaaaatgtataatttcacctgaaaaacttgagaaatgtaaaattattcgtttagaaaatctatcacatgttaacctaagtgacattttgtaatgaaaataattatttgaaataaaaaatatataatgggaagaacagcatttttgccatctgtttttttttttttcggagtctcgccctgtcgcccaggctggacctccacctcccgggttcaagcgattcttctgcctcagcctccctagtagccggaaccacaggtgtgtgccaccatgcccggctaatttttgtagtttctaatagagacggggtttcaccatgttggccaggctgatcttgaactcctgacctcatgatccacccacctcggcctcgcaaagtgctgggattacaggcatgagccaccgcacctggccgcatttttgccgtcttagaagtcaactggattttcatagctgtttctgccttcagtctatggagttaagatgtttcattggaagtataagaagacaatacagcctcacacaggtatttggttggaaaagggagaatagtttttaaaagcctttaaaaataattgttgatatgctcctttgatacactactaggtttcttttttcccccccctttttcgtaggacacatgctcaaagagatactaggtttcttagaggctagttgcaatgtggaatctgaaaccatatccaagaatttttttctactttgttacattaaaatccattggtctgtcagtgtcttgcatctggaatggatctcttacctgtgtaagatttttaacatcatacactgcttatttggaaaataatggttcagtgagttatgcagatcttccaatgttgacacattttcttatatagtatcaaacaataataattcattaatattacctctaaactcattaagcgtctttgatttttaggaagttgtcaggcttacagtggcagatgaaatctttctaaaattctgatttttctactgaaagcttaaattttaagcaacaatcttaagttcagacaattgcctaaatattgtattttgttttacagtagtggaagtggtttttgtgcagattatgaaaaatatggaaatagaatgaaatttaatgaaactggtaatgtttattgcctcatcaaagtcattcctttttttttgttctcaagacggagtttcactttgttgcctaggctggagtgcaatggtgcgatcttggctcactgcaacctccgcctcctgggttcattctcatgcgtctgcctcccaagtagctgggattgcaggcacctgccaccatgcccatctaatttttgtatttttagtagagacagggtttcaccatgatggccaagctggtcttgaactcctgacctcaggtgatccacccacctcagcctcccaaagtgctagaattacaggtgtgagccaccatgcctggcccaaaggcattcttatatgaaactcacattattagtactgtgagagttggtagtaataaatgtacagtgactactcgtatagttttgtgtcactgtcttggttcttgctaaggcaccagcagatttaactactgttgcttttgcaccgttagtgcaaatgtgaatactgaaaagcaaagtgccttcttagcattattatgaaaatggatcttagggcctcctgcctgtctgcagaccacattttgagaactgctgatttaaataattccttgttgataagcacttaagatgttttcaaattttccaaaactaaaaacgtcatttgtttgtttttgaagacagggtctcactctgtcacccaggctggggtggcgtgtaatctcggctcactgcagccttcaccttccgtacccaagccatctttccaccccagctggggccccacaggcatgcaccaccaccattttagtattttttgtagagttggagttttgctatttcccaggctggccttgaactcgtagactcaagcaattcatccacctcggcctcgcaaaatactgggattacaggcatgaaccaacatgcctggctttttttttttttttttttttttttttttggaagagacatggtcccattctgtcgcccagactggggagcagtggcatgataatagctcactgcagcctcaaatttctgggctcaaatgaccttcccacatcagctttctaagtagctaggtccacaggtgtgcaccaccatggctagctaaggtgttttttttttttttttttttttttgagagatgcggggtcttgctatgttgctcaggctgttctcaaactcctgacctcaagcagtcctttccccttccccttccattccctgtccctgtccccatccctgtcccattccttgacagggtcttgctctatcactcacgttggcgtgcagtggcatgatcatagctcactgcaacctcgaactctttggctcaagcaatcctcctgccttggcctccagagtggcagggactatagacacatgccatcatgcctagcttattttattttattttattttattttattggagatggagcctcgctctgtcaccaggctggagtgcagtggtgcgatctcggctcactgcaacctccgcctcccaggttcaagcgattctcctgcctcagcctcctgagtagctgggactacaggcgcgtgccaccacgcctagccaatttttgtatttttagtagagacggggtttcaccgtgttggccaggatggtctcgatctcttgacctcatgatccacccaccttggcctcccaaagtgctgggattacgggcgtgagccactgcgcccagcccatgcctggctaattttttaaatgtctagtagagatgaggtctcactttgttgtccaggctagtcttgagctcctgggctcaagtgatcctcctgcctcagcctcctaaaatgctgttattactggtatgatccacctttcctggccccatagatctttatgtgtttaaatggctgggtgcagaggtttttgttttgaaaaaagattgaattatttttaaaaatccagcatgtatacttgacctcgttggtggttttcttgccttttcttcttcttttttattgataatggggtggcagttgctgacaaattatcaagtacatgttgaaatgcatctcatttttctgtctaggtgaagttaccaagcattaattataggattatgaaatatatattcaatttggaaggctcttcagacaacattcgtgttgatgagaaaatgaaatttccctttgactgccctttggtattgtaattcagagaatattcagtttaattcttctaaaggagaatcatcttgggataataacatttaagtgtaactttaatgttccacgagtttatcttcaaggcattagagaaaatattatacaggcgtacctcattttactgtgcttcacaaatcatgccttttctataaattgaaggtttgtggaaatcctgtgtcaagcagttctgttgatgccatgtttccaatggcatgtgctcacttggtgtctctgtgtcacatttcggtaattctcacgatatttcaaacttttattgtatctgttatgatctgtgatcagtgatctttgatgttgctattataattgttttggggtgccatgaacattggcgatataagatggcaaacttaattgataaatgttgtatgtgttctgactgctccactgactggccattcccatcttcttgtccttgggcctgcctattccctgagacacaacaatgttgaaattaagccaattaatagccctacagtggcctctacatgttatagtgaaaggaagagttgcatgtctctcactttaaatcaaaagcttgaaatgattacgcttacgaggaagacatgtcaaaagccaacacaggccaaaagctaggtctgttgtaccaaataagttagccaggttgtgaaagcaaaggaaaaattcttgaaggagatcgaaagtcctcctccagcaaacacatgaatgataagaaaacaaaacagccttattgctgatatagagtaagttcaagtggtctgggtagtaaataaaaccagctacaacattcccttatgacaaagcctaatccatagcaaggccctaactctgttcagtgttatgaaggctgagagaggtggggatgctgcagaataaaagttgaaagctggcagaggtcagttataaggtataaggaaagtcacccccataaaagtacaaggtgaagcagcaagggctgatatagaaattgcagcaaaatctccagatctagctgaggtaattgatgaaggaagtttacactaaaaacagattttcagtgtaaacgaaacagccttctactggaagaagatgccatcttctaggactttgctagttagagagaagtcattgcctagcttcaaagctacaaaggacaggctgactcttgttaggggatcttgcagccaatgactttaagttgaagccagtgctcatttgccattcccaaaatcttaagaatcctgaagaatgatgctaaatccactctgcccatgctctagaaatggagcaacaaagcctggatgacagtgcatcgatttatagcatggtttactgaatactttaagcctactgttgaaacctactgcccagaaaaaaagtttcctttcaaaatatcactgctccttgatgatgcgcctagtcgcccaagagctctgacagagatgaattgttttcatgcctcttaacacagtgtactttctgcagcgtatggagcagcaaagaggaattttgactttcaagccttattatttattaataagaactatatttcatgaggctaaatgctgtagatagtgattcctttgatggatctggacaaagtaaatggaaaaccttccgaaaggattgagcattctggatgtcattaagaacattcatgattcatgggaggtcagaatatcaacatgaacaagagttaggaagaatttgattccaacccgtattgatgactttgaagcgttcaagactttagtggaagaagtaactgcagatgtgcagagagcaagagaccaacagtaagaaatggagcctgaagatgttactgaattgttgcagtctcatgagaaaacttgaatggataaggtgttgcttcttatgggtgagcagaaaaaaaggtttcttgagatggaatctattcctggtgaagatgctgtgaacattgttgaagtgacaacaaaggatttgaatattacataaaccaaattgataaagcaactgcagggtttgggaggattgactccaattttgaaagaaattctactatgtaaaatgcttacaaacagcattgcatgctacagagaaatcttttgtgaaatgaagagtcaatcagtgtgacagacttcgttgttgtcttaagaaattgccacagccaccccaatcttcagcaaccactactctgatcagtcagcagcaaacaagggaagaccctccatcagcaagattaccactctttgtaggctcagatgatcgttagcatttttagcaatagaatttttaattaaggtatgtacatttttttttagatgtaatgctatttcagacataatgtagactacagtatagtgtaaacgtaacttttacatgcaccgggaaaccaaaaaatttgtgtgactctccttaaagatagttcctttattgtgatactcactttattatgatgatctggaactggactcacaatatatccaaggtatgcctctatatataatatgttaggtatatataagctattatgtattatgtaggaataaaactattttaagagaagtatatacagatatattaaaactggtatacattatttcagaacatatctatgcagcattactcaatctttattattttcccagttaggtatttgattaaatatagaatcacatttaatagtttccccactcctggcactctcatttcttcttggctaatttgttcctctgagaaatatcagccaacctgtttctcgccttctttttttttttttttttttgagacagagtttccctctgttgccctggctggagtgctgtggcacaatctcggctcacagcaacctccaccacttggattcaagtgattctcgtgcttcagcttcccgagtagctgtaattacaggcacataccaccaggcctggctaaatttttttgtatttttagtagaaaccaggtttcaccatgttggccaggctggtctcgaactcctgacctcacgtgatccgcccacctcagcctcccaaagtgttgagattacaggcttgagccaccgcgcctggccccttgtcttattttatagtttaagtgtctgctgtgttttttttgttttttttttttgtttgtttttttgttttttgagatggaatttcgctcttgttgcccaggctggagtgcagtggcgtgatctcagctcaccgtagcctcctgcttcagcctcccaagtagctgggaatacaggcatgcaccaccatgcctggctagttttgtatttttcctagagacggagtttctccatgttgatcaggctggtctcgaattcccaacctcaggtgatccgcccacctcagcctcccagagtgctgggattacaggcgtgaaccaccgcgcccagctctgctgtgtttttcttaaataactgtgcttgcttatctctgtcagagcacttagcacactgtagttgtctctctgcgtcatttctgtgaattccgttgagtgatgagtttcagtgtgtcttgggtctctaggtatagcagggaatctgttatgtagtagacataacatacatatcttttaaatgaaagaaatggagaactctcattatttgccactgtaataacaactagcattttgcttttttccctaaatttttgtggtaaacataaacatttacagtattaactatttttaagtgtacagttaatgttaagtactttctgcaaccaattattgtgcaactaatctccagaactcttgttcatcttccaaaactctgtaaactctataaccctaaactcccttctctttggctagtggcaatcaccattctttttgtttctatgaatttgacttcttatacctcatataagtggaatcatacagtatttgtcttttttggaggggggctggcttattcacttaatgtccttagcttcccctcatgttttatgaagtgttagaatttccttcatcagggctttttagtattccattgtgtgtatatatacatttttcattcatctgttgatggacaggtgggttgcttctaccttttgacttttgtgaataatgttgcttttaacatgggtatgcagctaccattttttgacactgattttttatttttagatgggcactctggttttttaaaaatgataaaagcaaaacttggcaagcaaacctgcggctgatctccaagtttgatactgttgaagacttttgggcgtaagtaaccatttgttttagtatgtttgttgttttattcgttgtgtagtttttttatttttaagtcgaattcacaaaatgaagtgtgagttaaacagttaatgaatgttcatctatttttttatctcctcacaaaagtttgaattggtgattatgctttattagttttacagagcttcaatcttgtcatcccccagccccaattattgtttcttgtcctgagatatccttagctcaagaatccattattgcccttagaacttttgacagctagttggaacttgttccactcctggttgccaagatacatttgcctcataactgggtattgcagtgcgttgttgggtcctcatttctgcaaactgttttcagtgcaatatctggaatttcctgtaccagagattttaagatatcaaaggctgaagtgttcagaattcacggtttgtcaaggcaatgccagtatctatcatgatactttattcatttcattatactttgatcaacctcaagaagaatagttgaaatatttttgaaattttgtttctgtatagcagaaagttaagaattgggatcatcaacttttgcatgaccttaaaacaaaatttaaggctgggctcagtgactcatgcctgtaatactaatactttgggatgctgaggcaggaagatcacttgcagccaggagttcaagaccaacctggtcaacatgagtccctgtttctctataaaataaataaaaattgtaaagtctatttcaagaagttttgataattgattctcttaaaaacaaagttaatccagtgtgtctaatttacttggagaatgactagggaggtactatttgagaccatgaaaggcaaaactctttaataagcactttaaattacctagcagttatctaaatattctaacttgtacatctttttttaggatcatatacatgctgaattagtgatgctactcttatgttttaatgtaaccccctcaagatattctgctcatacaaagaaatagattgtggtataaaatttatacatatgtatgtacatcttcaacagcagaaacaatatttttctgtatatttccagtgcttggcttctaatagatattttgtattcatttgtgttgctgaaaaaagcaaagcatacgattaaaaccataaactttgagagtatttgagaacattcatttgagagtaaactttgagagtatttattttttattaaaagcattgacacttaataataactacatttaaggcctaataatttataggtctagttttctagttaaactaggattattattctttgcccatcatcaaaacatcaagtagtttttcttctctagttttgtttattcaggactcttaaataactccagtcttctgcaccccccaaaaaaaagcttttcattctcctacagagaaaaaggaagccttgagccaccttccccaatcagatttgcatttatctagtttgtttggcttttaccagtttacataattctaccttctaattagaacagttctccatgcttcagttacatgtagtcaatgtcattacatagtaggtttttataccataacttagagatatgaaggatttttcagttttctataaatgtgtgggccacttcctaatttctgtttttttctagcaaatttattgcagataaccattgagtccttttgtatttatccagactgcatagtcttaggattctgtttagatgtgccattataaattctcatgatggacttacttgagagacctttgagcaccacagaagagaaaggaggcagcaaaagggaaaaagtattttattgaaggtcattcccacaatatccattcattttatgacattagtagcgctaattttatagtcacttagtatcccgtctttttttgttgcctagtggaggctgtcattgatgatgtagttgggagttaccattaggtagtgactcagcaaaccttatgtggtcttaggttgtctcacctaaactatatttgtgtgttatactatggaatttgatttaaagatgccaacttctttcttaaatcttttttttttttttgagatggagtctagctctgtcaccaggctgaagtgcaatggggtgatctcggctcactgcaacctccgcctcctgggttcaagcgattttcctgcctcagcctccctagtagctgggattacaggcgcatgccaccacgcccggctaatttttgtatttttagtagagacagggtttcatcatgttggtcaggctggtctcgaactcctgacctcatgatccacctgcctcggcctcccaaagtgctgggattacaggcgtgagccactgcacccggcccttaaatctttacctgaaatattcctagatggggttaacatagcaccaggagaaccagactaaggatagtagaatcatccatggtctgtagacacagctaagatcattatttctgccatctaatattggagacaagcaaaagattcttaagagttgccaatttttaaatcaattttgctgtaaaagactacaggagatcaaatgatctaagcctcctaccttcaggcaagcaactaagtcatcgcaaatgttattctgttattttgatacttgggaaatagtttagaaatacagactgcagggttccatcttatatttaggtgattataatcccaagatgtagggcttgtaactatatttatttatttatttttctaaaatcagttttaaaatgattattatgttgactaaccagtgacagtttgtggtgtttgggaaccgttgatctattctactcttggataccttcaaggataatgactgtttcagtcatgcaatcctgatggtcaggaagttcatcgtttctggtttttgtttttgtttttgtttttgtttttttatgtttgtgaaaaaaactgtgtattaacttcagaaattatttcatctacttaaagccaccttatacctctcttctcagtttcttatatatatacatatgtatgcactgagttaactaacataaaatatatttttgtcagagcagtcactagaagtttttttgaaaattatacctgtcatctgaagttgattatttaactgcttttaagatctgttttgtccattttagaaattgactccttagaaacaagtaaacatgaacttttatctgtttattttcatcatatgttctaaatgtatatatatgtaagcacctaaactctatattacatattctgtgtttttaattgttattttcttttacctagtctgtacaaccatatccagttgtctagtaatttaatgcctggctgtgactactcactttttaaggtatgcttaattggtgattttatatatttattataggactgggccatttggtattcattaagaaatcttaccataaacttaggaatatttgatagtgtgatgaataggctgataatttaattggctgtagtatgctttagtatcaatatatcttattctatttgtttataaaaattgagagagagttactctgtgggcacatactgagattgattttgatgagagctttgattatccagtctactccttcctttatatatttgagcagactgagtttatcaagcattcttaaccttaggagcatgggtccttggaatacttattattgggctttgtcagttggtagagggacgggacattcattaactgaaattgcatagtttttgcatgtattttctagctgtagaaatgtacagagcttctaaaatatgtttgcttctcagaaagtttaagaaccttcaaattaagtgaaacccaagatttgatagctaataagtgacaaagccaggactctaattctgcaatgtcatgcctctggctttaagtcttatgtgctgtttaaaaactacatcaatggcagttttatgggcaataaagtaagaagttgacagtgttgttgcttaactgtttctaatgattatctctcaaagtcaaggtaacaatgttgtgtaatactgttgtcttctaaccctgtaggatggtattgagcctatgtgggaagatgagaaaaacaaacggggaggacgatggctaattacattgaacaaacagcagagacgaagtgacctcgatcgcttttggctagagacagtaaggttttaaaagtataaagcagttttagaggtagttttggaatactgatacttaagatatgttatgttttacatttgttacttaatttaagagaaggatgcccaacactagaaaatcagggtcagtaattatttttgttctgtcatatgactcctgtttatagtacagtgaaacatcctaccacattataagtcagatattttaagtgattggcagttgactctcaccacagtaagctcactgtggtcatttcattaacctcaaaattatagaaccttacattttgtatgattgaagtttttgcaaccctcttacagcattgctatatgtatactaaacttttaaatacttatatttttagagcgagggtcttgctctgttgcccaggctggagtgcggatatttatttatatggctcatttcagcctcaccctctgggttcaagtgatcctcccacttcagcctcttaagtagctgggactacaggtgcatgccaccatgcccagctaattttctaatttttttccagagatgggatcttgctatgttgcccaggttggtctcaaacttctggcctcaagtgatcctcccacttcagcctcccaaagtgctggaattacaggtgtgagtcactgtgcctgtcccactaaactttttagattagtgaagcaaataataaaattgttgtgtactaccatttgacctacatgttgtgatattaactggaacttctggctttacaagacaaattaaatatgagataataagcattttctgtagacagaggttccaaaccccaagcttataggagcggggtttgtagtctcttttgtatccctagcacttgaaaccgtgcctggtttatagttagcacttgttaagttaatcactttaaatgtttgaataagtgactattttgcttttttttagagacagggtcttgttctgtcgcccaggctagagtgcagtggggccatcatagctcactgtagcctcctgggttcaagcaatcatcctgccttagcctctcaagtagctgggactacaggtgcatgccagcacagccagctaatgaatgaatgactttttaagaagaaaattctgtttttgagggggaagatcatgagcaaataccatttttgaattccacattaaaaagtcaggacatttccattttgcagttaaaaaaaatcttctggagatggatggtagtagggatggttgtacaacaatgttgaatgtacttaacaccactgaactgtacacttaaaggtggttaaaatggtaaattttatgttatttgtattttaccacaattaagaaatctgttagggctgggctcacacctgtgatctcaacacttcaggaggctgaggcaggcatttcacttaaactcaggagttcaagaccagtttgggcaacatggcaaaaccctgtctctacaaaaaatacaaaaattaactgggtatggtgacatgtccctgtatgtatgcccacctactcaggaggctgaggtggaaggatcatttgagcccaggaggttgaggctgcagtgagctgtgatgatcccactgcactccagccagggtgacagagcaagaccctgtctcaaacaacaacaacaacaaaaaaccagaccattaacaaatattcataaaaaataagaacaagaggagattaaccatgaatagctatttttattattctattaatatttgtttgctcataaatataagcagcagcagagcaaatgaatattaataaaatcagcttttatgtctgccatgacattaactgccaaatttgctgaaaaaggctgatttgatagtaaataaatgaatgagtatttaaaagtcaggacagatcaatatatgcaaataaaatttacacatttaaaaaattaactcttgatttaaaaactgcctttagtttctatgcaaatacagaagagacatttgcagtgtaatgagcttgtttataatctattaaatgtaatttgggatttttttttaagcttctgtgccttattggagaatcttttgatgactacagtgatgatgtatgtggcgctgttgttaatgttagagctaaaggtgataagatagcaatatggactactgaatgtgaaaacagagaagctgttacacatatagggtaagttttgctctttgcctacttattttacagtattaagatgagtaaaaccagaagttattttatttgtagctttagaaatacttcagtttgtagatcctgttttccttgtattgttttcgtgaacacttttataattttgaacggctcaattggtgcgcaacgtcttgtttttttgggttttttcacagctatttatttatttatttatttagagatagagtctcactctgttgtccaggctatatatagtacagtggcatgatctaggctcactgcaacctccgcctcccgggttcaggagattgttatgtctcagcctcccgagtagctgggaatacaggcgcatgccaccatgcttgggtaatttttatatttttagtagagaccaggttttgccacgttggccaggctggtcttttaacttttggtctcaagtgatccgtccacctcagcctcccaaagtgctatcattacaggcatgagccactgcgcctggcctttttcatatgttttttatttctgtaaaattgctttttcttagcagtgaagtatataaccactagagcactctcctttggcatgtagcattttttattcattcacaaatgagaatgtattatttcctactttgaaagtgctgtttggaaaaaagtactactttgaaaagagctaatgtatgctcataataataattcagtgattattggcaaatagtatatgtgcatttaaagcatgtgtgtttactacgtataattttcattaaaatttatataacatatcttggtttttgttccatgtttaaaacccacatatgtagggttttattaaacctttttttgtaaattttattctttgcaaaagtggctttttttttttttttgagacagggtctcactgtgttattcaggcaagagtgcagtggtgcagtcatggctcacttcagcctcaacctcctgggctcaggtgatactcctacctcagccacccaattagctgcaactacaggtgtgtatgaccacacctggctattttcttgtattttttgtagagaagaggttttgccatgttgcccagactggtcatgaactcctggacttgatcaagccacctcagcctttcaaagtgctgagattacaggcgtgagccaccatgctaaaccagctgacattttttttctaagatttctttttacctcaattatattagtaatatttgacaccaggcgcagtggctcacacctgtaatcgcagcactttgggaggctgaggcaggtggatcacaaggtcaggagattgagaccatcctggccaacacggtgaaaccccgtctctactaaaaatacaaaaaaaacaattagctgggcgtggtggcgggcgcctgtagttccagctacttgggagactgaggcaggagaatggcatgaacccgggaggcggagcttgcagtgagccaagattgggccactgcgctccagcctgggagacagagcgagactgtctcacaaaaaaaaaaaaaaaaaaaaaaatttgacttacaattttatgttaaaattaagtgctggtcagtcagtggtcaaaatgtttggtttgcccctttgtgatttttcaaatattattaatttttctttttaaaattaattaattttttgagacagagtcacactctgttgcccaggctggggtgcagtagcgcgatgtcagctcactgcaacctccacctcttgggttcaagtgattctcttgcctcagcctcctgaatagctgggaccacaggcctgaaccactgcagtagtttttgtagagacagggtttcgccatgttggccaggctggtgtcaaactcctagcctcaagtcatccacctgcctcagcctcccaaagtgctgggatttcaggcgtgatccattgctctcagccatgtaaatttttatgtgaacataatttatttctggatcaaaaggtatagggattttctacatttcatgctatatggggttccataagagaaaagagttgatttgtcatcatattttaatgtttcttccagcatcaaaacctaattttggaggatttactttttttttttttaaatgagttaaattaagaatttttttcctacggaagttttgtatttttgtcaatattaaatgtttttgagtgtatattaagacttcagattttcaaacgaagattttcttttttaaccttccaatttgcatgactcaatggtcttgctttttgacatttttaataattaagtataattgaaaggaatgcattgcattataatgcaaatttgataattaacactttagttaccataaaattactttttaataccttattttagggggaaggtagtaaatcttctggaaggtataaaaaaaacctatcctagtatcatgttggaggatttaactccattaatatctttattcctttatttttatttgatttttgcttatttttgaatttttactatttttttcctaaagattcttttttcttttttttttttttttttgagacggagtcttgctctgtcacccaggctggagtgcagtggcacagtctcactcaagctcactgcaagctctgcctcccaggttcacgccattctcctgcctcagcctcccgagttgctgggactacaggcacctgccaccacacccggctaattttttgtatttttagtagaggcggggtttcaccatgttagccaggatggtctcgatctcctgacctcgtgatccgcccgcctcggcctcccaaagtgctgggattacaggcgtgagccaccgcgcccagccaaagattcaaatttttaagatgacctatgaagctctctgtgatcttcctctgaaaccttgtcagctttatctcatgttcactttacttacaagccatagccacacagcctaatttttatttctcagctttcaaatgtgctcattctcttaacattatccttttgacctcgtgatatttaaaggggaagacttctctaatgttgtagatgagattagaatctccttgttatacagtatcacagcccttatgtttactctttggcactcatgacaagtgccattttattcttgcaatagagtcatgtcttacttgaaaattaggttgtaaagttagtatgtaaagcagaaattacattctccctcgaagtgtttcattcactccctcgaagtgtttaatctccctcaaagtgtttagtttttgtttgtgcagtcttataacaggtatggttaatataatttgtgtagtaatatacaatatttgctagggttcagacgtgaaatgtaacattttagatcaaagaatgaaacatgtttgttttacagatttctgtttttaagtatgcatgtgatacaggtctgtcatgtatttgtgattatttgattatgttttctctactagactataaatgcagtcagctcagggactgtccttactttgttcactgttgatttagtaataattatagtatcataataaataacaatataataatatagtaatgctcctgtaatttagtaataacatacctgactcgctctcaaatattttaaaagtaattaaccaagaatatcgcaaaaatgaagagtaaattgtgctgaaaggaaaagggtgtataattaatttcctattttattctcaagtctatgttttttaatataaagactaataaccctaaatttttaaatgtatttcttgtgagtaaaagttaatgactacttttttcttcttctttttttttttcttctaggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtctttt

SEQ ID NO: 35875 - DNA, 90160 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcttctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggcctactatgttggataatgaacgggtattgaagtatgggtggggtcactgggagggactagggagtggttaaagaaaaatctgcttccacaggaagccccaggagccagtttcgaggccggtgcagaccccaggagcaaacccctctgagcacaggggagtctgctgtgctggatggggaggcagggctgtggccccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcaaagttacattgctcctaagcaaaactatattgaaaactgagtgggtggccgttgatgacattactgggacttctgaggtttttgttgggctaaagataatggaagagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatgtaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcacacttcattttatttctaaagcattcaggactcagcaaattgcactgactttatcatcagtgccttttgtgatttcctatcctagaacttaatacgtccccgatgagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaacacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggcgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatccctaatgctaaatgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaactactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaattacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagccggcccggcggtgcaccagggtgctctgtttctaactggggctgcagaaaacccatcattcatcagagcccagggcaacagatggaagagagcagtcgcaggactatggcctgttcgagcaacaggcaaggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctgatgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatgttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggtgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaagggaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagccggacagactctcctctgctatcaatcttcaggtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagggagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacccaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgaggttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatcatctatctaactgtctatcatccatccttttgctgctggttcaaagaatgaatcagatacaaagtcttcttggaagtctaaaaaggacgtagaaagcatgggattttgagagattttgcataatgagagtcaaaaactgatcattccctttgccctgttttctcttttaggttcatatttggtgcttagacaaattcaaaatgaggaaacatcggcacttgcccttagtggccgtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttctaggatttataggccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaagaatttgatttcagagttttagaaaagtgggaaatgcttcatgcattgcaagctggaaaggactcaggtgggtctccctctccttgacccagagagcttggcctctgagggattcttcctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaatgagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaacgccaccaagctacgccctgccctgctgttcttgggagatgagcttggcaactgctggccttaaagcaacagctaggatggcgggtgggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagcgagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtaatgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccactgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatgctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaatgaactgcactcctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctcagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggactatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaagataaatattgtaataagatactgctttacccattgtatcaattacaattgatcaagggaggttttcctttgataaaggagtgaaaataatttaaaaataaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtacaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcggagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgagcacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgcggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatgaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttataatgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtgcatcttcatgcaatggtaaaatggtttctaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacattgcggtgccatagggcctgtcatctgtgtttcctattgtctcattacaacagattgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggtagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttccgtttcctcccattaacccacttgtgacttgcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggccgggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgttgctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgcctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctgcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctatttctccaagaaaatgcaagtaaacccaaagagagctgtccccggccacgtcatcccgtggttccttgggtggcctgtctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagaaccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattacggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatatagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctcctagtccttccttgctttgcacctcacacacatctcttcacttccaggaactatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattgcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacacacatgcacgcacatgcacccatacacatgcacacacatacgcacccacacacatgtacacccacacacccacacatgcacacacacgtgcacacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaagggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgagaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatacttctttgcagggttagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctattttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttaaagcgcatttatgattttctgctgggcatttcttgagatctgaacatttggtttctcttcctttcggtaggacaacattgccgagaaagcttgctgtggggttccctgcaagtgctctgggcagaggggagaccgcgggcccatcggcagcatcgggccaaaggtacggtggctttacccttgcccacgcctgagatgaggtgtcagaagcccgacattactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactgtagagcaaagaagaccacgggattaaacagaggacccgattactttgtttcagggtattcctggagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagcccggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcggcgttccccatggtgaaatctgctttctgctgcatgctgttcacagtaccctttacgctgctgcaagcccggcagagaaagggtgatgaagggctccagcttgcaaaatgcctttgtctctcacaacagggtgagcgtggtccgcctggtgtgaacggcactcaaggtttccagggctgcccgggccagagaggagtaaaggtgaggcgtgggtgatggggttgctagcgtggggaggggtcaggtgactcgcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggtaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattgcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacacgttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctcgaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagacgtggcctttaacactgcaacgtagcctaagattagcagcagagtccccgtgaaggaagtctccgtggggaaccagagtgacccttgccaagtggggcttctcagcagaatctgtgcctcttagatatttacggaaggtgcttgttaagccaaaggcttgtagaggtgggagtgtactgaagtccggtgcatcctgcaaagtgtgcaactgtcctgcagacgggctcttcctctgtgaatcgacccctttccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagagacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcgtattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaattttgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagatattttacttaaccgagtgtgtgttgtgtttggccgggatcacttggagaacctgggactcccttccattataattaatgtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtattcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaattccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttaagaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagtggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgaggaacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagccgggctttgagggagagcaggggaccagaggtgcacaggtgagtgcttccgtgtgtgactgtgtgccctctgatatttcacaaatcatttaaaaaatgattgggtggcatttatatccggaaagttaaccattttaaagtgaacaatccagtggcatttggtacttccacaatgctgtgcaatcatcacctctatctaggttcaaaacacagtctcgaaggagacctgtacccattagcagtcactccccatcaccctccaccccgagtccctggaaaccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatgatggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccgtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattgccaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcccctttggtccctggagatagccccttgtgcttatgtattttgtatagtgagtgcctcaagttcacccatgagttcagcacagaagatggcccttaaacttgctgtgactgcagatgttatcttgcaaagcagctatcagcaatgatgagcagagacacactgtcattgctgggctaggatcaggtgtcacggaattacgtattcgggtttccctcatggctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgataaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgcgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttcagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacatgggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccgtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaaggtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcgggaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtgatgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacacgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccagtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggtgtgccaggcatggcgacctacagtcacatctctttcccactcttagggagatgacgggagagacggagttggcagtgaaggacgcagaggcaaaaaagtacgtatctgctgaggattatccaagcgtccttgctgccaggaggctccaaggacaacttctgatgtgttgtgttttaaaagaattatttctttaaaaattgtctttgtatttgagtgagtgttttcgtttgatgactcagcagacatttctttctttcaaggtcaatttattttagatgaatttaaattagaaccaagtattaaataatctatttttcctttatagggagaaagaggattccctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccctaaaatactctctcatctgtcaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggaccctcagtgagatcttctgttccaaagcttactgtgccacttctcggctttcttcccagggtaacccaggtgaacctgggctaaatggaacaacaggacccaaaggcatcagaggccgaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcgaatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaaggttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttaccgtaccttccaactataggagccttaaattctccactttctgacacagttgaacaatgtttgttctgctccctctagggaaattcgggacctccagggatagttggacagaagggagaccctggctacccaggaccagctgtaagtatttatccagttctgacccggccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtatttctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacagtttgtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcaggtctgtgctctgtgcgtgctgttggcatctccctttcttctggggctctgagaaggttctcagacacgtccatgctcctttgtggcttcatgtcccatagctcctaaaacgtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatctacaccacaccactgtgcaaagctttcttcagtgaggccccaagggtcagcccacggagaggccaagtgtcgcttgtaattctattaaataactggtttaattgtgtgttttttttttttttttttttttttttttttttttttttttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactcgccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtctttccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcacccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtacgcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttcaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccagatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctccttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccgtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcttacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagcccttgctagggctgccatcttgtgacatcctcatttcctgctccagggtgtgttcctcaaagcctgcatgtaacacactcagaatacagtccttgatctgggcttgtacacctggatgatgtattttaagaggtgttggttagggattccagcctcccactccccatcctgtgccctcaatcctgtcttgcgatagggatgggaagctctcattctctctggaatgtcagtgggggcacagttcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaaggctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccgcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaagtaagtacatgatcagtacaagtcggtacctgatttctatgtagagtatcaaataggacacaaaggagacacttacttattgaatctattctgaaataaccacaaattcaaaaaacaacaacagcaacaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgtagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctaattcatataaacaacaatgtctttcagcaagggtctggctgggctgttttgtttttcttttcatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattacctttttttttttttaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcgtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtatttttttaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggcctcctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattgcaaaatgaatcctaaattattggcttaatcacctgtgttaaagaagtttcaatgcagaaactagacaaaacaactaacaaaatcaccatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcattgggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcgagaccagcctggccaacatggtgaaaccctgtctctactaaaaatgcaaaaattagccaagcatgatggctcatgcctgtaatccagctactgaggaggctgaggcaggagagtcacttgaacctgggaggcagaggttgcagtgagctgagatcatacctcttcattccagcctgggcaacagagtgagactcagtatctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccatttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttccaaatatcttcttgtccacagtaacagtgtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcaccccacccaccccctctctcgacgctcagtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttt

SEQ ID NO: 35876 - DNA, 25735 bp, Homo sapiens
gtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgaggagccgggggccggcaggacgtgcctggggaggtcctgcgccgcggggcttgggggtcgggggcggccgcgggcgagtagctgcgaggcaggtgccgcagtgcggtccgtcagcggcggcctcgcctcagccgcgtccccgtcagcatcttctctggatcggccgtggcggcgcggcctcacgggccgccggggccggggctgggctgcgtagggggcccctgagcctgcctccaccctccactttgagggcggcgcgtccggccggcttcttgcgcctgaaaaggcccttcagagtacggagatgcatttctcagtgaactgggattgagtcgcagcccgctgcgaagaagagaaggcagactttttagctgccactggctgccacgatgtttttgcatttgtatggtgccttcatttctagtggttgtcatcagtaattgctgaaatccctgcccctcccttcccttatgtatatttccggatgcaaaagttgagatggagtcattatttttatatgacttatatttcttaaggcgaatacaaagcacctctcaatagtttgtcagagttccaaattttaaggatttggaaacaggatgtgagtcgcatttttagggtcacatgtcaataaatggtagctttctgagtagaacctagattcctaagcattcagcaagaggtgaagaaatcagctaatacgtggcctcttactgcatatcatgtggtaatgtatttcatttgacagcagtccttagagggcatcatctttgttttgcagggtgatcaacctaaataaattacccaacactaaacaggttgggtgctggatttgatttcagatgaggtggtgccagcgcatcggccttttccattatatatgttgtgttgcacaagtaacgctattactgtgtgagaatgtgggagtgatggggactgagactggaggcacagacagtagtgaacaagaggccaagttgagaacggcttggaggaatgggtgctctgatctcagtgtgtcagtttaaaacctatgggaggccgggcgcggtggttcacgcctgtaatcccggcactttgggaggccgaagcaggcagatcacctgaggtcaggagtttgagaccagcctggccaacaaggcaaaacgccatctctactgcaaatataaaaattagccgggtgtgttggggcacacctgtaatcccagctactcaggaggctgaggtacgagaatcgcttgagcccgggaggcggaggttgcagtgagccgagatcgcgccattgcactccagcctgggcgatagagccagaccttgtctcagaagcaaaaacaaacatacaaacaaaccaaaaacctatgtgaggtgttgggaggtcctgcttgtggaatggcgatttaattctgcaccagtatgctcttgaaatctgcagatctctgtccctagaggtgcgggggttttgtgtgttaatgatagttacgttgtatccatgccccaaacgttttcgagttctttgtttctttcttctgtttctggctctggaaaggtctttctgatctactgagatactttgagggaattaattttaattcagtttttgaaattttaaaaatattccctttgatcctgtggtttaactgaacatctattgagattccatgttttaatattttgactgatattattttgattcagtgaggtataggcttttttgttttgggtctgagataaaataattgcttctgcacatggtttgaacatgttttccttactagcatagccgagttcatacagaacaagaacctgatcctgtcagcttctgaattgctcagtcttgtcagatgaggttcagttattattttccacaatgactaaatgtgatgtagtggaaaacatctttaagagctctgacttctctattccaggcagaaacaaaaatagaaatcctttaaaacagtgttgccaaactagagggagaactagggacctagagagagaggaagggaactaggattttgaataccatatcatgaggcgtatttgataaaattcagatatttagcctggagaagaaaggccaagggtgaacacatggaatttgaagtgatgtcatgtagaagagggagataggatccatttttttattattattgattccatccaccattcgtagacgataatagcacagtatagtggagttcctagagggaaggacacttagcccagactggggaggctgaggaaaatttcccatgggaggtgcctcccagggctaatgtgttgaaaagttggggtgggaagaaaaggtatttgaaacagaacagcatgtgtaaaagcatggcgatgtgagagcaaaggggcaagtagtttggtggggctgaaatgtacaggattaagttggggagataccagaaataaggttgatgaggtttcttgggtgttaatgctttgggttttgcttcagagtctctgggcagtgagagaaggcatttaagcagaagggtgaatgatcagatctgtattttgaagcagttatgggaaaggctggattagagagtggcatgacaagggtcataaggcacccaattctagcaaacctggagagggcctgaagagtgtgccctggacatagaggggaaaggatttgtgagataagaaaaaaagatgaaattcagtggctaattagctgtgttgctgaggaagatttaaagacgactgattccagccactgggtggaaggaaggtggtatcatccttcaagatagaatacaggagaagtgtgtggaaagatggtgaattgggtgtgtttttggtgtttgcagccttaggagtagttgggctcagcctgggagagatgtagaataggaaagcagtaagagtcaagaatggagccctcagatctccaaagtggagtatgctaggtgatccatttggatgccagatgaatgtactagaaattccatttatatcctttttgtttttgtttttgagacagggtctcactccgtcacccaggctggagtgcactggtgtgatcacagctcactgcagcctcgaccacccaggctcaagcgattctcccacctcagcctccctagtagctgggaccacaggcgcatgccaccatacccagctaattttttgtttgtttttgtagagatgaggtctcaaactcttgggctcaagtgatcctcctcctcagcctcccaaagtgctgggattacacgcaggtgtgagccatcgcacccagcctctatctttttttttttttttttccttttttgagacagagtcttgctctgtcacccaggctgaagtgcagtggcacgatctcggctcactacaacctccgcctctggggttcaagtgattcttgtccctcagcctcccaagtagctgggactactcttgttgcccaggctggaatgcaatggcatgatcttggctcactgcaagctccacctcccgggttcaagtgattctcctgcctcagtctcccgagtagctaggattacaggcatgcaccaccatgcctggctaattttgtatttttttagtggagacggggtttctccatgttggtcaggctggtcttgaactcccaacctcaggtgctctgcctcttgagtagctgggactacaggcatgcaccaccacatctggctaacttgtgtatttttttggtagagacggggtttcactatgttcaccagactggtctcaaactcctgacctcaaatgatctgcctgcctcagcctctgaaagtgctgggattacaggcgtgagccaccacacctggcctcatttttgtatttttagtagagatgaggtttcgccattatggccaggctggtcttgaactcttggcctcaagtgatccgcctgtcttggcctcccaaagtgctgggattacaggtgtgagccatcatgcctggcctatttttatcttatctctttttgaataataatggtcaggtattttgtagactgtccctcaatttgggtttatctgatgttttctcattattagattgggaaaaatactacacaggtatctcatccttttaaaaacttttatttttgtatgctttgtaatatagcacaaatcaaatacataatctattactatagtagaagtatatactttacatggagaggatgagagggacagagagaagaaagaagggctactttccaattttgggctgacagggttgaaatctaaaaagtttggctaccactgctttaaaggacaggaagggaaagaaacagaggagaagcagccaaagggattgcaaggaaaaccaggagccgtggctgcatgaagaccaaagcaggggcttttcaaggagggagttgccagtatcaaatgctttgggaagttagataaaattaagggatggaaattgccttttgagtttggggagtcgtttcagtggcatggtgggcttggaaggtgtgggcggccaggtggggtggctcacgcctgtaatcccagcactttgggaggccgaggcaggcggattgtttgaggtcaggagttcgagaccagtctggccaacgtagtgaaaccctgtctctaccaaaaaaatacacaagttagccagacgtggtggtgcgtgcctgtagtcccagccactcaggagtctgaggcaggagaatctcttgaacctgggaggtggaggttgcggtgagctgagatccttaccactgcactccaacctgggtgacagcaagaccctgtctcaaaaaataaaaataaaaaaaatttttaaaattttgtgggttaagtagtaaacttaaaatgaagtatagaagcaaacggtggttgactgctcttcctggattcttcctctgaaggggagcaaggctggtagctggtggagactggtaggaccaaaggaggttttttatggttttagttatagaatgggagtgccttgagcgtatttttatgctgaagtgaaagggccagtggagagggaaaaaactggtggtttgaagtgtgacttcattcattcattaactcaacaagtacttattgagcaccaatgtgtcgggctctgttctcagccctggggatagtgtgtgaacaagacgcactgaaatccccgccttcatggagcttgtattctatagggccatcttttgatggctattaccatatagccacctcactcctgatgtgttgtctgtcctagaagagtggcttccttaacaaacagtgaaggaacaaaggtccctaaaaagactgaacacaggattgtcttagtctggaggagggacatccctgccctcatgtctggagggagaggagttacagataggggcttatgcagataaatttgtggtggggagaggaagcaggtagctcaagaaattcctctgttttctctgtgaagctggagatgaggttatctggtgagactgagttggggagtgatagcataggaagttgaaagttaggaagcccatttcagttcagtacaaggaaaaacttttcaaaggactagaatgttaggaaaatggagccagttgctggcaaatgtagttcgtatattgaggtggtgtccccatcactggtagtattgaaatagaggaggggtgactttctgccaggtatccctgagacatgcttatacttataataagcagaagtttggacaaatgaccttcctctgtataggagtccctgactctaaggttttctaaagctctgggcttctgaaggactgttgtacaggcatggaagttgaaactacgaagctggggcaaagttatttggtataggtttgccagaattgaatgagtagggccgtgtctcaaaacaagggtatctccaaatcaaaatatggttttttaaatgtgtatggtacctggggctgggcgcggtggctcacgcctgtaatcccagcacatagggaggctgaggcgggccgatcacttgaggtcaggagtttgagaccagcttggctaacatggtgtcaccctgtctctactgaaaatacaaaatttagccaggcatggtggcacacacctgtaatcccagctacttgggaggctgaggcaggagaatcgcttgaacctggcaggcagaggttgcagtgagccaatattgtgccactgcactccagcctaggcgacagtgtgagactctgtctcaaaacaaacaaacaaaatatgtgtatggttcttgggaagcataggtctcttggttccccatttttcttagtgtttgcagtactactactttagtgaaccaagatatctatcagttacaaaagaccattccattctgctaatttttttggtctgtcttcagctagagcagtttggaaattcctgttctgacagctgtgccggattgaaatttgtaactcccgtgtatcagcaccaacctgaagccttttatttactgtcaatactgcaacaccaaaacatttactgttgcttccaactttatttccatcccctgttagtggtactttccttaggtcaagagaataacactgattctttactaaagtctaattttcccatactaggtgtggctaacatttgttctagacttggagcccatttttttaataggaaccccaaattaaaaaatcagccaggcatgatggcatgcatctgtagtcctagctactcagaaggctgaggcaggaggctgaggcaggaagatcacttgggccctggagtttgaggctgcagtgagtcatgcagactcaaactcagcttgggtgacatagccagaccctgtctctaaaaaaataactaggtacaaatttcatccttaaatgtaaacaaccaatcgtgttcactttggttgcccaaagactacaaaaagctcaggggctctgcccttaggcctggcagtgaagcagttcccaggcagagtttctgttttcaagggtgctcaggatttggagaaaagttcctttcagtaactgaaattagctacttgtccctgtgtaagctagacatcacgaggttaatagataatggatgaagaggccaaatacctcatccttagctgtggagagcttataaaatagtccctttattctcatctttatcttttaatcctgaatccttagactagttgactttatcattacagaataccttttcttaccctcttgacatgtcaactacaaatactgtttcctggactttgtttctaaagtctgaagtgtttttatgtttctacttgtgacatgtatgccccccccccccccccaacatttgacagtccttatttcactagggttgcctatgggacataaggaaagatgttacctatcctaagacatagtaacctggtaaaatcttatagtgaaataataggaactttatgaatttgcattgtgtagaaaggattgatggtagaaataatttagagatttcaagcttcttcctttttagtctgtgcctgggctttgttttttgttttttaaattttggagatatgccactgatttctaattcctgccaaattgccacatgcctctttaagagccatcagtaggaaggtgtctatatcattaggaaaccctgttttgtagttgtacctttgttgatctctttttgagacttttgtttgtttgtttcttgttcttatcaggcagaccctgaaccagaataggttcagagaggctctgatagttgtacttttgttccagcagaatgtgtggacttaaattcttagagtgatactttgaaaaagaatttgttattgtttaggactcagcattttgaccagtcataatttaatacgctaagtcagtggtgaatggggaaacatgtattatatttaataattgtcaaggtaaatgatttatgatgttgataattcatttactgatctgttttcttttcaggtgttttggggaacgagtttagtatattaaaatcaccagggtctgttgttttccgaaatggaaattggcctataccaggagagcggatcccagacgtggctgcattgtccatgggcttctctgtgaaagaagtatgtatatattttttaaatgtttggagctgcttttaagaacatttttactgatttctgctaatagcccaaaaaagcatcaaacgaacgtaggtacgtttggtacagattacaaaagttaaaaagctcatctggaccaggcacagtggctcacgcctgtaatcccggcactctgggaggccgaggtgggaggctcagttgaacccaggaatttgagaccaacctgggcaacatagtgagactcccatctcaaaaataaatgaattaattttttaaaaacccatttgtagttgggaagattttggatgagtgcttcaagcttggcttctgaaacaaatcattagaaatcattaactatataattatttattcatagtagtgaaattctttgtatattagagaatgcatctgtcctactcttaataggatatctactttctggttttttttttttagtataggcgatagattcactatgaatgataaaatatatatgcattatgcctgaggttaggaaaataatgtggtcagtagccatggggcagccaaggaccttggtttcctagaatggagctatgacctgttgtagtaattggctgcttatgtgattgtagggggcgggagggtctagatccagtcaatgtgagagatcgaaaggtaagggctcagaagaaaggaaatacagcttgctcggtgctatcatctccttctctttgtaagtctggtgcttttgatgtggtctctagatatatatcatcagtcactgaaaggaacttttctccaaatcctgagcacccttgaaaacagaaactctacctgggaactgcttcactgccaggcctaagggcagagcccctgagctttttgtagtctttgggcaaccaaagtgaacacgattggttgtttacatttaaggatgaaatttgtacctagttatttttttagagacagggtctggctgtgtcacccaagctgagtttgagtctgcatgactcactgcagcctcaaactccagggcccaagtgatcttcctgcctcagcctcctgcctcagccttctgagtagctaggactacagatgcatgccatcacgcctagctgattttttaattttttgtagagacagggtctcgctatgttgtccaggctggtaggtctttaactcctggcctcaagcaatcctttctgcgtcagcctcccaaagtgctgggattacaggcacgagccaccacacccagcctgtacctaattctttttttgttttgttttgttttgttttttgctacagggtcccgctctatcacccaagctagagtgcagtggcctgatctcggcttactgcaacctccacctcccaggttcaagagattctcccacctcagcctccccggtagctgggaccacaggcgtacaacaccatgcccagatcatttttatattttttgtagagacaggattttgccatgttgctcaggctggtcttgaactcctggacacaaggaatctacctgcttcagcctcccaaagtgctgagatgacaggcgtgaacaccacacctgaccatctagttctttacaaccttaaacttgactactgatggctattaaaataactgagaaataattattagtaaactaatgatagttacttttagtaggaattgttttatttataaagatcttagtctaaagaggatgttttaatgaccatcttgctatgtctctgtgaaagataaaagtgatgctgtatatgagggcaaaaaatgatgtgggggaagaaaatttccatggctacatgaagaaaatattttgtgatctgaaatttgaaaggtacctatgttttgtttacttgcttgcttttttccacaaaaggtgtcagatgacttactattggactttatttcaaatctgtaaaattttaagaaaatgaagagggtagaaatcagcattcttgattaggggattgcaacgactgccacaaataaaatgtttactttccctgtgaattttccttgtcagtgtcatctcagaaccccttaactctgcttattagatgttattggggaggtgggttcctgagttgataattaagcaccgctttgtgcttttcaatgtttaggacctttcttggccaggactcgcagtgggtaacctgtttcatcgtcctcgggctaccgtcatggtgatggtgaagggagtgaacaaactggctctacccccaggcagtgtcatttcgtaccctttggagaatgtgagtatttattataaaaaattaaagggatgcattttacattttcccttgtcagctgtcattatgaattgcattctaaacatacttctcttatctgtttttgatgcacagtttcttttgaaattctttgacaaacacaatttctttttaagaaaattacatgatgattgtaattaactgaggcttggctgttctctgtggatgagagtactgtttaagataagagatagagaaattgccccactcagaatagccagaggcttgaaaaagagagccactaaaggagaaaccagttggggttgtatcctgctactgtttttttggccattgtcttgtcatcttccctgcaggattttacctcttttcgtgtgtaaggacactggaggctgcttgctggctcacttactccttcactggctattcaggcaatgtgggtgactgtgctgatctaagaggccctccttccattataagcatatagaagtgcttgaaagaatgtcacaaaaaacatttttactagcataactaaatttgaatgcaagagggggtgatatacacaggtgttacatatggatggaaaactcagaagccatagtggtgagcagaagctgacgctgaaactgtgtttcctgcagaaagccagggactagaaatgctgtcaacttgttcttgaaaagcagactagtaaaactagtaaagctggcttgctgcccttggctgttggacccaaagagtcccctgagataaattagaattagaattataggcttatgctgtgcagagtggttctttgcaaattcacatgacctgccccatagggacatctccatagccaagggctcctttggtcaaatacggaagatgagtggaatttacaaagcacctgaaggaaaaaaaatgccatgagaaacaggtgcaacaaacagaattcatctccttagaactacggagaataggccaatttccaagagatctaaaaatacatacattaaaattgtgaaaaaaagggccaggcatggtggctcacgcctgtaatcccagctttgggaggccaagatgggaggattgcttgaggccaggagtttgagaccagcttggtcaacatagcaagaccctatctctagggggaaaaaaaaagaaagaaagagaaaaaatttgtgaaaaaaaggaaggaacagaaactatgagggagttataagacatttttgatacatggtgctttagctgatacttcaaaatatttcataatttatattgtgattctttaacccatgagttatgtagaagtattttttccaaatgcatgggttttaaaaaagtaatttctaatttttaaatttctaagttcactgcattgtaatactgtggtctatgtgatgctgaagttttgggatttttttttttttcagactttcctgtggtcgagtatagattatttccaagtacacatggcatacttagaaaaaattactgtgcagtagtccacaaggcaaatctcaacaaacaataaagaatcagtgtcatataaactaacttctctgaccacaatgcagttaaatctgaaaataataataaaatgatatcttaaaagggtatttggagcccggcaccatggctcacgcctgtaatcccaacactttgagaggccaaggcgggtgaatcacttgaggcgaggagtccgagaccagcctggccaacatggctaaaccctgtctctactgaaaatacaaaaattagccaggcgtggtggcacgcatctgtagtcccagctactcagtggctgaggcacgagaattacttgaaactgggaggtggaggttgcagtgagctgggattgcgccactgcactccagcctgggtgacagagcgagactccatctgggaaaaaaaaaaaggtatttggatcaacatttctcctttccccatccacccgtctcccccagcgtcttctaaccatcattctactctacttctatgagttcaacttacaagtgaggtcatgtagtatttgtccttctatgcctggcttacttcacttaacataatgtcctccaggtttatccatgttgcaaatgacagtttcccgcgctttaaaggctgtatagtattccattatgtttatataccacattttctttctgcttttttcttttttttttgagacagaatcttgctctgtcgcccaggttggagtgcagtggcgcaatgtcatctcactgcaacttctgcctcctgggttcaagggattctggtgtctcagcctcctgagtagctgggattacaggtgcatgccaccacgcccagctaattttttgtatttttagtagagatgaggtttcatcatgttggccaggctggtctcgaactcctgagctcaggtgatccacccacctcagcctcccagtggatctcagtgctgggattacaggtgtgagccactgcacccagctgcacattatctttatccattcgtttgattatggacaccgaggttgcttccatccatatcttagaaattgtaaatagtgctgcagtgaacatgggagtgcagatatctcttcagcatactgacttcaattgctttggatatatatacccagaagtgggcttgctggatcatgctttagtgatctattgcacaaaatggtgactatattaaataataatgcattgtgtatttcaaaattgctaaaggagtagattttagatacttttaccacaaaaaaaatataagtatgtgaggtgatggatttgttcattagcctgatttaatcagtctactttgtaaacttataacaaaacataacattgtaccccataaatatatacagttactatttgtcagttaaaaataaaataaaaagtatttggaaatagtaacaaacagaagataacaactcctcagatttaaagcatatggaacacccagtaggcaaaagccagatccacacctacatacggtgaaattgaagagtcatcaaggaaatggaaaatcttaaaagctgtgagggagaaaagacactgtcattacaaaggaatgagagtagaaggaaagcaaggaaaatgtagtgattgtgtagtatgagctaggctgagtattatttgcattgtcataataatgaaatgatgctgatcaagtgaaaattttgatataactattgggtaagagtggggagatagaaacagaagcagagcgcatggatggctcagcgcatggatggggcagtggttggtgatgtgagagagctaaagcctcattttctataatggatagtaaatagacaagacctaaaattgaaaaatcaggagatgtaatttaagtgtcttatttagagatgttaaaagcaaaaaaagtcaacaagaaaagatagttggaatagatgcactcctaaataattcatgggttgaggaggaaatcactgtggaactttttaaattatttggaactgagtaacaatgaatgtagcatttatttacaaaattgggaggtgcagctaacgtggtaagaaaagggaaatttatagccttaaatgcatgttttagacaatttaggttgtctaagaatggaaattaatgagctaaagaaagcggaagaacttcagagtaaatacacataaagtagaaggaagggaacaatacagatcaaaaggcagattatttcacagggagcatttaagtcattttttatgtgatttctgtgaaaatcattgcagaagattttctttaaaattataaaaatccaaaatgccattttgagatttttattagcatgtaatccaaaaataaagatttaaaaacagactagcctcattttacatgagaagaagctgtgctgtgtgaggagctcattttattgcttggccctggttggctgctcaatgcttttcctagcagaagatggtaaatgagataaaagattcaggggcaaaccccacaaaacataaaaatcagagtatcttagaattccatttaacgaagcttccatttgattagctagctgttttagttagaatttcaagtcatacaggtacagaaatttgaggacagatatgcatctcccttacaatacagtgagagaaaaaccatcattcgatattaagcagccaagctttttactttttgagcttagctgcctatataattatttcttttccttcattggtgttcatttgattcatgagctgcttcaatttgatcgctatggacatggttcctaatcttcaactttcctgaaccgagcgccatttcactaagtgaagtgaggctggaaagtttgcatcatttgctcatgtattcccctcacagcctgaggaggtaaactctatgatcgctaaaggaaagcacctatagatgattcagggcggctgctagcagtatgcttttgcaactttgaactctcttccccctcttcacttactcattaactcattttgagagaatttggggaagagttaataagcatcttgagtaagagaaaaaaattatttcatttcacagaatcataaaattgatcacttaatattgatgctgggcctgggcatggtggctcacgcctgtaatcccagcactttgagaggccaaggcaggcagatcacatcaggccaggagtttgagactagcatggccaacttgatgaaaccccgtctctactaaaaatacaaaaattagccaggcgtggtggtgcgtgcctgtaatcccagctattcaggaggctgaggcaggagaatcacttgtacctgggaggtggaggctgcactgagccgagatcgcgccactgtactccagcctgggcaacagagtgaggctctgtctcaaaaaaaaaaaaatgtgatgctgggattttatcagtaagacataatcacattgatttctgcctgtatcatattagcgttactttgctacttgtaaacatgaatctttaagtagtaagggaactactgaatgaaagatcaatgtaagaaatctccattaaaacaaaaacatgactgtactgcttgttttaatacagtaatactgggaatgaaataatttttttaggggaaaaataactgtaatttatttttttaaatcatgtactgcaaaacaaatctatggggatagaagtcagaatttttgttacccttgagggtggaggtagtacttcgagggcgctgatagtgttctgtgtcgatctggctgggctacctgagtgcatgcatgtgtaaacatttgttgagctgttaccccaagatttgtatactatattatatgtattttgcactttaataaaaaaattgaaggaaaaaagtaggtcttatcaccattggttatttcaatctaataatatcaacatgtcctaagataaaggcttcaaaaaccttgtgacatacttaacaccttatctaagagtctttaggctatctgaagacaaatgttaaatctcattaaacatttttaaaattttgaaatgaaagatgaattccatttttatttcaattaaattcaatactcagattcctctaacctcttaaatgcaaattaaatactttattgtggaatatgcattcatcgtggcacatttagtcaatattgaaaccaaatgtattgctgcttcaaatacatgaatgaccaccagaaaatggtttgtgctagatatagtgttgtgtccatcaggtttaagttattttccactgaggcatgatgggagatacagacttggcttaccagggggctgtttaatcttctgtgccctcaaaagggcttgtttggaaatgatttcgggcttctaaatttccatagaaagtgctggaaaaaagtttaaggcttctttttaaataccatctgaatgatttttcttcccactttggttcacataataattgcgttcttactcttaaatttcaggcagttccttttagtcttgacagtgttgcaaattccattcactccttattttctgaggaaactcctgttgttttgcagttggctcccagtgaggaagtaagtgataagggttttattcaagacattttaaaaaataagcttttattatttgaaaattatgaaatgtaattttattatgaaaatataaaactaatttatgaacaatgttgtcatacctctgggtattggaactaatctgtagaatttgagcaacttaaaattttctattcttcttacagagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagtaagtgcagttattcaatgaatacatgaatatcattaatttccgtctttttaaaaaatagagacagggtctcactctgttgtccaggctggtcttgaactcctggcctcaagcaatcctgtcttggcctcccaaagtgctgggatcacaggcttgagccactgcatccggcctcccattccttatactacttgaaattttggaaattttgctattttagaaaatgaaagattgtgcacatttactgctggggtagattcttctttagtgtaattttcttatgactctcatgaataaactgatcctttttgtgagttgagctgtggtaaataacatcacattttagcacgagggttgccacctattaattcaaacaagccagaggtcatagatctacttggtgactggtggagctgtgtggatctggtaacttggaagccattgttcactgcctctgctgatttgttgccacatttttctcattcattctggacattgcagtggagggagccacctctacttttgactcctgtccttcagtttctccatctgctcatgcgccctcttaaccatgtggcatgccactttcgtggtggcctcccctttttatttgctgtggatgaccagggccatcatcctttattctctgatgtggaaactattcaagggaagtgagcaaactgggccaatggtaggatgtcattgcagagtgccaggatatcctgatgctttgaaggaaaaccactggagaacttggatgctttatcatggttttgccaaaaatatagctattgagtggcagtcactgtgctagggaatggccatcacctttttgttaggaaataatgttttatatgcattttcaattgaagcaaacataccaaatggaagataattatataaattcacttatatgatcaacatttgtaatatcctgtgccttgcttggtaaatggcaaataaagatctctggtgcacatttaaaagaatgctctttttttttgggctctctgaaggttgacctgctctttctttctgaactgcaagtgctacatgatatttcaagcttggtaagtaggctgctctaattttttaattccatttattttggtttctagagaatccttgaataatagtaaaggcagttgaaaagtttgattaagtatgccctagatttatgatcccatgaaaattgaaaaattagtggcaatattgggaattttgaacacatccatgttatagtcaaattattttgcatttctgctttttagggagagacaacatatcttccaagaacacaagcctgggcgtaagaacaccctggccatagtcctaacttggctgttgatttcttgtgagacttaattcctatctatatctttgggcctaaaatagaaataatagtttggactaataatgctgtcagtcaagtcaagaagggacgaaatccgtctgaagggtatttttttggtgaatgattttttaaaaatcatccttgttactgaaatagaaattcttatctgtttgctaccttctgaagttgttttccaaactttttcaacaggtgttggttcggggagtctggaagtgtagtgcattcctgggatcaaactggtccagccatctgttctttcatacgttggcccatacctgagtttttaaaactgaggaattttgttgaaagcttttattaaatatccaaggagtcttgtactgctcctaaacatgagattcgtgttggatttatcagaaacgcttattcaaaccagtttcttttgccaccattttagactatttgcatgttgtggtacactggtatggtttagtttagcctagtttagttaggcataaaactttaactggctgtgtttgacgtctttcatcttactttatccgctacctttttttgtttgtttgttctcctaagctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaaggtaaatatcaatgcgacatgagaggttggagtatgaccatttcacttttagcctcttaatagaaaaatctgctgtttcaaacactgttgattgaactcttatttgccttctttggggctcctctaattatactggccaaggatggagtagggtcaaaaatgtatattgatatatttcttcctaatgctagaaagaacagcattaggaaaagttatctcacacaaagctttacaaaattattgtggtaaaatatatataacataaaattaccactttaaccatttttaattgtacagttcagtggtattaagtgcaagtacgttcacatgttgtacaaccatcaccatcttctatttctagaactttttcttcttccccaactgaaactctgtactccttaaacactatgagataactgaagtagaacacccagcacagtaccagacagtagatgcataataaatgctagttcccctctgcccttgaagttcttcacctgcatcctttcagtgaggcttcatattttaatctttatagatgtttgtgattaaccagagaccacttaggaagatttcatttctctttccaacttcccttcctccaatttatatgctgacaaattcagtctcttcttaaagtaattttagtctaaacatttgaatatatgttaaagcttaacacttttctgtatagttgagcaaaatcaaaacctttaagacttgcttattgtaagatgtagtatatttcatgagccaggaggtaagtgtacattgttcttgtagctgcacaaaagctttaaaaataattttaataagtatgtatttgactcactgcataaaatgataagtaggaggtaatgcatatgttaattagccaatgtggacttaagccattccacaatgtgtacatatttcaaaacaatatgttgatgtgataaatatatatgattttaatttgttaattaaaaatgaaaaaagtacatagttgagattcccaataatgttaataactaactttcagtttgcagatgacatgtacagtctttatggtgggaatgcagtggtagagttagtcactgtcaagtcatttgacacctccctcattaggaagacaaggactatccttgaggcaaaacaagcggtgagtatattttgagatcctgctttaaaactgtaaaattaacttcttataaaaaaaaaaaaaaaccaagtcctatatcacctaagggtgacatgaatgagcagtcagtaaatctgaaaaacaatttcagttaaaacgtaagcttcttgttcacatacatatgtgtgctttgccagtgatgatcagttctttagggttataatcagataatgcaagaatttgaattagggataaaagtaaatctgtccaagattataattcaaatatcagtacacacaaggagatatcagaagttaatgtggcgccaggtgcagtggcgtgcatctgtaattgcagcttctcaggaggccaaggcaggaggattgctttagctcaggaggagtttgaggccagtctgaggaaacatagcaagaccctgttttgaaaacaaaaagaagtgaatgtgtgcgggagtggtgtggtgcccacatcctatgggctctgcttttctagcaggcacattgtctttgtggcgtagtccctcacttactgagatcctctgtgtgcacctctttatgattttgatttacttaacagtttttttgggtatggatcttgctttgattttaagcatttagagggtcagggttaagcattaccatggttgctggccatggtaaaatacatatctgtttatgtgtatgtacgtgcacatttacatacatacatatatacttacagctgcagcagaacctagggagggtgatgggaaagagtagtgtagatgctccctaacatcctacgtctgagaacattgcttagggctggctgtatcacttgcagcagatagatatccactcaattacatacacctccgcttcagacccatttgcagccctcaccctgctcagttttactgaagtcagtgtgggacttggagtcggaaggtcgaagccagtgcctgtttgagatagtctagcgattactggtttgagattgtttctttctaaattaaattggggatggaaggacctttgtttcagacagcatgtcagtctagacaaccacccaagatttcccaccataaaacgtctagaaatgctagataaaaataaagatcttttaaaaagtacatagtttgggctgggtgtggtggctcacgcctgtaatcccagcactttgggaggttgaggcgggcggaacacctgaggccaggagttctagaccagcctgggcaacatggtgaaaccccgtctctactaaaaatacaaaaattagcctggtgtggtagcgggcacctgtaatcccagctacttggaaggctgaggcaggagaattgcttgtacccgggaggcagaggttgcagtgagccaagattgcaccactgcactctagcctgggagacacagcaagactccgtctcaaataaaaaaaaaattacaaaaataaaaatacatagttcagctcgcaagaaagggaaattctcttacagagtaaataaagaagaggaggccgggtgcggtggctcacacctgtaatcccagcactttgggaggccgaggtgggtggatcacaaggttaggagttcgagaccagcctggccaacatggtgaaactccgtctctactaaaaacacaaaaaatcagccgggcgtggtggcgcacgcctgtagtcccagctacttaggagtctgaggcagacaaatcgcttgaacccgggaggcggaggttgcagtgagctgagattgtgccactgtactccagcctgggtgacacagtgagactccatctcaaaaaaaaaaaaaaaaaccgaatgtggtaagcaggccgccctaaggatatttgccagctgggtcaccaagagtcctttggtgccttgtgtgtgggggatgggaatggacaactccagataaagctggggaccccgagagagctgtgccctcagtgagagggtagactggaaatttttgcccaccagcacagggaaacagaaaggcacctgggctctgggtggtcagcacatgtgttgagagtggggatgcctcccagagaattcttttttttttttttttttttgtgttttcagattttttggagataggatcttactctgtcacccagactggagtgcagtggcacaatctcaactcactgcagcctccacctcccagattcaagtgattctcctgcctcagcctcctgagtagctggaatcacaggcatgcaccaccacacccggctaatttttgtacttttagtagagatggggttttaccatgttggccaggctggtcttgaactcctggcctcaagtgatttgctcacctcagcctcccaaagtgctgggattacaggtgtaagctaccatgcccggcctatgagatttctttttagggtgatagaaatgttctagaattagattgtggtgataactatgaaaccactaaaattccttgacttgtacacttaaaatgggtaggaaaaagaacatgtttatcaaaaaaaaaaaaaggaaagaaacaaagaggtcttcatgggcgtgaaatcctttaacgtttgcctcagctctgagctccccgcaggtaaatatgcatgcctgtgtacccattctctcctacatttgaaatcactctcttccattagtttaaggagacaggagtttaaggaacatttactgagtactcacaacattccaggtgctggggctgtagggacaaatagatctcggttacattttcgttctcatcctcactgccaggcaccctgcccccatttctcccacctcatttgactgccgcctcctaacttgtctgaactcatctgtctctctgcttcccagctggctcctcccaaatccatcctacacattgtcatcaaagttatcttttttcttttctttttttgagacagggtctcgccctgtcccaggccggagtgcagtggcgcaatcatagctcactgtagcctcaaactcctgggctcaggtgatccacctgtctgagcctcctgagtagccagttctataggcttgagccaccacactcagctaatttttaattttaatgttatctttttaagacaaacctgatcatgtcactcactttctgcctaaagcttgtcaatggctccttattgcccagaggctcatgtcagattttctgtagcttccctgcttctagcttcatctcctgctgtgttcctacttttaaaattctctagccagaatgaatgatatttcccaaacagtgcctttgtcagaatgaattcagtttcccaaacaatgtttttacacagctctgtattttaaaaaaaagtgttaagtggatcatacatacataagtatataacatatttaatactagttatttaaataataaaaataataacactgtatagctccgttttcatatggctataaagagctacctgacactgggtaatttataaaggaaacaggtttgattgattcacagttccacatggctggggaggccttaggaaacttacaatcatggaggaaggggaaggggaggcaggcaccttcttcacaaggtggcaaaagagagagaaagtggcacacttttaaaccatcagagctcatgagaactcagtatcatgagaacagtatgggggaaactgcccccatgatccaatcacctcccaccaggtccctctctcgacacgtggggattacaaatcgagatgagatttgggtggggacacagagccaaaccatatcaatagcttaagagaatgcttgcttctttgaagctccctattttctccctctaccctccctcatccagaggtaactgctgtcctggatatcatgttaatcccttgcttttctttacagattgactgcatatgtatttgttcttaaacagtgttgtttggttttgcctgtatttgaattttatataaattgaatcatactacatgtatttttctgtgttctttgttcagtattctttttaagattcactcaggctgacaaatgtagctgtagtttagtcattttactgttacatattctgcttgtagggatataccacaattccattctgttgatgattttttttttttttttttttgagacggagttttgctcttgttgctcaggctggagtgcaatggcacagtcttggctcactgcaacctccacctgctgggttcaagcagttctcctgcctcagcctcccgagtagctgggattacaggcacctgccacgcctggctaatttcgtatttttagtagagacggggtttcaccatgttggccaggctgctctggaactcctgacctcaggtgatctgcccgccttggcctcccgaagtgctgagattacaggcatgagccactgtgcccagccttgctgctgatattcttatacatgtctcttggtacacatatagaaattttccctagcgtatggacttactggatcacaggatatgcacaccttcaactttattaggtattgtccagttttcccaagcatttggactggtttatacttccaccatcagtgcaagtgtcgtctccacaaaggcgctccttcttgcttcctcctagtataagtagctgttatgccacttatgaagaaatgtttgttagacaaatgaatcacagtcactagactgggataatttcctattttaaaattcttccctcttgatttttctttcttttctatattgtagaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattcc

SEQ ID NO: 35877 - DNA, 36932 bp, Homo sapiens
attggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctgtgagtctggggcagcgatgagggaggcgggatggtggtcgtcccggagggaaggcctcggccctgcgccgctcccagcctattgttctccgtggacaccgcgatatcgtggtttttgtttccttagcatgcacctggatgcttacaaccaagacccaatctgtgaggacgaggtgaagggagacggggctcaaccctctcaattaatcccttcactttagcaacaccattgcatgacctttgctctcgccacgggccctctgtggtcttagacctggagaaaagactttaattcagacctctttttagaactcgtcgaaccttccttttgtcctatgctttctttccttttcccgcttctccccctttttgattaacctcttcttatctttacagccgtctccctttaattttacttttgatttcctactgaaattcttcctttcattttcttctcggtgataagattttttttcctcctcgagggtgcttgtactcattttcagtgcagtaaactttattcttgcagttgccaattggaaaaaagccaagcatttttctttaacctctggctttccttctgtagcacccaccgaccaaaaagcctaaccagacaccccaaggatttggaaatctcacccagaaggaatatatcaattgaggggaaatggatttaatattatttttatagtcgtttactactgttgtgattgacatggtgttgaacgagcgggctgtaaatgccctaacatatttacagagaatttttagagatagcgttaaattaccggagcgtggatattttctttgtcgtgtggcttccccaactgcgttctttgtttttcgaggtattatcggatgagttgatcctgcctttgttggcatttctcggaagaagaaaagctcaatgagttcttgacatagctttttgtttttcttggatgacatagctttttgtttatattcttggaatactggcagtttgagagctccatgcattaaaaatgcaattttaggtttctctttgcagctctctaataaagttgctctgaagtacgatgtaattgtttttttacctccaaaatttttccacttttaagttgctatttcttgtctatattggaaatgtggttacacttgttttcttaatagattgtcagttaatctgttagtaaccttgaaatttcttttctctattcctgaggctcagaaagtatcttttcagtaggacgtagcaattagtgcatgacctttgttttaggaaagattgtatctgtagatgaatactccctaaaaaactactagcctcacggtgttggtggaatctcttccctcttgcctcttagctatgacagtcatcagcattttgggttaaggcactgctcgtgttttataatgtaaacttaatattctcagtattagtttgaaaatgtttaattttagaaactgcagaagtatctgaccacttaactttttaactttttaattttgtttttactttttaattttttgagatggagtctcactttgtcacccaggctgcaaggctagagtgcagtgatgcgatttcggctcactgcaacctccacctcctgggtttaaatgattctcctgcctcaccctcccaagtagctggcactacatgcgggcaccaccatgcccggctaatttttgtatttttagtagagatggggtttcaccatgtcggccaagctggtctcgaactcctgacctcaggtgatccgcacacctcggcctcccagagtgctgggattacaggtgtgagccactgcgcctggcctgtcctcaacttttaactattacatttattacttattttgccttgtatccctcactaatacaccccatccaagaaactcttcctcaaagtagtcatactgtaaaagtcttctcttgtttctacctccctcaacccaaactcccatttttctagtcaggcaaaccttgaccaaacatgagggtactaatccctaagttttcctaatagtgtttttaattttaatgtaagatttttgctttaatgaccctggaagtcagaggcttttaatatatgttcttagcagagttcttagcacattaaaaacacagcctctcaatatatgttcttagtgtggtccatggtaagtaatcaatacatttgtttaagaaactggtataattggctgggcacagtggctcacgcctataatcctaacactttggggggctgaggagggtggatcacttgagggcaggagttcaagaccagcctggccaacatggcgaaaccctgtctctactacaaatacaaaaattaactgagcatggtggcgcatgcctgtaatcccagctactcgggaggctgaggaaggagaatcgcttgaacccgggaggtggaggttgcagtgagccgaggttgcgccattgcactccagcctgtgcaacaggagggaggctccatctcaaaaaaaaaaaaaaaaaaaaaaaaaatctggtagaatttcaagcagtgaattaagattttactctttcttgaggataaaatagagtctgaatttttatcacccacatacctaaatggctcactggaaattccttcatttgctacatctgagtgttcggcatctccatgttaagttagagaataccagtatttgatttcttgtcaccaatactttggaatcatattctgagacaaacttcccgaaagtttatactgcaagattattttgaggagtattcaaggtacagttaataagttcaaacatttgtagtgagcatatgggtgatgtatactactcttctccatatataaatttgaaattttccacagtaaaaaaataaaaatacgtgtatagtgagtctgaattggccttggttactttaaaaatattcaacttgtgaactaaaagctacacactagactagaaaaacattgctggtgttagttgatgaaagttaattccctcaaatccagacaccttaatatcctttgtgtggtttactctcaaatgcatgagtgttctcttttgagataactatactgttattgtgcggctttcccatttgctaagatgcagatctgtaaattatagaccatctttaaaagcctgcagctggccaggcatggtggctcacacctgtaatcccagcactttgggaagccgaggtgagtggatcacctgaggtcagaagtttgagaccaacctgggcaacatggtgaaaccccatctctactaaaaatacaaaaattagctaggtgtggtgacacatgccagtagcctcagctactcgggactccggaggctcaggaaggagaatcgcccgggaggtggaggttgcagtgagccgagatcacgccactgcactccagcctggatgacagagcaagacggagcccaattaattgctatatactaatgagggccttgcctttcttctgctccatgctcatctttcattcttgttgtctactccactctccaaatagtattggccttgtaatttgtatgaaataaaatctcttgtattgagaatcagacctatctttttttttttttttttttttttgagacagagtctcgctctgtcacccaggctggaatgcagtggcccaatcttggctcactgcaagctctgccttccaggttcacgccattctcctgcctcagcctccggagtagctgggactgcaggcacccgccaccacgcctggctaattttttgtatttgtagtagagacacagtttcaccgtgttagccaggatggtctcgatctcctgacctcgcgatccgcctgcctcagcctcccaaagtgctgggattacaggcgacaatcagacctattttaaagattagattgaaggcaaggttggccaaaatgagatatttattagataatacttatgtttccaaataactgctagtaattaagaatatgctagaaacattacattcactcagtaatattgagagcatactacatggctgtccgtcttctgggaactggggatatggtagtacatataataggccttttacgaatttacataagtaattatgttagatggtaataagtgctatggagaaacataatgcagggtatgcatggtaaggaggaaggggtggatatttatagagaataataaaggaaggtcatcctttgataagtgacatttgaggaaaaaagtgaaggagatgagggagagccatgcttctatctgaaggaggagcaccctagaaagagctagtgcaaggggcccttgggggcaggtcatgctggttggttagcctgaagagagtaaatgtagtagaggagtaggaaatgaggtcagaatgataaataggaatgttaggggagatagaaaatgccagatcatacggatccttatgagggctatcttatctgagtaggaatggaagctgtaagtgggtttcacgcagagtagtggtatagcctatcttaaccttaaaactggcaaaagcaagtagcctagtcaggaagccaatccaggtatcagagaaagcagtgcctgtaattgtagttagtgctggtgaaagtgatgggaagtagttgaattatggatatgttttgaaaatagagcaacaggaattaccagtggcttagatgtggcatgtgagaatgatgtcaacaataaatggatttattttaaaatgtgtaatatcagttatctaaaatgttatagtttgttgcaaaatataagtaaaaatgaaaagtcttgaggatcgatatcccttaagatgtctacaggcatagtattgaatacatttgttcaagctggtttacctagtgaaggaggtcccaactagtaaggcagtttcagccatctcttgtaacagattattctttgtgatgggtatacatttgttaaataataataaggttaggatgctgatgtatagtatatacacaagcacttactattctacacaatttatttatttatttattttaattgagatagggtctcatcctgttgtccaggctctggcgcagtggtgtgatcacagctcactgtagcctcgacctctcaggctcaagggatcttcccacctcagcctcctgaatagctgggactataggcatgtgccaccatgtctggctaatttttaaaaatatttgtagagaagcgatctcactgtgttgcccaggctggtctccaactcctgggctcaagcgatcttcccaccttagcctcccaaagtgggattataggtgtgagccaccgtgcctggtgtttacacagtttcttcattagcaaaagacataactaatcttttccctctagggtaacttaagcaaaatgagagaattttctagcaaattgcaaatgttcagaagtcattctgagacagtacatttaactctttaacagatatttatagagcaataaatatcactgcaatgatattgcaatgttccaggcagtgttctagactagcagtccccagcctttttggcaccgagaccagttttgtggaagacaatttttccatgggcgggatggtttcaggatgaaactgttccacctcagagcatcaggcattagataaattctcataaggaacacacaacctagatcccttgcatgcccagttcacaaatgctgctgatcttacaggaggcagagctcaagcagtaatgctccctcccctgctgctcacctcctgctgtgtggcccagttcctaacaggccatggacgcataatggtccatggcctaggggggagttggggacccctgttctagatggtagataccaactaagaataaaaatgaaaacctcttatggaatttattattaggtaaaaaactattcatcgtttttactcaaattttcagagaccttatcaaattctgcctttttttttttttttttttttttttttgagactgagtctctgtcactcaggctggactgccgtggtgagatctcggctcactgcaacctccacttcccgggttcaggtgattctctcgcccaccatcacacttggctaattttttgtgtttttagtagaggcaagtttcaacatattggccaggctgatctcgaactcctgagctcaagtgatcccccacctcagcctcccaaagtgctgggattacaggcgtgagccaccgctcccagctaatcctgaaaatttcttataggcacaagagtcaggtgagagtagacacacaagagatgcagagatagtacagagttttgttttttgcgggggagggttttgcggaagaatggcatgataaccttcatctagcatcccttaatgttaccatcttatataaccgtggtataattatcaaaattaagaaattaacactataggctttattccaatttttccactgatatcctttttatattctaggatccaattcaggaaaataccacattgcatttcgtcatcgtctctttattctccttcattctgtgagaggtctttctgaccttaacacttttttttttttttagaggtaaggtctcactctggtgcccagactggagttcagtggcacaatcattgttcacttcagcttcccaagtagctggaactacaggtgcacaccaccacacccagctaattttttcttattttttgtagagacggtgcatatcactatgttgccctagctggtctcaaactactggcctcaagtgaatctctcacctcggcctcccaaagcactgggtttacaggtgtgagccaccacaccctaccgacactttggaagggtactgtttctcctgttctccaaaatcaccgtgacttcttttttcttaacttactctgttggttagaagtaagtcaccgaggctagctcacactcaggaagaggaagattaagttacacttcctggagggaggtatatccaaagaattcatagtcatgtaaaaccactagttcattggtcaaaacttttttttttctttttttaagacagagtctcgctctgttgccaggctggagtacagtggcatgatctcggctcactgcaacctctgcctcctgggttcaagcgattctcctgcctcggcctccctagtagctgaaactacaggcacacgccaccaagcccagctaattttttgtattttttagtagagacggggtttcactatgttggccaggatggtcttgatctcctgacctgtgatccgcctcggtctcccaaagtgctaggattacaggcgtgagccaccgcacctgtcccaaaaccaatttttaataaatattttagtggaggtactttgaggctattcagataccctgtttccccttttaaggtttcatcaactaatgtgagcttccatgggtggatcttcctttagaaattattactgtggtgttttaatggtgattttctatttctctcattctttctacatttattaattctgtaagaaaaaactattttcccctcatccgggatccatttaaacattattgattgtatttggttgtcagtgttttttatgtcctttttttttggtgggggggcagggagggcagtgtcttgctctgtcaccctggctggagtactgtggtgtaatatgagctcactgcaatgtccacctcccaagttcaagtgattcttgtgcctccccttcccaggtagctgggattacaggcatgcgccaccacacctggctgatttttgtatttattgtagtagagatgaggtttcaccatgttggccaggctggtctctaactcctggtctcaagtgaactgcctacctcggcctcccaaagtgctaggatttcaggcttgagccactgtgcccagctttctgtttcttttatttatttatatcttagaaatgaggtcttgctatgttcccaggctggactcaaactcctgggttcaagggatccacccacctcagcctctcaagtagctggggctgcgggcttgtgccaccactcccttttattcaagaacagtcatctgttgtttttgttttaggacaataattttttgaagagactgagttgtcttataaagtgtcccacatctggattcatggaattgttttatttgcctgatatcctataaacttaaatctaattttcagcttggttagatttaggttagacttttttatgtaaatatttcataggtgatactgtgtaattcatattatatatatgcagtatctcattggtcgttgcccatctataaaataattgaaaattttatcactgggtcatagtggtaacagccaaagctctcatttttaaggtaaggttttccctttgcaatttattaagtaatctatgtgataactttgacaccttgtgactatttccacaccaactgttcatgtagtagtttaagcattaattaaagatccttgcctgaaacagttatttcattagggtttacacattgttaatttaatactatctttctacatttattaactagcattctcctgtaaaggagaacttttctaaactagagctattagattacactatttagtgggagttcctacttaataggataaatgcttaattctgtctctttttcagaataaagacttggtgtagtaataactcccaatactggtaaattgctgttgggtaaatgttgctgttactttctcttttgagtaccattattttacctgatcgttaaatgtcatttgttattaagactcagcatttcttcctttgccatcttaaccttttccaaaggcttcgtgttaagcactcaatatgtgtttgttgaatggtagatggaaagaagaaattgattccacactttgtgagcatgtatgaatatttacttttctggggagaaagtccataccttgtatcaaattttctgaagggtacctgagagacaaatgagaaactaccattctggggagactgcattccctgattccagaactgataaacctctaactctgtaaaatgactagaggtaatctcatctcaaaatctcatttaaaaacttatttataaaccctttattggccgggcgcagtggctcacgcctgtaatccaaacactttgggaggccgaggcaagcagatcacgaggtcaggagatcgagaccatcctggctaacatggtgaaaccccatctctactaaaaatacaaaaaactagccgggcgtggtggcgggtgcctgtagtcccagctactcgggaggctgaggcaggagaatggcgtgaactcaggaggcggagcttgcagtgagccgagatcacgccactgcactccagcctgggcgacagagcaagactccgtctctaaataaatgaataaatagtaaaacctttattttctttttagagatagagttttgctctgtcacctgggatggagtgcagtggcataatcatagctcactgcagcctcttaactcctgggttcaagtgatcttcccacctcagcgtccgaagtagctgggaccatgccatgggacatagtgccaccatgtccgctaattttttatctttatttttattttttgtagagacgggggtctcgctgtattgactgggctgatcttgaactccttggctaaagtgatctttccaccttggcctccaaaagtgctgggattacagatgtgagccactgcccctaatctaaaccctttaaatgaagatcatcacagtcttatggtcttgtaatgcacgatttatatttttatattgataaccaactcataatctgtgatgtttctactccctttcacccctcttctactgatcagtaatgttaaatggaaggtttctcatcccactgtaagcattcaaaacaactgataatttacctataacttttcaaaaatgtgttcattgcataaccaaagtctacctaaattgaacaaataagggaaataatgttaatttaaaaattgggggtaccagcctggccaatatggtgaaaccccgtctctaccaaaaatataaaaaaattagctgggcgtggtggcgggcgcctgtagccccagctacgtgggtggctgaggcaggagaatcacttgaacctgggaggtggaggttgcaatgagccgagatcgcaccactgcactccagcctgggcgacagagagagactttgtccacaaaaaaaaaaaaaaaaaaaaaaaaaaacttgggggaacgtcaatgttcttagtagtagtaataccatagaagtagaaataattgcaatgccttttaggtttgatggtatacatttttttttttaattgagatggagtctcgctctgttgcccaagctggagtgcagtggcaccatctcggctcactgcaagttccgtctcccaggttcacgccgttctcctgcctcagcctcccgagtagccgggactacaggcgcccaccaccacgcccagctaattttttatatttttattagagacgaggtttcatcgtgttagccaggatggtcttgatctcctgacctcgtgatccgcccacctcggcctcccaaagtgctgggattacaggcatgagccaccgcacccagcctttttttttctttttaaagacagtcttgctccgtcacccaggctggagtgcagtggcgtgatcggggctcgttgcaacctctgcctcctgggttcaagcaattctcatgcctcagccgtcccccagtagctgggattacaggcaggcgccaccacgcccggctaatttttgtgtttttagtagagaaggggtttcactgtgttggccaggctggtatcaaactcctgcctcaagtgatcctctctcctcagcctcccaaagtgctgggattacaggtgtgagccacctcgcccagccattattgtataagatattttatataactaatgatgattcatttgagtgtttttaaagcttgtcttcctaaggtaagcctggaaacgtagaaacaagcaatcagtttgcaaaacgatgactaaaacagacaagcacatactagcttccccttcactagcaaggtgtaatatattttcttttttgagacatagtctcactctgttgcccaggctggagtgcagtggtgcaacctcagctaacccagcctctgcctcctgggttcaagtgattctcctgcctcagcctcccaagtagctgggtttacagatgtgcaccaccatgcctggctaatttttgtgtttttagtagagacagggtttcaccatgtttaccaggctggtctcaactcctggcctcaggtgatcttcccaccttggcttcccaaagtgctgggattacaggcgtgagccaccacacctagctaatatattttcaaataacatactttacatctgttttcaaagagattttgaagtgttggcaaacttttaaaagttactcccaaatattatagtttaaggcaaagatctgcctatttctcaagtttaatttttaatgaacaactttagaaaccgatggagaataagcaaattaaaaatggtaaatcaagggctgggcacaatgcctcatgcctgtaatctttaagattacactttgggaggccaaggcaggcagatcgcttgaacccaggagtttgagaccagctcagcaacatggtgaaacgccttctctacagaaactgtaaaaaaattagccagatatgatggcacacgcctgtggtcccagctacttgggaggctgaagtgggagaatcccttgtgcccaggaggtggagattgtagtgagccaagattgcgccactacactctagtctgggcaacccagaagaccttgtctgaaaaaaaaataaattgaggtaaattgagctgggtgtggtggttcctctagtccgttactcaggggaccaaggcagtaggtttgcttgaggccaggagtttgagagcagcctgagcaatatagccagactatttctcttaaaaaaaaaaaccgggtgcagtggctcacacctgtaatttcagcactttgggaggctgaagcaggcgggtcacctgaggtcaggagttggagaccagcctgaccaacatggagaaaccccgtctctactaaaaatacaaaattagctgggtgtggtcacgcatgcctgtaatcccagctactcggggaggctgaggcaggggaatcacttgaaccctggaggcggaggttgtggtgagccgagatcgtgccattgcactctatcctgggcaacaagagtgaaactctgtctcaaaaaaaaaaaaaggtaaattgtttctctttgtgtttcagatacgtcggtaacctttccagagatgtgacagaagctctaattctgcaactctttagccagattggaccttgtaaaaactgcaaaatgattatggatgtaagggtattttacttagttaactttattctttttttttttacacattacttaaagccattgcttggaaggaattcttagtttaccatggtctaaatatagtataaattattagtttactgtagtctaaatatagtcttagtttaccatattctaagttaatagggattttagtgaatttgtaatgaacctgttttgacagctgaatttaatttgttttattacatgatggaagatgacaatagaactagttatttctagatcagatgggaacatatatatgggctctttcaggtgcattgaggcatcagaaatgtttatatgtggtgtcaactggttggctaataaattcagctcttacaattaaattggaaaacaggtttaaaaataataggcatttggtacagtgaaagtatttttaactttatttttaaaggtcatcattcaagtttttcttgtatttaggcaattcctatttatgagacaatgtattaaacacacacacatacacacacacacacacacacacacacacactcattcatctaattggtgttaaccctgaatcataataggtataaaaagacatttagggaacatttaccccatttccctggagtctttgtctcctggttggggggaaaagactttaaatttttttttgagacggagttttgctcttgttgcccaggctggaatacaatggtgcgatctcggctcgctgcaacctccgcctcccgggttcaagcaattcttctggctcagcctcccaagtagctgggattacaggcatgcgccactacacctggctaattttgtattcttagtagagatggggtttctccatgttggtcaggctggtttagaactcccgacctcaggtgatccacctgtcttggcctcccaaagtactgggattacaggtatgagccactgtacctggcctaaattttttaatgggaaaggctatgttaaagagaaatccttttgtcccatggtctctcttttctgtaaacttttcgtttgtttgtttgtttgtttgtttgtcttgaaagacagggtcttggtatagccattgcacccagcctgctataaactttcagttttcttttctccagaaaagacaatcatgtatgtgtgtatgtgtatctgttaccttctttcctgttgtattccagttcaacttttttttacttaatatttttaaaagtaattatttagccgggcacagtggctcacacctgtaatcccagcactttgggaggccgaggcaggcagatcatgaggtcaggagttcgagactagcctgaccaacatggcgaaaccccgtctctactaaaaataccaaaattagccggacatggtggcaagcgcctgtaatcccagctactcaggaggctaaggcagtagaattgtttgaacccaggaggcgaaggttgcagtgagccgagattgcaccattgcactccagcctgggcgacagagggagactgtctcaaaaatatatatttatccaattggctttgatttgttgtcttagatcttaaaatgttgtcagacctttgttctgatgctgcaaaatcatctgcatattatatagatgaaatcaacaaagagttatgttcttttattctatcacatttaatatcggtatgcctttggataaaggagaaaaaatccatgtacccatagagaaagacaggagggaaagatggggaaagatgaagagaaatttaaaaccagtctttccttaatctagatctccttacttatcccaatggtagcatttatggaaaatttgctgcctgtcagttactttaatacattgtcataaatgctcaatagaaacataaagaaggtgttattttcatttcatgtatgaggaaatgaggcaaagcaaggctgtaaaccctaattgatttatccgaatataaatcttctctgttggtttgcctgctgctactctctctctggctggtcatatgtttccctggggaaagatcattagacaaaacgttaatgattgccttggctacagaaaaaaccaggttagcctttgccactttttatcatttgtggattctgatcgctcaaaagcttagatttttattattcaaatctaaattccagtctgttcacattctgagactaatgttcacatttataaattttatgctccctggactgataatatgtatatatgcttcgattcttatttaaaaagttagttttttctgcatataaattaagtaaagcatattctttttcatttatttactcttaaatgcaagtgactttttctttttttttttttagacagagtctcactctgttgcccaggctggagtgcaatggcatgatctcagctcactgcaaactctgcctcccaggttcaagctattctcctgcctcagcctcctaagtagctgggattacaggcatgcgccaccacacctggctagttttcgtattttcagtagagacagggtttcaccatgttggccaggtggtcttgatctcctgatgtcatgatccgcccaccccagcttcccaaagtgctgggattacaggcgtgagccaccacagccagccgcaagtgactttttctaacttcatttcagtgttgcctgtcagcattgatcttggtaatagaattcccattgtgttttattagtttgagttatataacatttttattctctaatttttttagacaaaatatagtcccaatatattaaactttgtcttggcctcgttgctttaaaatttttacaagtcattgccagtgactctcaaactattaattgttgatgtgcacagtgactgatgcctgtaatcccaacactttgggaggcagaggctggaggatcacttgagcccaggaatttgagaccagcctgggcaacataacaagaccacatctctaaaaaaaaattaattaactgtacttgaaataaaattgtatattcctctattttagtagctttctagtcttttgaattagttttttattttaacaaatctgtttaggaggctatggaaagaattttaaaatggcctataatgtcatttgatattttgcactgtaggtgtaaaaattggaatttttttctgctacttgaatttataattaaacatccaggttctatttatcacatagcctcacctacctggaacaccagcagaaaagggaagttttgtttttttttttgagacagagtctcgctgtgcgcccagactggaatccagtggcaccatcttggctcactgcaacgtccccctcctgagttcaagcgaatctcctgcctcagcctcccgagtagatgggattacaagcacacgccaccacacccagctgatttttgtatttttagtagagatgaggtttcaccattttggccaggctagtctcgaactcctgacctcaggtgatccacctgcctcatcctcccagagtgctgagattacaggcatgagctactgtgcccggccaagggaagataattttttttttttttttttttttttttttttttttgagacagagtttcactcttgttgcccaggctggagtgcaatggcgcaatctcggctcaccacaaccttcgcctccagggttcaagcgattctcctgcctcagcctcccgagtagctgggattacaggcatgcaccaccacgcccggctaattttgtatttttagtagagacagggtttcaccatgttggtcaggctggtctcaaactcctgacctcaggtgatcagcccaccttggcctcccaaagtgctgggattacaggtgtgagccatcatgcctggctgggaagataattttttttcttttttcttttttctttttttttttttttttgagacagagtctcgctctgtcgcccaggctggagtgcagtggtgcaatctcggctcactgcacactgcaagctccgtctcctgggttcacgccattctcctgccttagcctcctgagtagctgggactacaggcgcccgccaccaggcccggctaattttttgtatttttagtagagacggggtttcaccgtgctagccaggatggtgtcgatctcctgacctcatgatccgcctgcctcggcctctcgaagtgctgggattacaggcatgagccactgcgcctggcgggaagataattttttaaaggcttctgagcaagcaaaaaattgatgtcagaaagttcacattctaaaacttattctaaaattttacttaccagagaatctcttcagttttcagagcctatttacctatattttaaaacaggtttaagaaggttggctaagattttctgctactcagcaagctagtagcagcaaggagcaatgtacatttgtagcagtaaaaagtaacttataacagggaggggatagaaaaatcataaaaagccgaagtgagacttcagaacttaggagttcagtcaaacttaatctgtgtagcttgaacaaatggttatatgatgatggggtatgtgtagctatatatccagttaggatacctagtcattaatattaaattatagtactatagtataacctgttgaagaaaatagctatgtataaaagcagtgtgattttaagtgtttgcttttttttttttactttttaattattttagagacaggatcttgctgtgttgcccaggctggattcaaactcctgggctcaagcattcctcccacctcagcctcctaaagtagctgggactacaggagctggctgtttacttttttgtttgtttgtttttgagacggagtcttgctctgtcgcccaggctggagtgcagtggcgcagtctcagcttactgcaacctccacctcccgggttcaagcaattctcctgcctcagcctcccgagtaggtgggattacaggagcctgccaccatgcctggttaatttttgtatttttttttaatagagacagggtttcaccacgttggccaagttggtctcaaactgctgacctcatgatccacctgccttggcctcccaaagtgctgggattacaggtgtgagccacctcacccagcctacttttttaaatctaaaatttacttgtggaatagaccattcattctccatggcctgataacttagatgtataaaacttggtttaagatttttttttttacataattttaaggtaatgggtgaataaagcttaaaattggcttttgtgtttcttctcccacagacagctggaaatgatccctattgttttgtggagtttcatgagcatcgtcatgcagctgcagcattagctgctatgaatggacggaagataatgggtaaggtaagctgtcgtaattaaagaaggtgacttgcactgaaaaaatttaagttatatatgattttgtttcctttttagaaacattaaacactttttttttttttttgagatgaaattttgcccttgttgcccaatctggagtgcaatggcacagtcttggctcactgcaacctctgcctcctgggttcaagtgattctcctgcctcagcctccctagtagctgggattacaggaacgcaccaccacacccagctaatttttcgtatttttagtagaaatgaggtttcaccatgttagccagactggtctcaaactcctgacctcaggtgatctgcctgcctcggcttcgcaaagtgttgggattatagatgtgagccaccgcgcctggctgaaacattaaacactttatagcaaaaggtcagttattgacatataatattaaaaaggtaggataaagcttttagagggcagaggcttgtgtttatgttagtattttcttttctttttttttttttttgagttgggtctttctctgttgcccaggctggagtgcagcggcgcgatctcagctcactgcaagctctgccttccgggttcatgccattctcctgcctcagcctctggagtagctgggactacaggcgcccgccaccacgcctgactaattttttgtatttttagtagaaacagggtttcaccgtgttggccaggatggtctcagtcgcctgacctcatgatccgatctgcccgtctcggcctcccaaagtgctgcgattacaggcgtgagccaccgtccccaggtttttttgttttttttttttgagatggaatcttgctttgtcacccaggctggagtgcagtggcaccatcttggctcactgcaacctctgcctcatgggttcaagcaattcttctgcttcagcctcctgggtagctgggatgacaggcacccaccatcatgcccagctaatttttgtatttttgtagagacagggtttcactctgatggccaggctggtcttgaactcctgacctcaggtgatccgcctgtcttggcctccgaaagtgctgagattacagacgtcagccagcagcctatgttagtattttccatggtggattgtacatggtaaataacaaaatatttgctgaattactcaagcttggatgctaatggaaaagaatgaaaggaaaaaaaataatatgggtactttaggtaggaaaggttaattgaatgataacagacacataaagattaggatttgtcaacattatttgcctaaatgtaggtcagaagattaagtgttgaaacttgaccagagctggtatctccttcagtgtttcatcttaaacagatatcttcctatgtgtttatagatacaaatgtgattttgggctttatttttgtgaagtataaatgtagaaattttttttttttaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatttgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcgtaagtaacagaagataaataaaatccttttaattagaaacaattatatgtagacataacttgaaaataattctgttgtgaattttgtacattaattttataacttgaatataatgtattacattgtttagagatcattcaagaagttaacagcaaaagattgttttcccattgatgaataaacctttggttttcaattatcttaaaatcctttttcaattagcatagctcttaagagacaaatttgccattgtacatgttttactttcttatataggtatcaagctagcttggtgacaatctttagtaaaattgtgctgtaactaaggaatttagatctgttgggtacttctatgataccatgcattttgtgttaatatattttaacaaaaagaaaccttaacaattcaacttaaaaagcagttattgaatattattttctagatatttacacccttttaaaaaaactgctaacaataatagtgccttaataatattttatgaagcactgccttgcttgcacttgttattagtcatacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccctagtttatattcccatggtagtttaaaagtagctaataaaatactgtgaggaggccggacgcagtggctcacacctgtaatcccaacactttgggaggctgaggcgggtggatcacctgaggtcaggactttgagaacagccaggtcaacctggtgaaaccctgtttctactaaaaatacaaaaattatccgggcgtggtggcaggcgcctgtagtcccagctactcgggaagctgaggcaggaggatcacttgaacccaggaggcacaggttgcagtgagccgagatcatgccacagcacagcctgggcgacagagtgagaccctgtctcaaaaaataaataaataaataaaaatactgtgatggataggaactttttaaaaaattaaatattacccgggcacagtggtttatgcctataacctcagcactttgggaggctgagaagtttgagataaatactggcaatatagtgggaccctatctctacaaaatatatatattttttattttactttttttttaatttttttttttccgggaattccgaaaattcagccgagcccagtggctcacacctgtaatcccagcactttgggatgccaaggtgggcggatcacttgaggtcaggagttcaagaccaacctggacaacatggcaaaaccccatctctacaaaaaattagccaggcatggcgacacatgcctgtagtcccagctacttgcagggctgaggcgggaggatcacttaaatccaggaggccaaagctgcagtgagtcatgatcaagccactgtactccagcctgggtgacaaagtgaggccctgtctcaagaaaaaaaaagttgaaaattgtaaagtacattgagaggtgaaaacaatacaagctcaatcatgtacatgtcccatctaccaaagattttttttttcctgtaagatgagaaaataaaaattaagagaatttatttggttctcaaaactttactattaagcatagcataatgttttagaaaggtagaaaaataccttctataatggattgatagccgtgattaatttgagttccttagaggattgattcataggttttaggatgttttagtgcaagttagggaaataaattggcggtttgatgggctaggaactcatttttcacattttcgagattgtggactgtagggttctgctatataaaaatcactgttgaatgtgtatttagtatgaactagagtcaaatagcaaaggatgtctcttgataacctgtgtatggcctctggagttagccagagatgtatacaaattctgacaaccattataaaacagatgtaactttgagtaaataatataattttttttttgagacggagtttcgctctgttgcccaggctggagcgcaatggcgcaatttcggctcactgcaacctccatctcctgggttcaagcaattcttctgcctcagcctcccaagtagctgggattacaggtgccgccaccatgcacggctaattttttgtatttttagtagagacaggatttcactatgttggccaggctggtctcaaactcctgaccttgtgatccacctgcctcggcctcccagagtgctgggattacaggcgtgagccactgcgcccggcagtaaataatataatcttctataaaatcttctataaatttaaatctataaatttcaacttatgtaaaatttgtgatacgtgcttggctctgttacgcagtgctacagccctgattgcaattacccccagcctctcttcctatgttctacatgctaggaagaccacaatactgattgagcttagcttctctgcctaccccaaaataactgaatgttcctggaaaaaaactgagttcaggtggttttgcttctaatttaatggtcacacactttaggtgagtacagagtactgtcttggcaaacatgtgtttctcatctttcaaccaccaaacttacataaaattcatccaccttcccattcttcctattatagtacaggaaaggtccttcctgtcaaaggcaaaatcacttatgattgtgtccccatctctcttgccttttcaaggactttgagcctatgctgccactgcttcattgttttttttttgtttgtttgttttgttttgtttttgttttaacagcagctttattgagatataattcaagtatacagtgtggccgggcacagtggctcacacctgtaatcccagcactttgggagactaaggcaggcagattacttgagcctaggaatttgagagcagcctgggcaaaatggcaaaaccccttctctacaaaaaatgagccaggcatggtggcacacacctgtagtcccagttacttgagaggcagaggtgggggaatcacctgagcccaggaagttgaggatccagtgagctgagattgcaccactgcactccagcctggacgacagagaccctgtctcaaaaaaaaaaattttttttttaaagtatacaattcagtggtttctaggtaattcacagaattgtgcaactattaccaaaataaattttagaatatttttaccaccccaaaaagaagctacatgactcattagcagtcactatcctcctttcatgcccctcctgccagccctgaacaattgtcaatctactttctgtctctgtagatttccctgttctcaacatttcctataaatggaatcataatgtgctgttcttgttattactgctattctgtgtcatcactctattccttctctactggatcattctcatcaacctaggatctctcttttttttttggagagagggtctcactctgtcactcaggctggagtgcagtggtgtgatcatagctcactgcagcctcgaactcctggcctcaatccatcctcctgcctcagcctccagagtagctgggaccacaggtgtacaccaccatgcccacctaatttttttttaaaaaaaggccaggcatggtggctcacacttgtaatcccagcactttgggtggccgaggcaagcagatcatgaggtcagaagttcgagaccagcctgaccaacatggtgaaaccccgtctctactaaaaatagaaaaattagccaggcatggtggcacacgcctgtaatcacggctactcaggaggctgaggcaggagaatcgcttgaacctgggaggcaaaggttgcagtgagctgagattatgccactgcactccagcctgggcaacagagtgagactccgtctcaaaaatatatatatatatttttttgtaggaacaatctcactttgttgcccagtctggcctcgaactcctggcttccaccagtccgcccgccttggcctcccaaagtggtggggttataggcatgaggcaccgttcctggccatctagtatctcttaatcaaaaccactgtttatcctcacatcccttccctaactgtatccccatttcttggctataattctcaagagttgtttgcatatgcttctactttatctcccattcacaaccaccaacatagatacatctctgttttttttccacttttttgagtgagtagttttatttttttcctgaggagctgtatcaaagtatcataaactggatggcttagagcaacaaaaatttattttctcaatgttttggaggcgtgaaattcacaatcaaggtgtcagcatgtccatgctcttttgaaggctctgtagaagaatcctttgttgcttcttccaagcttctggtggttgctggtaattcttggcattcattggcttgtagctgtataactccaatctctgccttcatcttcacatgaccatcttctctctttgtgtatccatataatcatcatctttttttttcgagacaggacctcactctgtcacccaggctggagtgtggtggcacaatcacaactcactgcagccttgacctcccaggcttaggtgatctttccatcacaacctcctaagtagctgggactacaggtgttgcaacaccatgcccagctaatttttctattttttgtagagacaggattttgtcatgttgtccaggctggtctcgaactcctgggctcatgatccacctgcctcggcctcccaagtgctgggattataagtgtgagccaccgtgcccagtctgatctttacttcttatgaggacttgagtcattggatttggggcccaccttaatccagtataacctcatcttaattacttcggcaaagaccctgtttccaaataaggccatatttcacagataccagggtataggacttcatatcgttttgagggacacaattcaacacataacattagttaagcgtctcatggagttcggactggttggggtgataatatttgtttctttttaagaatgtgcatttcctgccaggcacagtggctcattcctgtaataacagaactttgggaggccaaggcaggaggaggactgcttgagcccaggagttagaaaccagcctgggcaacagcaagaccctgtctccattaaaaaaaaaaaaaaaaaaaagcctggcgacctagtctgtggaccccgaatccctcccattgcctgttgcaaccagtaaaggctgttcctaccatagtaaagaaattaaaaaaataaaaaaaacagccaaccttgttggtgcatgcttatagtcctagctactaggaggctgaggtgggagtatcacttgagcccaaggagttcaaggctacagtaagctgtgatcatgcctggatgacagaataagaccctatttaatttttttttaaagcatttcgttttcatatttcaagaaaggccttgaatttgcctgttccttcagtagtagattaagcttacctttgatgtgtgcacacaaaagttacactccatttactttttagtctactctaagctggttttactctcactttgtaccaatgctactctattttcaaggtcacctcttaacctctgttttcttggctccctggaccatacacttttgtggctttcttccttcatcactggctactcctccctagtcaccttagctagtgattattcctttacccatttttcaagttttgctgtttttcagggctctgtcctaggctctttctctagtctgcatgaattttgtatcttcagtctacttctctgcgttccacatttattaacaaatggtcttcatttatatgtctcacaggcatctcaaagttttttcttaatggagctttttgtttcttcctcagacctgttccccttttctttcctagtctttctccgcatttcaataaatgctgtctttccaatttctctagaggaacctaagagttatcttttctctccttttgcttgtggtgtcccctccagcccccattattttggccttgagtttaagttacattcactgctactgcaatgctcctggccaccaacactttttaaaaatctagaatattgcacaagtttcataaagtatctttatccccttactacccattatcctaagccattctcctcttagcgctaagaatggccttcttgccgggtgcggtggctcacgcctgtaatcccagcactttgggaagccaaggcaggcggatcacgaggtcaggagatggagaccatcctgtctaacacggtgaaaccctgtctctactaaaaaagaaaccctgtctctactaaaaaatacaaaaaaaaattagccgggcttggtggctggcacctgtacaggagaatggcaggaacccaggaggcggagcttgcagtgagccaagaacgcgccactgcactccagcctgggagacagagcaagactccatctcgaaaaaaagaatggccttcttaaaacataggtcatgatgattccttgcttaaaatctttcagtttcattctctgacattcttttttgctcgctggattccactgaaactagtctttcacatgctgctttcagatgcataccaaacttttgtgccttaacacactttgcaatacttttctctctactggggctttcttcctcattgttttgacttggctatctcctattgctgtcaggcttagtttaaatgtcatttcagagagacctttcttattcatcctgtctgtagtagatccttgtgcccatattctctatctcagccttttgtttctgtcataggtcttaccacaatatgtaattgctttatttgttccccacaaaagaatgtaagagaccatgtatgcttgtttaccagtgtgtccctagctcttaaccgcatgcctggaacataactgttcaatatttatttgttggatgaatgagaaaccaaatattgttaacaagcttgttagattgtttaagattttcttctatagtagtctgagttgcatgaactttatgatatctacctcattagggctgtcgggctcacgaccttttcagatgattaatgttcccaaaatttaatattcaaataagagaaaaacaatacaaaagcaccattgggttgagcatggtggctcatgcctgtaatcctagcactttgggaagctgaggtggacagatcacttgaggtcagaagtttgagaccagggccgggcacagtggctcacgcctgtaatcccagcactttgagaggccgagttgggaggatcacgaggtcaggagatcgagaccatcctggctaacatggcgaaaccgtgtctctactaaaaatacaaaaaatgagccaggcgtggtggcaggtgcccgtagtcccagctacttgggaggctgaggcaggagaatggcgtgaacctgggaggcagagcttgcagtgagccgagatcacgccattacactccagcctgggccacagagcgagacttaaaaaagaaaaaaaaaagaagaagaagttcgagaccagcctggccaatatggcgaaaccccatctctactacaaatacaaaaattagccaggcatggtggcagatgcctgtaatccccgctactcaggaggctgaggcaggagaatcgcttgaacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggaggctgaggcaggagaatcacttgaacccaggaggtggaggttgcagtgagccaagatcacaatcactgcactccagcatgggcaacagagccagacaccatctcaaaaaaaaaaaattgaaatttctctagcatccagcgtatttgcctctgtgattttatagctccctccctaacacaaggccagtgaaacacacattctttgttaacacaagttgccccagaactacaagatctttgaaaaaaatagcaaagaaaatatgccatgttacgcaaactgttttacctcagactcaccttgatttttaaaaataggttttattcataaatatttaaaagaatttgtattggtgattcttaatattgttttcaataggttcaattcccatgaaagtgcagcacatgcaattgtttctgttaatggtactaccattgaaggtcatgttgtgaaatgctattggggcaaagaaactcttgatatgataaatcccgtgcaacaggtgagagggttcttaactttgagaagtaattgttgggctaataatgttattttaaggtgaagattgttgataatccttgttaataagtttctagctaaaatgatagtatataagggctcttcctacatgtattatagttccagaatggtgtttcatggattgcagtggtgacatgatgaatgtgaccgcctcaattgactcatgctcacacagtggattttaaaatgctccgagaaacctaaaagggtattacatctttttttaatacttggtagatttattcacataccatttggagaactcacaagcatgcttgactcaactgaaacaaaaataaagctgtaaatatagttatggccttggcatttttcttccagattttgctgccttttttttccaggcagctttagtggttcaaacttgattccacaaagatttctatgaggaaactgtaaatggagcacagagatgggagtaagcaaatcctaaactatataagtgtcttaagtaagctgaatatagaaataattaatcacatcttccctatctaaaggaaacaatcatgtagatagtataccaaacacttaaacattctactaagtttaacatttattactagggtatcaactgatgccttccaaaaactatgccattcagagtatcacgtagagttacagcagtataacctcacttgttttgttgttgttttttgttttttttttttttttttttttttttagcagtcaactcttgtttatcctgtcattttaattgtaatgatggccctgtgtgttttggctaagaatttgtggtatcagcatattaggattgtatatatatagttaacttcaagtaatactaaattttatttaatagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaagtaagcatatcttatgtcttcctttactaacctttgaaaatgtctaaagaaattttaagtaggaagaaattttaagaattagtgggtaatagggcctcttatgtaaagcgtaactatagccttgaaagaacttaaaattgttttttagtaagaaaataagagcttaatagttgttaagcttttcacatgactaatggtcacttagccattcttatatacactgagtttgatgctagttgttgtattcattatgcttttttctgtacaaagggttttttcaatatgccttgttacattgcaagcttccttatacaccctgaattacactattttacttacatttctgaaaaacacactggaaataaaaatacttgagaggttaaaaaggaatttagtgggctgggcgtggtagttcctgcctgtaatcccagcattttgggaggctgaagtgggtggatcacttgaggccaggagtttgcgaccagcctggccaacatggcgaaaccccacctctgctaaaaatacaaaaattagccaggtgtagtggtgcacaccagtagttccagctatttgggaggccgaggcaggagaatcacttgaacctgggaggcggaggttgcagtgagctgagactacaccactgcactccagcctgggcagcagagcaagactctgtctcaaaaaaaaaaaaggattttgtggttgggcatggtggctcatgcctataatcctagcactttggaaggccaaggcaggcggatcacttgagtccaggagtttaagatcagcctgggcaacatggcgaaatctcatctctacaaaaggtacaaaaaaaattagccaggcatggtggttgcgtgcctataatcccagatgttcgggagactgaggtaggagaatcgcttgagcctggggagacgtaggttgcagtgagctgagatcataccactgtactccagcctgggtgacacaatgaaaacctgtcttaaaaaaaaaaaaaaaagaaaagaaaagaaaatcttgtaatgttatgaatttttatgagctttcatatgctaataattgttttgatttcttctttgagtagtataatgttcctttttcgttgtagggaacctacctgactctttcaggtagtggtttcctcagcaaatatgttcaaccaaggcatagagatgagatggatagctttcttttccaagaatggggttaggtttttctatattcaaaggagatgaatgttgataagttcagggtattttcttagctttaatttctaacaaaattaaactgtccaaattaaacatacagggatgcttgtttttaagagaaaaaaactttagtaaaagatttcattttccctagcataaattattctatttgggattaagaaaaagtatgtttcccatttcccatatttgttcttgttgtttgttcttgccaatactttattttaatcagtggatttcctctcccctctgcttctttcacattctccaccagtcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttg

SEQ ID NO: 35878 - DNA, 11010 bp, Homo sapiens
ggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgtaggtgccctcccgccctgctcctgccctcttactgtgttaacgattctccacgtgaggagcgtttcttttccagtgttgggtagaggcgtctgtcggtggggttatttggacagttctttagcttttcaggagcatctgccttgaacctgtaccgttttgggttggagacatgcagacattggaaactccgtctccccttttctgttacacgcttgtggagtaactctaaactttctgaaaatacgatcattatatttgcaacaatactgttttggctgccgtattgaaaggaaccgtttaggggaaatgtatgtttaccctcagctagcgtgttggctaggataaagcagccctcctttaatttccagacacaggagtttagtgaccacttgcttttttatgctgttttttggtttgtttaccatgaatagttgagcccagtgcatatcccgagcataaactgaacacttgcttgtagaaataagaatgttgaaaccctttcaaaagttctagtttttaaacggttcaaaactattttataggatccaacgcatgcctggagtggaggactagatcatcaattgaaaatgcatgatttgaacactgatcaaggtaatgtgaccatatctttaccagtttgttttcttggctagtgttcttaagtataaatgtttatgtaggaagagtggttcctaaattgcttagttactaagttgcttaagtacaggtggcttgaatttaggatttttttaatttaaatgataaccattaagttactgattacagaatattatgcatgtatttttgcagtaaagccagttatggtcgccattgtcagtgtttacataaattgacactcaagtatttggcctttattttgtccttagaagtgggctggatcccagactggccagcgtttcattaggattttccactacaatgctgatgttttgagagttcagtttttagaagctaatttagttttcagaagctaaaggtagatttaaaacctgacaaaaaataggcaatcatgtctatattaattgtgtttgttttaggtatttagcaaaatatgtttccgttgcattttttgaatgagtaactagatgatacatttcctttcggttaagtaatttcttagagatccagatatgaaatgacttactcaaatttttttggtgacattggcacagtgttagagattggactggagcccaaatgcatagagctctctagctgaacatttgtttgcatgtgtattcatcagacataggtattctaaggagataggagggtacagagatatgactagagagaagatgagttgagcaacaggagaatggatggaggatggccacattttgtcaaaaaactaagcacccaattagaagaggcttttgcatgaaagctacttcttctgtaacttatactgcaggtattgggttttgtttgccagtagcttaccctgtgtaataagtaagcttgtaagtctaggttctatttgttcagaaacttgtaggggtagggagaaacactgaaaagcaaacgtctcgattttcagtgttacatagagaattagctgtttattctatgaaagtcactgccaaacttcatgaaatcctttctttttctttcttgtttttttttttgagctagagtctcactctgttgaccaggctggagtgcagtggtgtgatcttggctcaccacagcctccgccacccgcattcaggcaattctgcctcagcctcccgagtagctgggactacaggtgtgcgccaccatgctcggctaatttttgtattttttagtagaggcggggtttcactgtgttgtccaggatggtcttgaactcctgatctcgtgatccgcccaccttggcctcccaaaatgctggggctaatcttactgtttgcaggtcaggaccatatattgttcattcctatatccttagcagttggcacagattctggtacatagtagatgttagttgaaggaataaatgagatatagtgagaaggttcaaattgaaaagaaaatgtctattgaaaatttgaaccacagtggaaccaagtgcagtaatgagaggacttcactcccagttctcataaccctttagccatgtaaataagtttcttagcagcattggcttaatgttcaacataaatgttgttgatccagaagaccagagttctccattcatttgtttattcaacagatatttcttgagcacctagcctgtaccagaccttgcactagatacgggcagagatcacagaggtaaacgcagttcctgataggaaatctagaatcaagtgaggaagataacagacatgccactatgttaatgtaatctgaaattcaagacagcctttggtatgtgcaatactagtgagtcatgtgaagtgtgcactgtaaggtgaacagagaggaacggataactttgtagtcatggagagatttttctgtctgtagtagacatttccatggggttggatgaggcaaattcattacagttgaatgaatgtttcttttaattgtttattttaggaatctttagtaaaggtagtaagctagatgttggggttttttcccctttttttttctctatagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtaggctctttatattcattgcaggagttgatggttttggggtgatttttgtcttggtgcatgattgttgactatgcttgttgaatttaaaggtgaaaagtcaacatggggggaaaaaaggttgacagttggttttataaatccaactacatagaaatgctttaatgcaaaagaaaattaactttgggattttgggccaacttttatttgtcagttgttatatttgcttccatgtattgttaatgctttaaatcgcaaaattgagaagcaactcactgccttttcagagaagtcatttagcagactgttcgattgtcttaaattgacgctccatcccaaaccagaagattggatggagcatcacttattttcatttgttatctgaggtttctttgggttgactgttgagagggcaaaatgggttatcatttcaagttcagtaagaaaggtgttttatgttccctggcttgtactgttcgtatatttattttttaatactgacagatgtagtttcaaggcaccttagtgaacaaagctttttaaaaccaaaactttgtgtattattctaaccttttgatctgtatgataaaagtgtaattgagctttccttctgtatcctcatcagactttatcaggtggtagttaattttaaagattgattgtttaagcagtttaaaggtatccctcacttgagtctatttcctcagcgtgaatatactattcaattcctgttagccatcattatttacaatagtgcatccaaagagccattatttttgtcacatcacagtcgaatctactcctggcaagacctttgttcagaataaaataattgcattgtttctagttttgatttatggttgtatgtaacatgttaagaactgtgataaattgctgacagaatatcatataatggacagccacactgaatcaagctgcttattggttcagcaaggttcattatgtcactttttttaatactttctttgataaatgtatatacctagtcagtagcatgacagtggtttcacttgatttatgatcagtggggatagaaagcactattagaagcttgtgtgtcacctatatagtaaagatttaagataaaattcccagtatgattgtaccattataaatcgatctctttctggattctttatttttaaagtttggtactttatacatcttaattttcattttactgcaaacattttgttttctgagtaagctatgataaatcttaacatttctgacatttatatctgcttatattaaatctattgttttgaatcttaattttaattccttatttttcccttggtcacattaattgttgaattttaaggccagattctagagaggggtgggacatggcgttgttaaagctaacttggttcttcagctgatggtatgtggttaacatactagtgattattaacatatggcttaagtactgaatgttgaagagacatcatcttaccttgccatggggcctctctgcattttttatggcagttcttcaggtttgaaaatgctaagtcagattagagtttcttattaattgaaaataatagagcacagttgtgaatcgcaagtctagatttttaaaaagtgactgaacatgatcaggagaatatttttttgccacctttttaatgagttggctacctctgttttgtttccaagtaacactatatttgcaaataaaccactaaatgtttgcttgtaggaaattctatggtttattataaaggaatttttgtggaaagtttaatattgaagaaagacattataaggggaaaaataggggatacactacttttaaaaattttccctaatgttgaacttctatcttgaatgcatagtattacatcagggcacaagaattgctttgtcatatgtcagaccactatcttgtcttttaattttgagtttgtatgccaccaaaggctgctaaacatctaattagtggtggctccctcacccttcctggaaaggcctatttattccatgtaacaactggggaaaaaaaatcaagatttttagagttgcaaaatgaaatattctaaaaggtggttttagaaaaatagttttgaaaatgattgttttatgaaaagccagaaacccattaagctctaccttgaattattttatggctctattatctcatttttgaatttttttttacacttttatgttgtctctaaatgaaacatgaaggctaggaaaaatagtttaatttgttttagtaatggagagaattaagacttcaaaagctcctttacagaattacttagaatgtacattatatgatgcttggtgaagtatggagagcatcatgggtttgctattttatgtgaattacttggtttgaataattgcagtatctaaaattgttatctgtgattggggaattcagtcagctaattttttatggtcttatgatcagatggactttattttggggcaaaatgccattttcaggcaagaaggtgatttttagcaagttttgatcttttttaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcaggtattgaactatacctcctcttctttctggaatttgaaaataatatgatcttatattataatgatttggccactagcccctaaagccttctttttttttttcagtagtgatttagaatttgctgttaggtgtattcttccttgatatttttgacagccatgtgttaacaggaagtgcgttaacccccattttagagacgaccttgatgttcagagagaccaagtaatctgctcaggaagtggtttgaatagaggaggttttctgaccttttgttgatcctggtccaggatgcttcataggtatacagtaatcaaagagcgctttgcagatatttcagtttacaaaatgctgaattaaaatttatatctggattttaagcttatggaatttgctgttttctttttgcctttttgtaaccctaatgcttatggagttctttccccagtttgacaatagaactttgatagtttttttttttcttaaactcaactgagattagagaggcagggcccctcttatgactgactcttgatgtacagggtgggtcaccttccatcatcgctaaatgatattagcctgtttattagtgagctccctcctccctcaagtccttaaagttctaagaggagatggtggtgtggtcaggtgcaataggaattttgcaagaggaaaagtcattaaaaacagaaggtgtctctggtatcttatggctgtcctttggtggttgtagaacttgaagcaggtatgttattctctttgctttttaacctgcaaaggccagtacctcaaatggtgatcacagttcctttttttttaggaaattgtaagtttccatcgaagataaagaattgcagttatgtgaaacttcagagatttagatatgtgattaaaatatgcttacattgtgaacattattttaatgccattatatctaatattttatataggattatttctactttgtaatggaagttaaaaagtaggattttactgacttatatatttcttcataaacagttttcaggaataaatctttttcataccttgaaggattaaaaaatcatagatttcatatttggtgtgttagctcttattttttaagatactgtcatttcaacgaaagatgaaaaaacgtttaaaattgtaaaccacttttgaatgtccctgaaagtctttgtgcaaacctgacttgctgtattaaatgcaagaagtagtatgactgagatggaagactggtgttctagttgatttggattattgatgcccccaatgaaggaaacacaattcttaacagttgttcgcgatgaagaggcacagaacatagaagaatatattttaactgagggaacaaatttgagtctgctgggcaggacaacaaataagcgacactaaaacactttaaatttttgtttaggtttgatgcagtaactagatattttttattgtaatgtgcaaggccctggtacctgtgaggaaagcatgtgatgagtcttattttctttttaaagtcgtcataaccatgttagtacagcctaaacacttcattaaagcctgctgtacttctcatttctgaaataatcactctttagtgtgggttgaatttgggaattagcaccttgtttttggaagctggaatttaccatttttttcctctggttctctcttggcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtaaagtatggcatgctgacctatatttaattattatactatttggtgcttgctttttatggtatttagtgaaaaaaaatctgtacagtgctttagggaaatgtaacttctatgaccttaaaaattaactgttaagagaatggttatttctgtatctggtgttaagaaccattttaactgttttgaaattacttccaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttg

SEQ ID NO: 35879 - DNA, 22027 bp, Homo sapiens
gttggtgagcatcatggcaaccgttgtaagtgtgggtgcatggagggtgaggagcgagctagcagtctcgagtttgagagaggaggatgctggaggccctgactcctgggtctgagggaggggggatctgggggttcagactcctgggtctgaaagaggaggaagctcggccacccagatctgggggagaaggggacatgggggctggacttctggatctgaggcggggagggggctgggatcccagaatctcgggtctggccccatcatgctataggaactccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtacctgttcagtgtgtctgagagcgcgagggcgcctagtgagcctttagtgggaagaaattgtcgaggaacaagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaaggtaatgtgacctgaacttagggactgggctgggcttacaggtgcctcaatttccatgatgagcccagtcaagatggaggaagggagggggagaaagttgttggtagctggggatgagatttgagtctgttgctgtcaccagggcaaggaggaggaggaggtggatagggaagtagaagaggaaggctatgaccagaactaccgtggagaaagtattggaagtatgaggggacggtgtgtgctgagttttgaaatgaccttggttttcatgggaacagcgggcagcaaggttttggagagacttatgatgaaagagaaagtctttataggagacagtccttggtaaggggcctgtttatgttgagagagctacatttgggattcctggattcatgtcttttttgtggggtggggatgcctagtcttctgcttgtagtctgggggtaatgttctatgctcctgggttccagcttcctataggagacggtaggtgggaaggttcacacagtgacagggaaagcttgtgaccattgatggccagaaagtctaaacgattggctccagagggaggaggcttcctctgggctggataactgcatgtcctctctaggggaagaagagaagaaagacctgtgggctgggcacagtggctcacgcctgtaatcccacactttgggagtccgaggtagaaggattgcttgagcccaggaatttaagactagccctggcaacatagcgaaaccctgtctctacaaaaaaataagaaaattaggccgggtgcggtggctcacacctgtaatcccagcactttggggggtcgaggcgggcaggtcatgaggtcaggagtttgagagcagcctggctaatatggtgaaaccccgtctttattaaaaatacaaaaaaaattagccgggcgtggtggcacatgcctgtagtcccaactactctggaggctgaggcaggagaattgcttgaacccgggaggcgaaggttgcagtgagccgagatcgcgccactgcactccagcctgggtgacagagtaaggctgtgtctcaaaaaaaaaaaaaaaagaaaagaaaagagaagaaaattagccaagtgtggtgggacacacctgtagtcccaactacttgggagactaaggtgggaggattgcttgagcctgggaggtggaggccacagcagtccagcctgggggacaaaatgagatcttatctcaaaaaaaaaaacacaaacctgtgggaaggaaggagacctggggatgggtggcctcggttagcatgctagcttcttaggcttccttttccttattagaaattatgaactattccaaagtgtcagaaaataatgtaacagacatgcaaagatccaccatccaggattgtttttttgttttttctttttttcaagacagagtctcactctgtctcccaggctggagtgcagtggtgtgatcttggctccctgcagcctctgcctctctcccatgttcaaatgatcctcctgcctcagcctcctgagtagctgggactacaggtgcgcgtcaccacgcccagctaatttttgtatctgtgtgtgtgtgtgtgtgtgtgtgtgtgtgtgtgtgtgttagtgatagagtcttgctctgatgcccaggctggagtgcagtggcgcgatctctgctcgctacaacctccgcctcctgggttcaagcaattctcctgcctcagcctcccaagtacctgggattacaggcacctgccaccacgcctggctaattttttgtatttttagtgtagactgggtttcaccatgttggccaggctagtctcgaactcctgacctcaagtgatccacctgccttgacctcccaaagtgctgggattacgggcgtgagccaccgtgcctgacctaatttttgtatttttagtagagacagggtttcaccatgttggccaggctggtctcgaacccctgacctcaagtgatttgcctgcttcagcctcccaaagtgctggtattacaggtgggagccactacgcccagcctgttgttttttttttttcttaatagctttattgagatagaattcacgtactacataattcacccatttaaagtatacagctcagtgttttctagtatattcacagacttgtgcagccatttccacagtcaattttagaacattgtcgtcaccccaaaaagaaaccccatgcctcttacctgtcaccgctaatccttccatacctcccatcttcagttctaggcagccactaatctttctctgtatatggatttgcctattgtggctacttcatatagatggaatcataccatatgtgtctttcgtgtgtggcttctttcagtcagtataatgttttcaaagttcatccacgttgtagcatgtatcagaactccattcctggccgggcgcggtggctcacgcctataaccccaacgctttggggtgccaaggcaggtggatcacctgaggtcaggagttcaagaccagcctggccaacatggtgaaaccccatctctactaaaaaatacaaaaaaatattagccaggtgtggtggcggacacctgtaatcccagctactcgggaggctgaggcagaagaatcacttgaacccaggaagcagaggttgtagtgagccaagattgcgccattgcactccagcctaggtgacagagtgagactatgtctcaaaaaaaaaaaaaaaagaaaagaaaaaagaactccattcctttttatgactgaataatattcctttgcacaaatagaccctgttttattttgccattcatcagctgatggacatgtgggttgtttctatcttttggctgttgtgaatagtgctgccgtgaacactcgtgtccatgttttgtgtggacctctgggggggtcctgaattgtcccgggtggtgtttactcacctccctcccccatgtgagaaggggtggtagctggctcctctctgtggagaactgtcaacatgggaagcctcggtatattcttgttgaatgagctcagcactttagagtatcacttagcaaaccacagacattgagtcccgaggtgaacaagagagaacaggccgtgcccttcatgggactcatgtccactggagcagagaatattgatccatccatctccctcgggaatgtgagatcacacagggagatcgggctcccagggaggcctttcatctgtctgaatgtctagaggtcctagaactagcctggcagggctgttggacagaaagggcctcccctagggggcagcacttgatctaattcagtgagagggcagggagagcagtctggactcaggggccagcatgtgcaaggcctggtggttgagaactggggccgcctggtacaagggatgctgggaaattagcaggggccagagcatgtccagctccatgcctgctcctcattggtgtctgtccttatggagctcacagttattagaaatggggaggacttgtctgggcacggtggttcacacctgtaatcccagcactttgggaggccttggtgggcagatcacttgaggtcaggagttcgagaccagcctggccaaccccagtagagatgggcgaaaccccatctctattaaaaatacaaaaaaaattagccaagtgtggtggtgtgcgcctgtagtcccagctactcaggaggctgaggcgggagaatcggttaaacccaggaggcggaggttgcaatgagctgagatcgggccactgcactccaacctgggcgacagagcagactccgtctcaaaaaataagaaaaaaaaaaaagaaatggggaggacttagccgggcacagtggctcacgcccataatcccagcactctgggaggccaaggctggtgtatcacttgaggccaggagtttgagaccagcctggccaacatggcaaaaccccatctctactaaaaatacaaaaattagccgggtgtgttgatgcgcgcctgtaatcccagctagtcaggaggctgaggcagagaatttcttgaacccaggaggcggaggttgcagtgagccgagattgggccactgcactccagcctgggtgacagagcgagacttcatctcaaaaaaaaaaaaagaaacagggaggatttcattcattcaccaaataaccaaatatgtgctggaccctgaggaccaagctgtcgatgagacagacagtccttgtcttcctggggctcaaccaaccagccattaggcagtgacaggcaagaggggtgggggtgactggtgcctgtcccatcgcctgcctgtgaggggaaggagtggaaaggaccatctcatgggagggacagaggaggggttggtgaaagctgggaccacactagtcctctgacacatcttcttgcacccccagacagccacaaccaaagtcccggagatccgtgatgtaacaaggattgagcgaatcggtgagtgagttgggtcaggaataggacctaagccctgcctgccatgtgccctgacagagcaaacctattgaggacccctaagatggagagggaggtggcctgcacaccaactgtgcccccactaccattcccccactcgccctatctaatgggggaggaggatcctcagttccagagttgggtcagatgatgcactggggaccaggctgctatcctggctatcctggtggggttcccgggtatgtttgcctggaagtcatagatatttactgggtgctttactgggtttggcctcgtatacccagtacacactgtggggtgagttccctgagggcagggacgaggtcgtgtcattcctagctgtgtccctagcacaggacctaacagagcagatgatcaagagataaccattgaatgcacgagtttgcgtcctgtggagccctcgcagtagccgcatgaggtgcatattgtaactgttagctgagggaactgattttcaggacagctaaatcactggccccggctcacacagagcaggaagttgagacgcagtgaggccagcagggtgcgctctcacaaagagctttaccggcagggaagtgaccgcattcattcatgcagcaggctcactgattcagggcatccgagaaaggcagtaagggcttctggctgtgaagatgggttttagaagcccagtgctggattcctggagcttagctctgccactttcccaccatgtggccagggactagttcctctctgtgcctcagtttccttatctgcaagacgaagctaagatagtttacctcatcagttaatgtaagattcagtaaggtagttcatataaagcattttgggtctgtgtgccaacactgtttcatctattaaaagtgctggggcactgggtgcagtggctcatgcctgtaattccagcactttggaaggccaaggtgggcggatcacctgaggtcaggaatttgagaccagcctggccaacatggtgaaacctcgtctctactaaaaatacaaaaatttgctgggcgtggtggcgcgtgcctgtaatcccagctactcgggaggctgaggcaggaaaattgcttgaacgaggaggtggaggttgcagtgagccaagatcatgccattgcactccagcctgggtgacaagagtgaaactctgtctctcaataaataaataaataaaagtgccgagactgggtgctgtagctcacgcctgtaatcccagcactttgggaggccgaggcgggtggatcacctgaagtcaggagtttgagaccagcttggccaacatggtgaaaccctgtctctactaaaaatacaaaaattagccaggcatggtggtgcatgcctatagtcccagctactagggaggatggcttgaacctgggaggcagaggttgcagtgagccaatatcgtgccactgcactccagcttgggtgacagagtgactccatctcaaaaacaaacaaaaagtgccaagtatggccgggcatgatgggtcacgcctgtaatcctagcactttgagaggtggagtcaggaggattgcttgaatcaggagttcaagaccagcctgagtcacatagtgtgatcctgtctctaaaaaaaaaataaaaaaattagccggcagtggtggtccatgcctgagtcccagctacttgggagaactgcttgaaccaaggaggttcaggatgtggtgagatgtgactgcaccatgcactccagcctgggtgacagagtgagacgctctctcaaaaaataaaaataaaaacatttttttttttttttggagacggagtctcgctctgtcgcccaggctggagtgcagtggcgcaatctcggctcactgcaagctctgcctcccgggttcacgccattctcctgcctcagcctcccgagtagctgggactacaggcgcccgccaccatgcccggctaatttttttgcgtttttagtagagatggagtttccccgtgttagccaggatggtctcgatctcctgacctcgtgatccgcccgcctcggcctcccaaagtgctggaattacaggcatgagccaccgcgcctggccaaaaaacaataaaaaattaaaaaaaaaaaaaaaggatgaagagccaagcaccgcttgtgagctgaggacccagtagagactagctgcacccaggagcctcccttggggtgctcacagtcaagcactggggtcagcaaatctttccttattttattttatttttttttttgagacggagtctcattctgtcccccaggctggagtgcagtggcgcaatcttggctcactgcaagctccacctcccgggttcacaccattctcctgtcagccttccgagtagctgggactacaggcgcctgacaccacggccgtctaattttttatatttttagtagagacgtggtttcactgtgttagccaggatggtgtctatctcctgacctcgtgatccgcctgcctcggcctcccaaaatgctgggattacaggcgtgagccaccacgcctggaccctagcaaatctttcttaaagggtcagatggtaaatccttcctctgttgaaactactcaactctcctcttgcagtgcgaaggcagccacagacagtatataaatggcagtgttccaatacaaagattttttggttggttttttgttgttttttttttgagatggagtctcactgtgttgcccaggctggagtgcagtggggcgatctcagttcactgcaacctccacctccctggtttaagtgactctcatgcctcagcctcccgagtatctgagactacaggtgcatgccaccacgccaggctaatttttgtattttttagtagagacggggtttcaccatgttggccaggctagtctcgaactcctgacctcaggtgatctgcttgcctctgcctcccgaagtgctgggattataagcgtgagccaccgtacccagctccaataaaattttatttgcaaaaacaggtggctggcctccaggctgaggtttgctcaaccctcatctaatgtaaagcatgggaatcccatcttcccctctcgctggctgtgtggctggggcatgggacctaacctctctgagctccctccccattcatatcaataggttctgggactgttgccattttgatactcagaagtgctttcagggtgatagcagccagggctcttgtttcattttattttgttttactgagacaggtcttgctctgtcatccaggctagaatgcagtggcacaatcttggctcactgcaacctccgcctcccaggttcaagcaattctcctgcctcagcctcctgagaagctgggattacagtcatctgccaccatgcccagctaatttttgtatttttagtagagacagggtttcaccatgttggccaggctggtctcgaactcctgacctccagtgatccgcccgcctcggcctcccaaagtgctgggattataggcaggagccactgcgcccggccccagccagggctctttttttgcaggatcatatggaataaactgagaacatgtgggtgctgtgtaaaccataaacatgaagtaattgtgatcattagcccttgtggttagatcttagtacaattatgtgcttaatcaggcctcagtgacttttgtttaactaggatgcatcctcagagcagctccagttcattgagcatttaccacattcagccatcttcctagggaggtgccaatttgggatatcctttccatgtgccccttcattcccccaacccctgctccctactcccacccacccctttgacaaagaaggaaaccagggctcagaggggtcaggccacatgtgcagcaagctggctagtaactgagtctttgttctttcccttcatgtaggtgcccactcccacatccggggactggggctggacgatgccttggagcctcggcaggtagagcagaggaggctggggtgtgagggcctctccatgaaggtcttgggtagtgggtacccagggtcctggggagtgtggggactatgttacggtcttctggacctttggctacatacccataaacttcaaccacatgtgggttttcttggtactaaagaattgattaggctaggtgtggtggctcatgcctgtaatctcagcactttgggaggccaaggtgggtggatcacctgaagtcagagtcaagaccagcctgaccaacatggtgaaaccctgtctctactaaaaatacaaaaattagccgggcatggtggtgcatgcctgtaattccagctactcaagagcctaaggcaggagaattgcttgaacctgggaggtggaggttgcaatgagccgagattgtgccactgccctccagcctgggtgacatctcggaaaaaaaaaaaaagaattgggagtgggtagcaattgctttgccaccttaaaaaaaagttagactgggtgcaatggctcacacttgtaatcccaatactttgggaggctgagatgggaagattgcttgagcctaagagcttgaggccagcctgggtaacatagtgacacctcctttctacaaaaaattttaaaaattagctggacatggtggtgcacatttgtggtcccagctactcaagaggctgaggtggaaggatctcttgatccctagaggtcaaggctacagtgagccatgattgtaccactgtacttcagcctgggtgacagagcgagatcttgtctcaaaaaaaaaaaaaaaaaaaaaaaaagcagggaaagcttttttggcttttcctagaagtcccagctagtaatgtctgcttccatctcactagcttcctgatgtggtagaaatgccatggtagccccacaggaaatcacctcatgtgcgcctcccacccacaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggtaagaaacctcccagggcaggaactctcctgtttcctgctaaataactcctcctgtgtaagtcagggtcaggatgagccgcctttaacagatgacccaaaatggcagtggcttaaacactcaggattcattcttgcccatggaagaatctagaggtaggccatttggggcttattaagcagttccaggaagtcttccatcttcctgcctcaccatcctctgcacttggttccagtcaagaggacgccatgttccaagagggctgccagagctccagccttcccactcataacccaggcagcaggaagaaaggagttgccatgaggatgaaccccctcgagttggcttcctttaaacagtcattggaaatcctccatgcttctgcttatatctcattatctcattgactagaatgtaatcatatgatcacactctgcttcaggggaggctggcacattaaatgttttttaaaatttcataatttggaccatttttgccttaagaaaatgaggattcttctgttgggcaaaaggttgttgtaaaaataaaaaattaaaaaaaaaaaaacaggaaagaaaatgagggttctagaactaaggaagaaggggaaggtgggtattgaggagtcacccagcagtctttgttgcagtccgctagtggtttatgatcttttcactcccagctgttcctcttcttccttgttgaactcctatttatccttcaaaaccctacttcagcatctctgccccattgaagcttttcctaacccactgctcttcccactcactcccacctctgtgctgaggctggggccaggcagggagaatcagagtaacagccaggtcttcagtgaagataaagcagtgcctgttggggtgctcggactggacactggggacccatagatgagttagaccaaggcctgacttcaaagagctcctggtctggaggaggtggtcatggacacgatcccttccaaggcgacatgtgttacaatgcaggtagcatgtgacagaggaggctcctgaccttggtaggaaaacggggcatgtggtggcatttgttgctagaggcttccagagaagcggatacctgagctaagcctagtaggatggccaggaggctcctgggcggacactggggacagcatgtccaggcccagaatgtggcacacacagtaacttccttccctccatcctttctgctttcctactcttcttcatttttttttttttttgagacagtttcactctgtcgctcaggctggagtgcagtggtgtgatcttcgctcactgcaacctctgcctcctgggttcaagtgatcctcctgcctcaacctcccaagtagctgggattacagatgtgtgccaccacacccaactgatttttgtatttttagtagaaatgggatttcaccatgttgaccaggctggtcccgaactcctgacctcaggtgatccacccccctgcctcggcctcccaaagtgctgggattacaggcgggagcctgtagactttattttttaggcatgttgtgactgtgcccggcctcgcctttcctcttcttgtgtctcccgcaggcctcctgcaggccaaaccctgtgctgggcagcactggggtgaggctagcctcgccctggcggggacgcttcttagtctagtgaaagaggcagagaggacccctggtgtccccagatggcatgggccgtgctcgtccactcagccctcagcagatacttgctgagttctgtgatgagggccattgtgtatccgcaaagaggactaagaacaggtcccacttgacactgggcaggagggtgtggtgtcagcctgtctgaaagggcgtgccccacattggaccaaaccttgtggccagggaactggaaggaaaggtctggcgttcagagctattgctggagacagacctgcttcctgccagccaccccaggccaccggcggtagagcgtcctgccctgtgccagtttcaggctgcgcaaccgtgttactgctgagcaccagtgcctgcctgcctgcctgcccatagtcactcctaagcagggtgtcatcccatgctggcacgtgttctgttatcatccccattagacagagggggagactgaggctcagggagcagttcagatcgctcaagatcccacggcgccacctgcacttaagtggtggatctgggatgggagccgaggcagtctgccttcatcacttgtagctatcgtgtgggctccttggccttcgtccctggtccccttcgtccagctctgaggctaaacagctcgtagaggctgggagactgaggtgtggcgaggttctagggtgtaccctctgggcaatgtgggattctaagccaggcctgccggagcaacctgccctgcctggcttctcactcactgtctgcctcatggctgaaccccgctctccagttccccctccccagcgctctgctcagctcggagccaagtccttacatgtaggatggcactgaaccctctttcctggggtgggagaaaagctagtttgccacagagcaggtgtcggggacctggtgccagagcggcttcacctacacagactgcctccttcccaggcatggcgcaggccctgggccctgacacgccattcacagccatcgccggcagtgaaatcttctccctggagatgagcaagaccgaggcgctgacgcaggccttccggcggtccatcggcgttcgcatcaagtaagcgggggacccgaggcgggtgccagaccccagagcctgggagcaaccccgcaccccgggcggctcgtcctttgtcccagagctcatggaaggttgtgattcccgagggtccaggtgtcaggctgtctcctcagatctgctctctggctagggaggagacggagatcatcgaaggggaggtggtggagatccagattgatcgaccagcaacagggacggtgagtctgtgtgagtctgtaccctgctgaggccacctccagcgccagggttggagagagtagatatcaggtctgcactgaggtcagaatcccatggaatgttctagctgcagactagagccatgtacatgcctacagtaggaggtcagttaacttgacaatggcttatccccttatgaaggacattatgggcaatagaaactgaggcggtaaaataatgagagagatctgttagtgagttcccaacagacctcaaaacccaacagacttcaaaactcgttccgtggccgaaaggcatgtcctgtccatcttacatgatacaggtgatttgctctctcttttttttttgttttcgagacagagtctccctctgtcccccagactggaatgcagtggtgcaatctcggctcactgcaacctctgcctcccaggttcaagtgattcttctgcctcagccttccgagtagctgagattacaggtgtgtgcatgccaccacgcccggctaatttttgtactttcagtagagacggggtttcaccatgttggccaggctggtcttgaactcctgacctcgtgatctgcccaccttggcctcccaaagtgctgggattacagccgtgagccaccatacctggcctctttttttttttttttttttttttttacaatttctgttttctcctttttgcatagctgtgttttctgattttgtgatcaacaaaaacactttttatttgggtataaaataggaatgtcaaagtgtgacatttggcaattttgcgagacctcgggcctatgttgtttttgatagactttattttttaggcatgttgtttgtttactatttttattttttatttttattttattttattataattttttttttgagatggagtcttgctctgttgcccaggctggagtgcagtggcacaatctcagctcacggcaagctctgcctcccgggttcatgccattctcctgcctcagcctcccgagtagctgggactacaggcacctgccaccacgcccggctaattttttgtatttttagtagagacggggtttcactgtggtctcgatctcctgaccttgtgatctgcccgcctcggcctcccaaagtgctgggattacaggtgtgagccactgcaccctgcctgtttactatttttattaagagctttattgagttttggccaggcgcagtggctcacacctgtaatcccagcactttgggaggctgaggtgggcgatcacttgagatcaggagttcgaaacgagcctgactaacatggtgaaaccctgtctatactaaaaatacaaaatggctgggcgcggtggttcatgcctataatcccagcactttgggaggccgaggcgggtggatcacctgaagtcaggagttcaagaccagcctgaccaacatggtgaaaccctgtctctactaaaaatacaaaaaattagctgggcgtggtggtgggtgcttgtaatcccagctacttgggaggctaaggcaggagaatcgcttgaatctgggaggcagaagttgcagtaagccgagatcacaccattgcactccagcctgggcaacaagagcgaaactccatctcaaaaataaataaataataaaaacacaaaacaattagctgggtatggtggcacacatctgtaatcccagctacttgggaggctgaggcaggagaactacttgaacccgggagatggaggttggagtgagctgagatcacaccactgcactccagcctgggcgacagagcaagactctatctcaaaaaaaaaaaaaaaaaaaaaaaaaaaaaaaaaaaagagctttattcaccaggcgcagtagctcactcctgtaatcccagcactttgggaggccgaggtgggcagatcacaaggtcaggagatcgagaccatcctggctatcacagtgaaaccccatctctactaaaaatacaaaaattagccatgcgtggtggcgggcgcctgtagtcccagctactcgggaggctgaggcaggagaatggcgtgaacccgggaggcagagcttgcagtgagccgagatcatgctactacactccagcgtgggcgacagagcaagactccgtctcaaaaaaaaaaagaactttattgagttttaattgacatacagaaagctgtacacattgcaagtgtccagtatggtccgttgggacatacatgttcagccgcggagccatcaccgcgtcaggctggtgagcgcaccgtatgtcttccctggagagcttccttgtgttgtgcccattttgaagctgtggaagcagaggccagagcagagccagaagcttatcaacactgggggcactggggcaacatcagggccctctctgagccccatccctggcttgtccccactctcagggctccaaggtgggcaaactgaccctcaagaccacagagatggagaccatctacgacctgggcaccaagatgattgagtccctgaccaaggacaaggtccaggccgggtgagcagtcaggggccatgccaggcagccagggggatgggcgagcttgggcccattcctttccttaccctaccccccatccccctgtagggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctaaggtcctccgggagcccccgtgaccctcagcgctctggaatgtccctagtcctgactacctcctgggcctggggtttccagatgaccccatttagcctcccagctccatttcctggagctccagtctcccccagacagagggctttaggggcccccttcatgcccttccctgccctgtctccgccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctgttctccacctgcaagtccgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggagggcaaggcggagatcatccctggagtgaggacccaggacatggccggggcgggtggtggggtggaggtgggccggggaagtggggacgcgggtggtgactctcacacacaccccaatccaaggtgctgttcatcgacgaggtccacatgctggacatcgagagcttctccttcctcaaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtcttcaaactgcgtgccgaggcaccccagggtgctgcaggaaactcacaggagtgctgtgggatgttttctagtcttgagggaagcacagtgacatctgttagacataacataaactacgattgttcagtcacttcgacccagcaactccattaacagaactcttagcgttgtgtttggcctaaggatgccagggacagattcccatgacacagagggtaccgtgctctgctgaagcctgggaacctcatctcccaggtgttgccagcaccctgtgcacggggaactcttaatgttgtgtttggcctgaggatgccggggacagattcctgtgacacagagggtactgtgctgtgctgaagcctgggaacctcgtctcccaggtgttgccagcaccctgtgtagctgggattacgggcacctgccaccatgcccgctggctgtcttctccacctcgccacattttggcccgcaggaagcagggggatgtggagggcaggcagcccccataggctgtgatccacaggctgcaccccaaccttgcacccccattccattgcccggcactgcttgggctcagtgctgtacctggtggcaaagaaggctgggtactgtcagctccagccctgcagccttgggcccagctgaaactgggcggttgggatgggcatcacaaaagggaagaagcgggcaccctacagaggatgctgggccgctgggcctggctctgtgtttggctcttttaactccttggatccgcagaagaagctcagaaggtagatatcacctcagccccattttatagggcaggacagtgaggcccagtgacttgcccaggtcacaagtctagaaggtagcagggccgtaatttggtctctggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgcccaccacacacacacacacacacacacacacacacacacacacaccacccctgggactcaatcagtcctctggcctcagcctcctcatcagctgggaccacgggcatgcaccactatgcctagctaatttctgtttttgttttgagacggagtctagctctgtcaccaggctggagtgcagtggcacgatctcggctcactgcaacctctgccttctgggttcaagcagttttcctgcctcagcctcctgagtagctgggattatgggcacccgccaccatgcccagctaattttggtatttttagtagagacagggtttcaccatattggccaggctggtctcgaactcctgacctcgtgatctgcccacctcagcctcccaaagtgttgagattacaggggtgagtcaccgcgtccggcctaattttttttttttttttgtagagatggtgttttgccatgttgcccaggctggtctcaaactcctgggctcaagcaatccacccgcctcagcctcccaaagtgttgtcactttttttgtgccttttttttttaaactttttggggccatttgttggtgatattgccatttaaagtgtcccctgtgcacagtgttgaagtgctgtctagtatcctaagtgcaaggaggctgtgaagcctgacggagaaaatgccatgttacagacgcttcgctgagcccaagttagaatgctgttgacacgagctccatgttagagaataaacagtgatgttacataacaaacacatggaaatagaaacacacatacatgaggccaggcgcggtagctcacacctgtaatcccagcactttgggaggccgaggtgggtggatcacgaggtcaagagaatgagaccgtcccggccaacatggtgaaaccctgtctgtattaaaaatagaaaaaactagctgggcgtgatggcgtgcgcctgtagacccagctacttgggaggctgaggcaggaggatcggttgaacccgggaggcggaggttgcagtgagccgagatcgcgccactgcactccagcctcgcaacagagcgagactccgtctcaaaaaacaaaccaaaaagaccagaaacacacaaatgaaaatacgcatagacccagattatatatatatggattgatgaaaatactgtaagccgaggctcgagagagcctaaccctgtattccagtaggagcagtggctcaggatcagctaattggagtgttcacgatgactttctagaacctcactactgtgaataaggggaactgactgtatcccctggcaccagccctgggctggccccgctgcagcagggaacaagacaggtgcagtcccctcctttgtgaagctttgtgtcgagcacgggagtgggaccttgatccagtaatcctggaggcagagatctagcttaaagcagcccagctccgcggaaaggtgcccttgggggactgacgcagctgtggaaggctgcgtcatcaggggtgatgtcatcatgtgacaggagacgcgagctaaaggttaagtggtgttgggcccagtgagtgggtggcgatgggaggtgagagtgttcccagcaaagggaatgaagagggaacatgcccctgacagccccctctttctgcctcttcctcagaatccggggcaccagctaccagagccctcacggcatccccatagacctgctggaccggctgcttatcgtctccaccaccccctacagcgagaaagacacgaagcagatcctccgcatccggtgcgggcaggaccaggccgtgcgcctgagacgcagggctggggtctaccctgtttgacaaatgctgacactgaggtccagcggagtggcatggtggctgggcctacaggagagagggctgagcgggcacccagacggtggcctccgatccgggagcaggagccacggtgggaaagggaggcgaggtacccgtgactggtgttggggccagcgccctgggggtggtcaggaggcctcggttttaggtccagcccagcccctgtctccgtggctcttctagcctcagcattctatggttctaagatgcaggcgccacatattcccagtggggaagggccagagggttgctgtggccacttctgctgcagtcagaggctgggccccggctgagccacccctgtcccccactgcttgcaggtgcgaggaagaagatgtggagatgagtgaggacgcctacacggtgctgacccgcatcgggctggagacgtcactgcgctacgccatccagctcatcacagctgccagcttggtgtgccggaaacgcaaggtcagccggccgaattagccagcagggccagatggcggcagtgagtgacacagtacttcaggggcttccagggttccgatttcatcctagaatgtacgttttcagacgcagggaattttcatccctcaggttggcttctgtatcatccagcctggcctatagtaggtatcagtaaatctctcttgacttaagtagatgctgttaggtccaccttacagataaagaaactgaggaatgaagaggctgggcccacaacaaggagatggccaggcaggatttgaacccaggcaatctggcccagaatgccctcccctcacatgccacactctgctgcctagagcatggaggtggcatacgctggggtctgtgccttgagcctcacggagaggggcccaactgaggactcgccctccccctccagggtacagaagtgcaggtggatgacatcaagcgggtctactcactcttcctggacgagtcccgctccacgcagtacatgaaggagtaccaggacgccttcctcttcaacgaactcagtaagaatccccaccccgcacctgcactgccagagccaacctcagagggaggaagagggagctcggcgtagaaggctcaggccctgccacctgggcgacactgaccatgtggccttccttctccccacagaaggcgagaccatggacacctcctgagttggatgtcatcccccgaccccaccctgttttccaccagagttctgacactgtgactctgtataaaatggttgggaagctgc

SEQ ID NO: 35880 - DNA, 49338 bp, Homo sapiens
gcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaagtaggtctggggcccggggaggggaggcggggccggtcccgggccctggagctccacggcgtcgggtgcccgtcccggcctgggtcgcggcgcggggcggaggggtggccgcggcggggcggggcggggcggccgggccggcggtgccgagtgcggcgcgggcggcgggtcccagcgccctcgcctccctgaccgcttccggccgctcccgggcgggagccctgggacccgctcctggggactcaggggaccctgccattttggggtttgagcgggatccagccgagtcagaacggttggcttcgggacttctgctaatttcactccatctcaaggaagtgattttggggttggtggttccccgtcctctcctccctcctttttctctctctgcgggcacaaaaggcccattactcattgagccggttggtcggttggtttggagaagtcggatcgcagaggtttatttagcctcgctccttatttgggagccggaatgtgtgatttcacttccccgagcctcgcgagggcagccgggccgccttggggcgcgccgggcaggaggtgtgcggcgggagggtcctgggtgtcccccggctgcgggggcgggattatttggatcccggagctggccccctcagctggccccctcccacgcccgcgcggggcggctccggggagaggccggcggtgtccgcggcccggctgatcattgtgaacagagtctgtaacccgcggccgggcccgtgctgattccgcctcctagagagggccacttgctgtcctggactcgcgccgtgatgggcagtctgaggaaacattatccttgagccgggggagcccatcccttttctttctttaaggggtgtggtggtggggagaataaggattcaagtgagaatatcgacttcagaagttaaacacaatggactgggaggtctcatgagatgggtgggtccgcagtgaagtgtgagccggtcttgcagggtcaccaacaaggttttcctctcacaggggtttcaggtcaaaccaatctctaaaggtgacgcctcaggtctgtttcccctggggtgtctcaatgattggaggaggagaaaaatacttcctgtgttatatttttctcttccccttcagcccccacagcgagctgtatttcagttgtcaagtacaaaactcagaaatgtggtatgggtggaactattggaatatacgatcagatgttttaaaagaaacaccagtacttcggggttgtacggggcaagcatgttccatttctagattttaaggcctctagaattgttttcctgctgctctcatactcaaccctgttacagtgctttgctttctactgtaagttattgctctgggatctcggttgttgtttagtgttgactgttggagaggggataagtatcttcaacacttcaacatttgtgtcttagacttctctttccctactcataactgaagggaaaggaggaggaggagttgtttggattgagcatggctctgaccttggggactggagttgggtgaatacagtttgaccacagttaacctgtatcattgaggaagtgacagacggtctttacaggagtgtttgctgtcccctctgagacaccatctgccttcacccattagtagtttggggacactggctgttcattctcttggatatttggaatattatgtaaagacttcagaacaaaagctcccaacttctgctctgtattctgtttaatagacacacgcacaaaatcatcctataaaatgcttttgagtggcaattcagatttctcttgtaactaacgagagagaggtttacatatttttctactttgaatagttttggaaggaaaaatccagcagcgtgttaaataacactcatagtttatccctctcaggttagaagtgggcgaagagtgaagtcagtctgttttgacaggcagcctgctcccagatcttttaagttgactcaactgttaaattgtggatttcccacacacgtctttgtgttaaaacttaataatggaggaagaaaggagagacaaggcatttggagactgacagcagtgttaacagcacttccatatccaaatattggctgagacataattacagctgtggggggaatctggttcaaagaacgctgttccagagacacacaccaaagagatttctagatcttgaattttgattaacctcaggtgctgagtagtgaaatggttttcaaaaccagaagtctagtgattataaagcaggagaggaagatggagtggggcaagagggattacccccttgggaaggtgcctgagaaaaggggaggagacctctattctacagtgtgccgaggccaatgctgggggctagggcagagctggagggcaggagcccagcctctgctggggttcagaagtctgctatgttgcagccctgagagttgatgggagctggcagctgcttagatgctctcctctctgcctatagtcggtgacctcttagccctgttaagtgaaatcagcatttgaaaaagagtcccagctcaccctgctgcttctctccctccacctcagagagctcccatttaaatgcttttggtgggtgctttgacctcacctcaccatctctcctggctgcttttgctaagttctgagtcatgcttccagtcagagttgcaagggacttgaaaggtcattttgtccagcccccttattttgcagaagagaaaaccaaggcccagagtgagggagtgacttgttcaaggtaccatagccattcacttggcagaggcaggattggaacccaggttgcctgactcccagtctcaggcttcttcccacttacttcctaactgagccacgggctcaggcacatggccacctgctgctccagggtgcttccagcctgaggagctgttctgtcacctcaggccctgactgacaagaggggaggtcagcgaagggggctggatgggtatttgctgctcctgagaacagtccccaaagttggaggggaacttcaacagtagcttcatgcatttttttaaccactccctcccccttttaagagagtatttgataggcaccttacttactattttttgtacaagaacatgggaattctattatttttatttttattttttttgagacagagtgttgctctgtcgcccaggttagagtgcagtagcacgatcttggctcactgcaagctctgcttcccaggtccacgccattctgcctcagcctcctgagtagctgggactacaggcgcccgtcaccatgcccggctaattttttgtatttttagtagagatggggtttcactgtgttattcaggatggtcttgatctcctgacctcgtgatctgcctgcctcagcctgcctaagtgctgggattacaggtgtgagctaccgcgcccggcctgtattacttctttgataaggacacctagtctcaacccacttgtgtattaattagttgtattccccgggagggttcctcagctgcttgccgcttcactgtgtcatggtgacccttaggtgttagctcaacaaatttaattaaagactgtatcgttgttctctgctgtgcaactctgattaggtgaagcatgttactgctttataaaatatagaatgttgtcgtaacttatctctgtgtatctttccattgcgtggattagagaaaacaaggtcctgtagtttcttttcctttcctttctccagcattcctctctccctaggtcatggaagtgccactgcgatgtggcttcctttgttctggtgaaggggagatgattggagcctctcatgattattctggatgctgttggagggaaatgccagagctcccacatccccacagtacaggcaccatctcctttccaacacacctcatactgtgtacctgtggagggcaagacagttagtgtggctaggtgagaggcagtgtcccaaactggagtttgctggagttgtcacaaggttaggaaaatttcattgaccaagccagcctcttttatatgcaatatggttacaggtaggtaacagtttgctgaatatctatcataagcttagttgcatggaggatacacatgtaaaaaatggcctgtaaaattttgagtcaagaaacttatttagagaaggtgaaattaacacatgtaggctagggctgcactgtccaatctggtagccactaccctcacatagctaattaaattaaaattaattaacatgaatggattaaactaaattaaatttgaaaaatcagttgctagccacacttcaagtgttcagtaaacatgtggctaatggctatcgaattgaacaatgcagaagaacattttcatccttgcagaacgttctcctagactttgttggtctgggagctaaatcgtgtggctgggaatagaggagctttgaaagaggggaatctgtggtgactccaggagctaagggaggctccagctggggtcagtgggacatggctgtgcctctgaggagtgagcaagtctgtgagaggtgtggtgacattggcctggctagaactgaggggaggaacaggaggtcagagtggtcaggggttggtggctccaaattgaagctaactcatcttgtgtcaaagcaggctttaaagtgtttgaggggcatgaaggtgtcaaaaaaggttaggaatcattgaagatgggcttacagaattatgagggaagggtcaggtttgtggtttcagagatcctgtccctcctggccgtagccctgaccccagccctgacccctggctcctgcagcagggcccttggcatccactgaggcaagattgaagctgggtcagctcactgtccttttttacttgtgaattctgggctttgactgagcttggagacaatctccagctaagatacgggatcagtggctgacaggaggggagagacaagcagtccctgggccttagggccaaatattggtgggtgtctaggaaacaaaagaacccctttgtgggaggaggaaggtattgggacctgtgatgtttctgctacttgggacctgagaggttgggccatccataattgatgatttttcttatgaagcaggtacaggggattgggaggagggcctggaagagcccagcctcagaactgctggaggcaaacttaatccttgggctaggggaggggccaaagctcctgttagccagagcccaggagtgtgctgagtgggtgccaggaggaatgtcagccaagatggggaagagcagggcacagtcgtctgcatctgagccattgcccagttcccaagcagccttgccatgctctgagctggggttcttcctggtggcgtgatgtctgtggtgcaggattcactctattctcctacctttcctctacttcaggccctgccaagtgtcatgtgaggtctcttttccccctcttccctgcactgtatctttccagatggttctgtgtcctggagggaggtggatgggcagagaagagttgttctttgcagggactgcagcttttcttggtaatggtttgaggcccagtggcaaagcaacccacacttcatagtaacttagaacccacactccctggtcatctttcttgactccttgcacatcactgaggaagaagctggcctagtgcagaaatgttcagtggcatgtccaaggtcttacatggtgtcagcatccgagccacatcttgagacctggttccctgggacctgctcttggtctgggcccctttggtttttggttgctagaagactgtagacctggtggagcaaaactgagctccactaacgcatcagctaggatctttccacatgggttaccttgtaaatgggggcattggtgaagagaaggggccatgtcactggacagtgtaataacgtatggcagttatagaacccaaatcagattgctgtgtaccttttctagtttttaggaaaatactggtattttgtattttaagatatatatatatatatatatatacacacatacacagatatagatatgtagagatgagcttgttaccatgggttatgtgctagataagaaagcaaaaataagtgcatacataaatagaaagcttccagtgtttgtatgctgctaacaagttacatgaccttgaataggtcagctaaactttccaggcctcattgcacagagggtcggctcgagcagctcctgagcaccggcagggtgaggcagtagaaggcggtgctgcaggccagaggtggagggcaggcaggatagcttgctgacttgctccgggtctgaccatcagcagtatctgggtcagcacagatgccctttcgtaagcttagtgcctggctccagggcagcctgtgtccagttaatgaataatcatcactgaccagctgctccttctcttgtgtgaagacttagaaagtgttctatgctggtgactcggcagagaggatagactacgtaatttagcagggtgtgcatcttctctttccttaaaatcagaagaatcatagtgtagtggtggtgcaaagtagagatgaggaactctattccctgtttgagattcctttctcaagttatggggcatttgagggccactgtgatttctggtgcaggctgttccctgtgcacagggatctggttgaggagctaagcgaaggctgaagtccagccactgtctccttgcttggctttgtctttgtgtgtggctgggttctttcaaaggagtgccttctaattcaccaaaggtatggttatggattaggggttgttcttaggttagagttggggactgattcacagagctgatgaggaaattaggatttacattcaggtgaccctcagcccctcagaccaggctgagtaagaagagatatcaggaatccaaggaagcaggaggaaaaggggttgcctggtgatgtctgttctctttcctcctcttcctgcccatgcaaggctagagcagctgtttcagccccggaggtttagactgtggggtcctgtgtgctgggccatcaggtttggtgggaggaggaagaaagccacagtagaaggagacataaagttgggctgggcctctggcagtgaaaggttcttggggtctttattgtctgatcagtaaacacctctgtgtgccagaatgagctgggacaaggccccaaggtcagcccatatttgtatctggtgttctcctccaagaccagccaagctgtgcgctcattctgctgggaacctgagccctccaaaagggtcatatgaaagggcatcttattcttgagggacgtttccaagcatctctgtggccagtgtccatccaggactcatcttagaggtgaagagtggtggccagaggcggaagctagtggccacccgatgggagccttttctgtttcagagcatatgagggagctgagggagctgtactgttgatgccttctctctggctcatctccatgaagattcttttgaaccagaagcaaaggtgaagtctctctgaggggaggggctgaacaggagatctactgactgtccccctgccgactcctccactttcgtcctccggcggggctccttatcctcctgcttgtctacagggagaagatcgagttgttcgtttgctgccattttaatgatccacattgttaggaggctctcagtacacaccggaccttagcagcctggcctcctgcccagggcccagaactgttactcagcccctctgccgaacagctaaaaataaacctgccactgctgcagtctcccctcacagccaggccctgttagctgtcccagtgcttcctgccacaccgctgacctgtttctctcactttctgctgatattctccctgcttgcccctttctcttccagcctgagcttggtaggtgatttggggctaactcactcttctgagtgctgggagacgtgctatggtttttatgtctccaggtgtctagatttgtgtgtatgaaagctccgtgaagctgtcctgcttatttcccagtagggaaagggttagacaaaaaggagagtgaccaagctcatcagagtggatcagaccttctactgtgctcgcctccagccctggcttcctccagttttacctccaagcaggcctctttgccagagttacctggttatggtaacagagttaccatagttatatgctaggacagccccacatgggcagtctgccccaggccttcaacccgactgccctgtcaccgagcatgctacctaccgtgtactcctgccctgttgctacgttatattctccacctccgcagtgtgaggctttgggctaccacattcaaaagtgtgacctcatcttgtcagcgtccaagaataactgggccctggctctcaggatctccttcctgagtcaggccatggcacctctggcccttccagctcagccacatgcagaatgtcaccgagtgcatgggtttcttctacctcttgactgcagtattgatgtgtgtccatggaggtgtggcctcttcctctactccccagggatcctggagacttgtggagcaagatgaggaaaggggctcaggtagctagaatatttgcttagctgatagatactgggcagagtctgacattggcattctgttcttcagcgtggcgttagtattctttctgattttttctaatccctagacaggtgttgatactaatcgtggcctaggagggctctatgtctgctttcaggaattatggtttatttgggggaaggggtgtatggtggagagtgatggcaatgacaaccaagacataggacttgaggaacccactgccttcagctagagttacatactctgaccatgtgtcgatggcctccttctcccacctctcccctggggccacatttcctctgcaaggaaagatttatctgccaaggcccattggcctgtgcagaggaagagttgggcatagttgctaagtgtttatttttaactctgacagaaggagcccctgtcctcagaatagccataccctctgtctttccctatcccgactgccttccttggcttctgtgattcctagaagaaggttagtaggattctaaaggccaggcttcacgggagctggagaaggctagcttctctaagtgaggaatctgcaggttgctcgtcatgcttggcttctgcagagctcaaagggtcctgcggggagagccctggacactaaaggccgtgtgtctggaacttggagaattctaggaatgcaggtgacctgatgaggaggctgcatgtgccctgcagctcagagcagcctggctgcacagctgagttggacagcccagcaaggggtcatcccataccttctacatccttacaggcacccagatctctggcagatggggaggccacagggagaaaatgagcatatgtagtaacctgccctggaaacacttgcgcttgcagacacgccaagtgctgtcattccctctgactgccaggctcacgagcatcatgtcctttccagcagagcccacctgcgactcttagtgacttcataccctttgtgttctcttcccctgatgtgctttagtgacctgtgctcacagagaggaggaggaagggtggcagtgccccctctcctgggtctcagactttcctgactttatgcatttgatttggctacctgggctcggatactttaaaagaaaataaaattaggtttgaggtgtaaccagagagagaaggaatagagagtagtagggggtgggatgggtggttgaaacatgtggctaactctgagaaccctcagctatggaaggaaggtcttgcccccatgattcttcggcgtgcagtgggggattagtttgcccagagcccagctctgatcatgtagcttcccagcttaagcccttcagtgggtctctctgcctgcagaatacatgagatatccacatctttcccagatctggccctgatctgtttttttttttttttttggaacacatgctttttttttctccccagcttaagtggcttatatatgttgtttctttaacagaactgtgctttccacccccacaccttagcatctatccatctgcatcttctctgtaccatgcctgtcccccgtcctgtctatatctaccttttccaccctgcacagatgctgcttttccagagcctttcgcaccaaaagtgggtcttcccatccttccccatcaaacttgctgatacactcttaccttttatttctctgtttaagtgcatttctccatgtgcaaggcatctctctctctctctctttttttttttaacaggaaggtaatttattaacggaaaatatttgaggagtcctgtgcacagtgaccatggcaaccccccttcctgcgggtgctgtcagaggggttgggagtgacgtcctcaatctgtccgatcttcatacctgagcgggcaagggccctgagggccacctgggccccaggtccaggggtcttggttctacttcctcctatggctcggagttcgatgtgtagggcagtgatacccagctctgggccacatcccgggcagccaacatagcagcatgtggtgaggattcatctcacctgccttcaccttcatcctaccagtcacacggcagatgatttctttgccagaaagatcagtgacatggacaaaagtgtcattgaaggatgcaaagatatggcagacaccaaatacattctctccttcagccacctgaggtctgaggctgatgacctgttcttccttcttttccttcccctttcaaggtgccatttctgcatgttgtttccagactccgcacaggaacgcaaggcacctctttagatatcggattggactgtaaatcccctgaaaacctacatcttcattatttttgtgtcctcttattttcatgtagtgaccgtatgtcctcattaaaaaactcaggccaggcatggtggctcacgcctgtaatctcagtgctttggaaggacaagtgggaggatcttttgaactcaggagtttgatatcagcctgggcaacataacaagaccccatctctacaaaaaattaaaaaggttagccagctgtggtggcacatacccatagtttcagctactcaggaggctgaggtgggaggatcacttgagcccaggaagtcacggttacagtgagctatgatcatgtcagtgcactccagcctgggtgacagagcgagaccccgtctctgaaaaaagaatcctagagtattttggcactgtgcattatatgcattatacttagctgctgaataaaggtgtgataactgagtaatagtggatgccaccgatattaaatgtgatgtactagaggtaatcctcagagtcagggactgtggcagccctgggagtgggatagtactgggctgtgctctctgagactgagctggggtagagtgatgatctctcacattgtctgttctcattcttctgctgctgaaaagctgctcttagtcttctgagcatttcttccctctacccacttggatctgctgactcaagcaggcaccttctatttctgcttacagagttctcattcttacaaggaccctgaccacagtttctcattgatgcctctcctccttctccctgttccaaggcccctcctattcctgttcagtcatggagatgacccttttgccctttggagaactttaactgagggagggacagatgtggagcttgccaactttcctacagctcctggcattttctagttagctacagacacggcacagacacacagatgcagtccattgttttctatctgctggtcctgctcctgtgtgttgcaagagggacgagtgttaaacactgtattagtccattttgtgttgcactaaaggagtatctgagactgggtaatttatagagaaaagaggtttattgctcacagttctgcaggctgtacaaggatcatggcaccagcatctgcttctggtgaggacctcaggaagcttttgctcatgggggaagttgaagggggagcaggcatgtcacatgtcgagaagagggagcatgggggtgggggaggccctcgactctttttaacaaccagatcttctatgaactcagagcgagaactcactgccacaaggagggcaccaagccattcatgagggatctgcccccaagacccaaacatctcccaccgggccccacctccaacactggggatcatacttcaacatgagatttggaggggccaaatatccaaactatatcaagtacccagttgctgggactgaggtcaaaggtttgaacctcatggggctgcttaactccatgccacaacagatttacacaagaaagagaacctgacactagactggaatctgggagacctggctactaactctacctgtgtggccccaagcaagtcctaggacctgtctgggcctcactcagtttcctcattgtaaatcaacaggactagacttgaccttgaaggactcctgcaccgaaagcctttcatcactgttgttgcatccgcactgctgggaaaataacctgatgctgggaaacaagtggtcggcctgggtcccagggagcctcggggactaagagccatcatctctgtcctcagtttctgcaggacagtgttacttcacctttttcctggctgcagtgtttttattcattcagccaatgtttataaatgtttattgttctccatgcctgcctcctgtcttccctgctgactggccatcaggaggcccagatggcaggattagcttggaatggcagaacagtcaagggtcatcctcttgggtttagacccctttaatacctctgctatatgagatgagaagaatttagaacattgatccttccagcagcttagactagacccctgcctttctaagcaggatttgcctgtgggtaccttctatacccttgagatccaaagcaacttactactcaagaaaattaattagcaatgccaagagtgacttgtacagctcccctaaggatagctcaaaacagcagatagactttgatacaatataacaaatttctattattcagatcactgtaggaaacttagcaactctgtgaaggtttcccagattaataacaagtctttattgagcagatactatgtatcaggcattgtgttaggtgttttacttacattcttgttaatccttaaaataacccttttactgcaaagtgaaagtccccattttacagaagaaacatgttcatgtacagaataattccttagcaattatttattgagcacctactaagtgctaagcattatcttgggctctggatatacatcagtatataaaacagacaaaaaagctatttggggggtgggaagggggaccaggtagaggaatagcaagtgcaaaggcaaaagcctgaggcttattaataagtgtgtctaactctaaaacctaggctccctccagctcacagtattgcctctctaatggtcctttgtgactccattataattgggtacttagatgacctagcaattttaagtttatccaatatttatgggatacttattttgtgcaaattgctacgatgagatgaataagttgtaggccctgcctttggaaacatacagtttagaggaacgaacacccgtgtgtataaaaatgaatgaaagaggacttcctctcaaaatccagatcttaccatttcttgcatttttgtcatttgacccttgtaggccagatggtgtggttcctcgttttgtatctgaaggaagagtttcagggagtgggtgggggtaagtgtctgggcaccagggtggccaataaaggatgcagagacacatgatgggctcttcaaggtgggaggaagtagagggtgggatcactgcctggcatgggcagaggatacttcatggacatatacctgtgacacagccaggggagggtgcagatgaaaatacgtccagtgggatggtttctaaggagaagtgtgagggactccactggggctccgtattttgtctggctgaggagggagagatgctgcctctccaggaatctggtaataggcaatgcttgagattggtgtgaaccaacgcatcacatagagccaggagaagtcacgaaggaggcaagaaaaagaaatggctgggctaaagctgtggcagagccctttttatcctcctttgggccctcatatggcttctcttttggtctgaagaatctcatccttcttgagtttagccttctaggtgaaggagtgggcagactgcatgcagggagacagggaggccgtgtttgtgtccttcagctcaggagctgagagaacagaggtcagggcttgggatggagctgaccgttagtgcagatgggaaagtgaagcaatgggtcgggtctgtttgttcctgagcatgtcctgtgacaaaggaagttgcaacatgtctgtctgtctttctctctctttttcttttctcctttcttttcgtttctttctctctctctctcttctttttttctctttctttcttcttcttactttttttttttttttttttaaataaagaaagaagcaggtaaaaccatcttccagaaaatgccagaaagaatatctggtctgtgatgggtggttcttgcccctcccgctgcaatgcttttcctgtgtagtttttcttttgtccttcctttcccatccacactttccactctcctttcctctgagaggttgtgtctctgcagcaggccagctatgtctccaaagggaagtagtcagtgcttggactgagggaaccttgagagagaatcctctcctttgtcctccaggtgagagagctgttgcatccactcacacctggaaggttgctggtctcctctcgctggacactgagagctgtttaaatttgacaggtggttcctgattcccacctggcattttttgctgctgcacaggtctgtgttgtgtcttagaaggctgagggaatacttacttctcaactcagataaccaccttgttggtaggttcagtgtgtgtctgtgtcaaggcagatgctgggaaaaaagggcccagaatgtgagtgggaggtagaaatcaaggctagaagaccacacatgttaatctggagtacttggtcaggtttgattttggcctgtgtgctatagctgggcaagaagccagttgtgtttggaaatgtacagatgatctattttcctgatgaaaccttttgaggtctggaataaacatagcttgctttctctctttccctcttttgagattcaatttctctcccttggacttctataccctagtagagccaaaagttccagtacaaaccagttttgagactccagcattagtcaactaagggatgttgtaggtcatccctgagaacgagggctgcttgctctggggaagctgggaaatggcaccaggtgtcaggccctactgcccaggatgggatgacagctgctggtgttaattacgtttctgggcagaacagggtaaagtccttgggggtgagagtttttgtttaggcactgtgttccctgtacctgttgcctctggtacagctgctgcagagcccctccttgcctgcagtcttctttgaatttaatctccctgtgatccagtgcatctcttcagactggaggtgagcccagaggagtggtggagggagtggggccagaatttacttgtttgcctggatcccactgagaatacagaagctctctttcacgagaagctgtgctggcctctgtggtacccactggccatatgtgactattaaaattgaaattaagtgttaataacatttaaaattcagttcctcagtagtgccagccacattttaagtgctcagtggttagctagtggccacggttttatgtggcacagatagagaacattttatcatcacagaatagtctcttagacaatgcaagattctgagataatttttctaatcctggtagacacttagctggaaggggatttgaggaagggtacagggagaggttttgaagcccaggtgagagggcaagtagaaggtattcatttagaaaaggatcttaaaaagtatttagtttgtagggccaggtgcagtggctcatacctataatcccagcagttcatgaggctgaggcaggcaaattgcttgagcccaggagttcgagaccagcctgagcaacatggggaaacactgtctctacaaaaaatacaaaaattagcctggcgtggtggcgtacacacatggttcgatctactcaggaggctgaggtgggaggatcacttgagcctgggaggccaaggctgcagagagccgttattgcactgcactccaacctgggcaacagaatgagaccctgtctctaaaaaaaaaaaaaaaaaaaaaaaaagaggagttcaccttgttgaggactacatcctaagagatggtcacctggcccagtggctcccaaaccaggatgattgttagactcacttgtgggtagcatttcaagatacagattcctgggcaccactctttgtgtctagttgaatccaagactcttcagaggaggtaacctggaatgtgcatttttaatgtgctccccaagtgataattatctgggtttggcaaccaccaacctatcatacctgtgcttaaattcttccaatggtaaggagcttatcccttttcaagaaaaccttaccattaaggaaaaattcgctgttgttaaagttctatgtttttcgaatcttgagatttggttctttgaggtcatgaaatcctttggtgctcattgcatctttagagcctcgcagaaccgtcatcttcatccttgcactcagtcttcagcagatatttgagggcagctgtggtgtggtccctgccactccaagtcatggcatgcgtcagagtgcttgatctgccaagggctctagggagatgcagagatgcaacatcattccaggatccttccaattgtcaggccttgctgagagccagaggaaaggtctgaatctcagtggagccctacagggacagcccaagggccatccagccggtgagggccatgtgtgtgtctgcctctctgcatcctgctccgtagggaagagtccctgcttctttgcatgttagcacttgttaacaccgacctggttttcttcagagacattgagagattcagccatccattcccggtaatgacagatgtcatttctgtttagagaccttcagtagcctcccttcacttccagtgtaaaattcaaactcctgaacgtggcattcaagcaagctggtttgtcctgccttccacactttgccttccaggagagcactccttcccgctctgccttgcatttatctgcttccacatcttctcttggatcttacatttgcttatcttcagttttttctggtagaactgtatttatccttcaaggctcataatagattttacccccttactcccctgcccaattccaggcagaactgcctccctcctctgccctagtgagggttcattctgcctgcatgactgctatgcactcaaattacagccccctgccaggccctccctgctagaccaagctccttgcggacaagaactatgtcttacttggcttgatatccccaagtgcaagcaagcaccagtgctggagcctccttttcctgcattggcattcttaccctcagtggcccagagctcatcagctccaatgagaaaagtgctacttagcagctgataattaacagacaggacgtgaggtttggctacttcagaggcaaaactggtatttaaacaataaggtttttaaaaatcaagcattaaagtgtcagcttcagaagcagctacttccaaacataatcctgcccagttagagaagacaaatggaataatgagtggaaccaaagatttctctctagccttgagaagagttcaggggaaagaggcctgggtggcgtattggcaggagattggaaaaggggccttcatatttcttttctctggaatggggctggggctgcttggagagcaggtgggaggtgcttccttagaaagggctgtctgtgttctcttccattcccaatttctatagattggactagttttgccaagtgagcaagcaagaaaaattgggaaacagagggtaggcatcaaccctggcatttatcctaaggtgatgcagcacacacttgtattcagcgatagagacttttccgtaatgcctggtaatatctcattgtattttcttttgatgctcctgggggcaggaggggagagctgacatcagagcctcctcccttctagatcacaaccagagcatgaggaattccccagccccttgaggtacccagacactaaccacaatctccatctctgctgaaggcgttgtaagaaacatgcaggccaggaacagtcagtggcttcagagcaggggcagcctgctaaagaggcagaggcttcttgtgagggcggggagcttgagagtgccctgcaccccatcctgggggaggtgagcatctgcttctgggttcagctgcctgcggaagtcagtgggagacaccctttcagggtctgcttcattatgaatgaagcaaaaagcctatcccaggaaatcacagaggctgatgggtataccccagggtacacaggctatatttttccaatccaaagtgagggtctatctgatagtttttcctggagttggggaggggtcctactttcagatccaaaagaaaatctgagatatgtcatttgaatatgaacgcactagactttctgggaaatgttgaagatttacgcctgtctgagtgtctctcactcgttgttacctgtccatttgttacctggcccacggatggaggaggtcggatggggtctcccagggtccccttgctgggcacgcttggcaggcatcctgcttttcctttcaggttgctggaattagtggtggtggtggctcagctcacccagaccatgtgtgatggttatggtggtgacttctcactgactgctgatgtgtacagtacattgaaagcagtcacccaacttcctttatagccggatacaaaacagtgcctgaggtccagggtcggggaggacttgatgagggaataaaaccagccggctcatctaggggctgatatctgtccgtggtgacataagcacacatgatctgcagtcaaggttgacttgagggtgtgcatgggttcagtcccttttatgaagtctaatggtccttccagaagcttcatcatcatttgaactgaataagtgaagatgagtgcaccacaagtgtgtgtgtgcacttcttaatctgtccattcatctgttcactgcaggcttattgagggagaaacatgtaagcaaggtatttcttgtgtactccaagtggtaggagagctatgttcagggaactgggtgaacttggaagaaggagccgcccgtttctccaagtgcagcgccagtcccgagacactctgtgatcatctaaactggggaacagtctgcaatgcacattactgaattaaaagctctgagaagttctacagtgaaagaatctgtttaactttgtttaacctggtgcttctgccatctatatgacccctttttacttagcacttattaacatcctacggaatactatttgagaaatggcaacagccccccttctctgggagaactgttcagtgattcagagcaaaagtcacctgactctgggtcagcacaagttggagaggtttgaaaaaggtgtatgtatgtttgcatgtgtatgtacggtgggttggggggaggggtgtggcagaggaggggccccggcaggtggcttctattgaaatcagctctgtctgcctccctgttggctttgtgcttctggagaagcttttgtcctggcatgaaaacactgaatagcagctgcatctgtcatgcctgggaagcagcaatgtgcagcatggggttgcatgagtagacactcctgctggagggccaggctgccgagagtgcctgggtattggacaagggagaggctggtgattctgaggcagctgcttgctaatcctggaagcagaggggaacaagatttagctcccttatctctctgccttctcctttccgatgggtgcaattgtgttgactcttgagggacagccaggaagaagcaggtgggctggatgctttctcctttctccaccaacccaagggcatctggagggtggaccagggcagaaaggcgattagctctccgttacccagggagctgagacaaaggcattttgggttaaattcaaggaggaattcagaattgtgaactggatttatggaagtttgtggagtttgaaaattcgagagtcctggctggacttgtgcttggaacgttggtcggaggtggatatgaatgatgggtcctgcagatggccgactcctgagaaatgactgggaggctttactggatttttcgcttggaacaaacccaggcttagggaattcccggagcctgttgcaggcctcaacacccttctggtgcagcttcgctgtgaggcagtggttatttctcaggaaactggcaactgggagtaaatgggagtgtggggtgggaatcagctactcttcctgaggattatacacttccagtgtaattaaggcggggtcaggatttcctatctcttatttatttatttatttatttatttatttatttatttatttatttgcttaatcttaaaaggctgcttttcccctcctggtcttcccacagggacaggagttagtctgttcccagaaggagctaggggaggtgtccttcatctcccattccttcttgccctctccctgcctttccctggccacagccacagagacccagagtcactcagatgggggaggagcaaagccagtccctctgatcattgcctctttgttagtggagaaagggcagatgctgctctgcagttatcccgaccaccctgcaggacgtctgggtgggccgggctttggtttgggaatcgggagtattagctgcagctgccaactgggcttgtacttgcagactcccaggctccaggctctctggaggggaccagcagctctgacccccgtgggcttgctgtggtccccagggagcaagcccttgccaagaacctctgagctcaccgaggcgggtatggggtaaggatggagaaggcctggggagcagaagtgtgcagatgactccctccttcccctcagctgggtatgcatcaccgctgctgggaagacgttcaggccacttctagacaaatcggtcatgatggaaattttttcttgcccgtgggtggggctttacttgttcagaagtggcttcagatgtgctctttctaggtcctggcttgagtgctgagcatttacctgcagcccctcggggctagaaggcagggcagtgtctgagccccttccctaccccttggggctagaaggcagggcagtgtctgagccccttccctacccctcattcattctctcccctcacctgtcattccatccgtcagccccgaacagcttggcagccttgcggctccagctggagcttagtaggcatgtagttggaggagggaacggcactgcagccgcgctcttctctctcccacaggtcttcttcttgttgggcctccacttcctgtcagggccctgcttgcagctgtggcacatctggacctagacggggtatcctgttgtcctgcatgatgaggatcccagatttcccctaggtgatgaccacagtcattccagggtgggagcaggacttcccccacccccaggcactccagagacttcctccaggcccccactaagtagtctgttcccaactccatctctcccccatggagaatggtgggaaggaagttctgccagaggttgtttttggtttgtgaggtaatagactttggtttgagaaacatacatctctccctcttctttaagatgtgaagccagaagcaccagactctggtttccttggaaaccagagcagcaaaggtagagaaaaaaggggctggttgtaggcactgaaattggggaggattctctggatcccagcacttttctggggaatccacatggtctgccctgggccctgggttgtagccctcactgtgttaatggactgtgtaaccttggtaaaatgcctgcaactctctgcaccttagtttccgccaagatgcctaaggtggggaacatgttggctccactcagattctgtgccccagagacctgctgggtgtgtgtgggggtttgggggtagggcatggggctcctgctcactgatttagcatttgctgtggctaaactacaaagtggacagtccacatggagacagttgagagctacttgcacccaggtcctttctttgagaatacagtgatgtaacaggagacttcttgcattttgcctatgtgaaaccagctggattttgctgaagctgtaattgtgtctctacattctttgattcctgtctaaaaaaaatggtttccacaaatgctgtgaagaatagactgacagagctggaaagcgttaagtagggatcctttaaacagatccctacattgtacattgatcccttcaaccacagccagagaggggcagggacttacttgctctgatcacacagtcagaacaagaactaacaacagtaaaggtctgggtagcagcctcacatatgctaagattccctgttggctaagtttgtctgttcccaggtcaccctggccttttgcaattctgccctccgcaggcccctgtgttggctgaaaccagccctcttcttccccttgcgctttcctcctgtgacctcccagccacctcttgtttcccctgtggtgttccccacctgttgttacttcctattcctcctcacaactttttattatgaaacatttcagatgtgcagcaaactggaaagaattgtacagtgaacatgattataccaaaccacctagattcaaccattagccttttactatgtttactttatcatgtctctacgtgtttcaatctctctatccattgaccagtccatcttattttggggatgcattttgtagtaaattgcagacatcaatgtactttacccctaaacatctcagcatacataggcattaatttgagttcaatatttgttcatgcatttttttgatgataatatttatattaacagtgaaaaatgcacaactcttaaggtatcacctgataagctttgataaatgcctctatctgtgcaacccaaacctctgtcaactatagaacaaaaagttttattacctaattaattccctcgtgttgtttcccaatcatcccaacacataccccctcgcaagtgatcacagttctgatgttttctcactgtagattagttttgctttttctggaacctcatataaatgggataatcagtatgaactctcccttttgtgtgaatttcatctgcatggtgacatgtatcagtagtttgttatgctgagcagtattccattgtatagatatgataaaatttgcttctccattcccctgttgatggacatttgggctgtgtccagttttgggctatgatgaataaagctcctgttaacattcttgcacaaatcttgttgtggatgtaatgttttcatttctcctgggtaaacaacgaggagtgtgattgcagagttacaggaggctgttacttattgttcctatctgactctctgccctgccctctcattgtactgtgcacccaattattttaggactgttatcacatccagtccctcagttgctccttcagggtttctcttcttccggcaattcaccctagtttattgaactgttgctcttatgttatgctcctcagatcttttatatcctggttgtcctcctctggaagtataatactcttttacagatgtgttgcccagaactgagttctcgctgctcgatgtgatctacatgtggattctaggtatgggagaaatatagagtgtgggtgcatttggatccctgtcttgagctaggtacttgatctgtgagctgaaggaaatattaactttttggcagccacgtcatggcatcagatcagatgagttaatgtttgtaaaaataccacaaatctaaggtcatattaagatatccattcagcttgaagtcagtccgagcctctgatactaatggcatttattatgaactttctacttgccattgtgtcatttagtttttgcctaccacttggtgagaaaggtactattcaaattagcttaataaaaactccttgatttaaaactagggtacttagctttggcactgttgaccttttggaccagataagcctttgtttgttgtgggggattgtcctgtgctttgtaggagttagcagcatccctggcctctacccacttgatgccagttgcaaccatctatctacccatgcccccaagttatgacaacagaaaatgccttcagacattgccaaacgtcccctggggggcaaattaacaccaggttgagaactattcccaaggtgtagagcttagtcaccgagaaaaaatttaaacaatatagctcttcctgaaaggtaatcactgccagctctttagcatatatacttacagattatgctctttctatggacagtcctcatttttcatggttctaatctgtgtgaatttcagttactatggtttggttaaataacatcagtcctcgaagaatttggctcaaatttgagttgccaggatatatgtattacaagtaactgcatgcagtacaaactttgctgttagctcttcagtccacagatcactatgtacataacagatgctcttcatggtcactgactaatcatgtttcttcttgaagagtcttttggtgattggtcactgcctatctgttcacttcacacgcagacaggaaagtgtgtagttgtgttgcctccctgtctcctagtgagaaactcgtgacattttacaaaaatggacaattgatgagggaattggccaagaaagatgaaatttcaaatgaaatgtggtaatgctggtagtgaatttcaagccaaacgtaatggaattatatagactagatagctgactgtgggaatgtcaacactgtcactgttcaagactacatatacagcctgggaaactcagtgaaggtggcatgtcagcataaatgaggaaagtggtttgatgaaaaggatgaagaggtcccagaggaggtgacactgcagaaggaaacttcacattaaaggcaccttgaagatatttcacaacatcgaaagtgcaaaggataaaacgttagaagcagatccaaacttagaaaggagtatgacaatttgcaaaggcatatgaaagatactcattccatattggatgttaaacaacaagaaggcaagtgctgttcaaattactctggataaggtttttacaaagcaataaaacactcattctcagtgactctaatgttttagagtatacacaataaatagttttactgttttctcatttccttatttataatttgacagcaagagagtttttaatgttttgaccgaaatttttaaatgtcgtggaaaaatcataattttcctcattggtgattagggttgctttgcatggtcatttttatggttccgcattactgtgcaaagcaagagctgcctgtatttacaaaaagtgtgggtgaatacacatgcacacatgcacacaccatgctttttctctttttaaaacattttacaaaatgggatcagactatatgtatcaaattacaacttgcttttttcatggaagttttttttgtttgtttgtttgtttgtttttgagacaccatctctctgtcgcccaggctggagcgcagtggcgctatctcagcccactgcaacctccacctctcggagttcaagtgattctcatgcctcagcctcccaagtagctggtaccacaggtgcgtaccaccacacccagctaatttttgtgtttttaatagagatggggtttcgccatgttggctaggctggtctcgaactcctgacctcaagtgacccacccacctcggcctcccagagtgctgggattacaggtgtgagccactgtgcccagccagaagaatgtatttttgaagaacttttgatttcagtatgtcttaatctacctcattctttttttttttttttttttttatgtttttgagacaggtctcactctgtcccccatgctggagttcagtggtgtgatctctgctcagtgaaacccctgcctcccaggctcaagtgatcctcatgtctcagcttcccaagtagctaggactactggcctgtgccaccacacccagctagttttttctgtattttattcgtagagacagggttttgccatgttgcccaggttggtctcaaactcctgggctcaagtgatccatctgcctcggcctctcaaagtgctgggattacaggtgtgcgtcactgtgcctggccccgttgtctattaacagctgtttagtttatttccttctgtcccctaatttgaaataatgctaaagtgaatatttttgatggatactatcataaactccatttaatcgatgagttcaatggagatttagaatgtgaagtaactggctaaggtcaggcagctactaagctttagagctggtgtttgaacttggggcagtgtaatttcagagcccttgcaatcacaatgctttacaccttctcttccttgttcttagaagcagcttttaacaacgacaacaaataataaaaaaaagatcttactgagtcaggtacaattctaagtgcaattatattgttattattcactaaataacaacctgcgagttagataatgttgttatccctgtattacagtgaaggaaaccggaggtataagaaggttaggaaaggtgctcagggcccacagcagtttaatggaggagctgggactgcccccatgcagcctggcttcagaaccttggctctcattcatgttataaagatgtgactagagaaaagtctctttcatcctgtgctgttgaagatgggtttttttgttgttgttgttgttagttttggcgtatattttctcctactgtaatcttttaaaaatctactacctagcacagactgcctctcccattgttttcttagggggtgtcacttggaagtttgataagcttactgcctactatgtctttagtcagcttgttggtaaaatattaatactaggcaaagccagtctggtgtggtggctcatgcctgctgtaatcccagtattttgggaggccgaggtgggtgaatgacttgaggtcaggagtttgagaccagcctggccaatgtggtgaaaccccatctgtactaaaaatataaaaatttgctgagtgtggtggtgggcgcctgtagtcccagctactcaggaggctgaggcacgagaatctcttggacccgggaggtggagatttcagtgagctgagatcgtgccactgcattccagcctgggcgacagaatgagactccatcacacacacacacacacacacacacacacacacacacacacactaataggtttgccactgaagttgttctttgggtttagtcaacaagtagatacttattgaacacctcctaaatgccatgtaccgggtctaggatttgaaatcaaaagatgaacaagacattgtcccagcttccaagaggtacatggtccacagtgaaaagagaaaccgttttataaatcccactggtgagtgctgaagtaggagtttagcaagagtctgtgggcacagagaggcagaggggctgactctgcctggaagtggtcagagaggcttcacagaggaggtgacattgccatggttcttacagacgtgaagtcatgacaaggcctggcttgcctgaggtcaggaagtgcattgtagcttcaatataggggatgtgttgggaggttagggtagcgatgatgtggataggagctagggaagactaagttagggaatttggattttatcatgtcagccagtggagatgtttaaggaggaaaatgtcctgctcagctttgcctttcagcatgtgacccaagatgtactgggatggagtacgtctcccttctagaaaccagttagaaaacacagaagagtaggccaggcatggtggctcatgcctgtaatcctagtactttcggaggccgaggtggacagatcacttgaggtcaggagattgagaccagcctggccaacatgtgaaaccccgtttctaccaaaaaataaaaagttagccaggcgtggtggtgtatgtctgtagtcccagctagtcaggtgcttgaggtgggagaattgcttgaacccaagaggcggagtttgcagtgagctgaaatcatgccactgcactccagcctgggggacagaatgagaccctgtctcaaaaagagaaagcacacaagagaaaaggggctgcaacccagtaagcgatagcaggactggaaaaggaaagatggatttgggagatcttcccagagacaaaattggattgcttctgtgggtgacggagggagagagtctgaggatgagtactcaagatttatatctgggagcctggctagatagtgatgtcattgccgtttactgagatccgggagcaaattcaaaggggccgtgagttcagtttggtgcctgttcagcagcctgtcctagatccaccaaacagcactttattactggccatttataacaactgcaaatattatctaaatgctttgtcatctcactgcctcctcctttgtcatccctaaggtctgggcaggagactgtgttcatatacttcatagaggtccagaccccttgcgtctggcattcctttggtctataattcagtaaactctgctaaaaaggaaacgagactagcttgctgtggcctcttaagcgacccagggtagcttgtgatggttcagattatgatttgttctagagcttttccagaggcagatgttgaggagtttatcctatttgtccccttccctttaaacaaacaaaagtgccggctggacgcagtggctcatgctggtaatcccagcattttgagaggctgaggcaggcggatcacctgaggtcaggagttcgaaactaagcctggccagcatggtgaaaccctgtctctacttaaaaaaaaaaaaattagttgggtgtggtggtgggagcctataatcccagccactcgggaggctgaggtgggagaattgcttgaatctgggaggtggaggttgcagtgagctgagatcacaccattgcactccagcctgggtagcagagtgaaactcggtcacaaaaaaaaaaaaaaaaagaagtcccaaccccccagttttttatatcctcttagtcatcatagtttattaacagttttgtttacatattgcttctttttccctcttggctagactgtgaaccttgaagccctgtgagcttggtctagtgcctggagcattgtgggtaccaggtttcgagagaatgtgtgctgccagaaagcagatctttgccacctcctctcccctcagctcctgaaccactgccagcagtggttctggaatcaacctgtactttccttctgcatcctgggatgtaattctgggtgattgtaagttggtttatggtctagcttagaattgaggcttctcttgagagagagcatgtgtgtaaatgtttagcttgttctagtctgtggagcattctccttcatagaaaagatgggaaatactggagatgaaaattctccattctctgtcattttgtgtgttagagtctctgtccccatcccagggccacttcctccctggttcttcttatggctttggatgtagcttgaagacatgctcctagcattttcacaagctctgcttgttgtgtttagtgagcgcagactactcccttcgggcctgtcctggctcatgggcagttgctcgtgtctttgcacacatcctttactgtctcagctcttcacttctccctgacatttgtggctgcctcctcctggtttcttctttaagcgattattgtgttttagatgatcagaattcactttttagagacttggaccttgtctttcaaaatgcattcccttttgggatctctgcccatcatactccttggtctcaacatctaaatattggttttttttttctttttctttctttctttttttttttttttgagatagggtctcactctgttgcccaggctgaagtgcagtggtacgatcattggctcactgcagccttgacctcctgggctcagtgatcttcctgcctcagcctcctgagtagctggggccacaggctagtgccaccatgccctgctaattttttaaattattcatagagacggggtctccctgtgttgcccaggctggtcttgaactcctccttctcctttttgtatcctcttagtcatcaagccatcctcctgcctcagcctcccaaagtgctgggatttcagtgtgatccactgcgcctgacctgaatattggtttttttgaagtctaggctaaacaactgtttttgtctcagtttttttttttttaatttccctcctttgaactctgaattgacaagcttacttcctcccaatgtggtgttcttgttattattgtttttgctagctgaagtattttttttttttttaaacataatttactaggtttttcttcctggccagaagtaagttcagggtaatagttcccttccttgtatcttcagctgtgtgagaggtaatgtagagtgagaatttatttatcaggtgccctgctcgtagcagaaggcatgacctcgacttctctctcacagtgaccttgtgtttgtgttggtggcttgaactcactcttgtgtctgggccatttctctcactgtgtaggaaagagtggttcctgtcttctccctggccatgtagtctgctgtgtgtcaccataacaatcatctatcttccggttctttttccttctctcctcacccagttgtctccagtcttaggcgtgtggaattgtgtactgggtgggggatgtgtgtgtgtgggccgccctcttgatttgtaggatccttctcttcctccacattctctgtcaactctcctccaccccctgtgagatctgtggactcaggtatacgttgctgtgagtctcattctgctcagctggggtgatgaaggtgagattgcttttgtcgcttcaaagtaaaattttagatttgctttggcagccgcacagggtcgtatgcatgggggctgcttaggccagaggcgcagtgttcctgacctccttccgtcttactttctcttgctagtttgtccatctctgtggattttttaaagtagatactagatacctagatactactaagaacatgatctttctcttcttgccacttggattttagcttaaagccaacttggaacatttagggtgtttccttcctaccactgtctgcctggtctcctagggaaagatgccttgtatcttgttctggtgtacagtctgcccatttaattggtaagtgtttattgtgactcttctctactgggctctggccccaggcctgatgcgaatagggcaggcctgtgaacagagcaaagacgagtcacttaggaggggacgagagaggccagcggtaaactaatattaccagctcagggtttatttgtcaaagcctcctttgctgtgaataaaaggttagatctgaattgggtctgagtcctggctttattacctactagccatgtggccttgggcaaattattaatacttccttgggccttggttgccgcacctgtacgatggagtcagcaatggatcctgttctgtagggctgctaggaagcttaaatatagcaatatttgctatatataaagtgcacctggtacataattgatgcggttgaaatgaaaattcctctttctctttcagtgccatttgctggaagaaacagaagaaatatctctgtccccatctttcagtttcctacccaagactcctgtgtggttgacatcactgctgtgtgcagtgttcatgtccatataagtcagaagtggcttgcagcagtggtttggggctttggggcctctgctcgctccttatcaattcttagggttacatcctctgggaagatgccaggcctggtcaagtgtggcctctgacctagagttatgcaaggcctctcttcctcctgtggccagtgtgaaatttctcatctgtgctctcctgcctctagcaggaaggttggcctacatttggggcacatctctgtcactgtctcaggccaggggttcaaatataagacctgaatcatactgcacctcagaacccaaacccttttacttaattttttttaaaaaatttcattcagatggtaaaggttcaaacaatacatagagatataaaacagaaagaaaaaaaaatacacgcctctctctagtacctattccccagtagtcaacactgctaccttttttttgcaggggaggtaaattcctccagaaaaaaacttaaacatctacaatttcatatatcctctcccctcttccctaaaaaacaaaacaataacaacaaaactatagaaatgggattatgctatatattctgttcagtacttttttgtttttgaaaatttaaaaaatatgcaaaagaagaaaatgtcatccatattactaccacttataattaaccactaattaacttttaggtgtgtttgcttcttgtctttatgaatatactttaaaagctacttaagtaaggtggaagcagttctgtttaaaaaattaggatgttgcccgggcgctgtggcttacgcctgtaatcccagcactttgggaggccgaggcgggcagatcacgaggtcaggagatcgagcccatcctgaataacatggtgaaaccctgtctctactaaaaaatacaaaaaattagccaggcatggtggtgggcgcctgtagtcccagctacttgggaggctgaggcaggagaatgacgtgaacccgggaggcagagcttgcagtgagccaagatcatgccactgcagctccagcctgggcgacagagcaagactccatctcaaaaaaaaaaaaaaaaaaaaaataggatgttaaagataaagccaaagtattatatcatcttggtccttatctgctttcccatttaatagcatcctgctctccccgtcgccgtggatggggagctgcctctttcttctacgacaccgcacgttttccattgtatggatttgctgtcatttcatttatctgaccaccctcttattggtaggcatttaggttattaccagtttttttgccattaaaatgctttatgaatataatgtgtaggatggtttcttgctgggtaattactgggtccaaggtttgaacatttacaattttgatagacatggccaaatacctccccaaaaatactagtttatttctctaccaactgaatgtgtaagagagtgccttttctccccagatctttgcataaacctgggagttttattttggtcaaacattaaaattttttttttgccagtctggtgaaattatcatcttttttataaacatttctctttgagctacactgagtgtcttccattcagccatctgtgtttctcttgctttgaactgcctgttcttatcgtttggccatttttatattaggttgttgatcttcaacaattgatttgcctgagttaagttagccttttatccatcatgtgttggaaatattttaaagatttgtcatctacagtgcgatttttaggcctcttgactttttgttgagccctaggcttttgtgactgcctgtgacagctctggagagggggccgacaggcacagtggcccgcagtcgagccaggccccatcttctgggcagtgacgcgtggttgttttaaggcttttggtactgggattccccgttgtaagttttagctttgttttgggtagggacttttccccatcatattaatgaacattaataacaaatagagacttgcttttgcctcccaaccaaatgtttgggaatgtgtgcacccacgtgaagggtctgtgtgatatctttatctcatcaaccttctaaggcttttaaaacctgttgttagatttatgtttagatcatggttctaggggagaaccatcgtcactcctcattgagctttgcagaggctctgaaaggaggacatactctcttccccaatcaatgtagaggaacgtcagtagttcagccaagattgctctatctgccacctcttatgcttccaagctgggctaattgagaagtgtgacatcttgctccagcctataagcagctgtctgtaattttgagagatgagaaggattctcccttaaaccattgctgcttttgtggcagcatcttatttctttcctttgcagcacaaatcacagtgtataattaaaactattttctttgagcttgtttttggtgtacctcctgcactaaaatgttaagttctgtggcggtcacggggcttatttgtcatgttctctattatacccttggcatcctctaaaccagtgtgtggcacatgctaggcactccggggtttcactgagtgatccattctgttaggatgggatcaagtgctcatgtgtctcctcctgtgtccctctctggctccagatcttccacctggcagagtttccggaagccccagagatatgctccatggccatagggcctgagacgtggatggctgccctctgactaaaatttagagagctaagcttgtctctttaaaaagtaacatatactaattgtaaatcacctagaaaatacagacataataaaggaaattaaatctgtgattctgtctttcagagatcattaccattaacaactcattgagtcttaatgcctttattgtttttgttttgttttgttttgttttgtttttgagacagagtctcactctgttgcccaggctggagtgcaggctcactacaacctccgcttcctgggttcaagtgattttcccacctcagcctcccaagtagctgggattgcttacaggtgcgtgccaccatgcctggctaatttttttgtattttttgatagagacaggctttcagcatgttggccaggctggtcatgaacttctgacttcaagtaatctgccccccttggcctcccaaagtgctggggttatagatgtgagccactatggccagcccctatgcctttattttttttatatacagatccaataaatatccatagagcactgagtttatgctgtacataagggtttgtaactttcagttaccatcagacatgttttgataatgaaatttaaagaaagtacacattgggatttgggatgcagaagaaaaaataggatagtattctagacaatgacagtgatgatacctgagaatctagtagacactcaggaatccacatttccccatttaatattcatctgaaacaccatttcagtggctgtagattgtgtagctaaactcacttttacataaaacaacctctgttacttatctctgggccttaagtttgtgatatagtttggatgtttgtttctcccaaatctcatgttgaagtgtaatccccagtgtgggaggtggggcctggtgggaggtgtttgggccatgggggtaggtccctcgtgaatggcttggtgctgttcttaagatagtgagttcttaggagatctggttgtttaaaagtgggtggcaccccacccctgttgctcctgctcttgccatgtgacatccctgctcccccttcaccttccaccatgattgtaagcttcctgaggcctcaccaaaagcagatactagtgccaagcttgtaccagctgcagaactataagccagttatatcttttctttacagattacccagtctcaggtatttcttaatagcaatgcaaagtagactaataagtttgttagctatttctagtaaaggtaaataactcttgagatgtatattttcttaaagatacgtctatgattaatacctgaggatgaaattctaaaagtagaattttaacatcaaagggtttgcactttaaggcattttcagcctccatttctggctgttgctgttgtggacagtcttgggcagattttgaactctttgccttactgtggggtggtggaaaggaggctttaggagcagccagagcagggttcaaactccagccctgccagggacaactggccaaaaggtcgtgaactaatgactcagtgagttttctcatttataaaataggatgtttcctcccagggtgggggtgaagtgggtgagatgacccatttgaagcacagtggacccttgaacaatgcaaaggttgggcagtcaattcacataaaacttttgatctgagttgggcagatcacctgagattaggagtttgagaccagcgtgaccaacatggagaaaccctgtctctactaaaaatacaaaattagccgggcatggtggcacacgcctgtaatcccagctactcgggaggcagaggcaggagaatcacttgaacccgggaggtggaggttgcggtgagccgagatcgcaccattgcactccagcctgggtaatgagagtgaaactctatttcaaaaaaaaaaaaaggccaggcacggtggctcatgcctgtaatcccagcactttgggaggccgaggcgggcggatcacgaggtcaggagatcgagaccatcctggctaacacggtgaaaccccgtccctactaaaaatagaaaaaattagccaggcgtggtggtgggcacctatggtcccagctactcgggaagctgaggcaggagaatggcgtgaacccgggaagcggagcttgcagtgagcggagatcgtgccactgcactccagcctgggcaacagggcgagactctgtctcaaaaacaaaaacaaaaacaaaaaaaaacaaagaaacaaaagaaaacttttgattcccctagaactactattaaataatagcctactgttgacccgaagccttactgattacatagttgattaacacatattttgtctgttgcgtgtattatatctttattcttgaataaaataagctaaagaaaataagcatcgttaagaaaatcactttgagtaggctgaggaagaggaggaggaagaggaagggttggtcttgctgctgcagggctggcagaagtggaagaaaatccctgtataaatggatccacgcagttcaaacctgggttgttcaagggccaacagtacttagcagccatttagcacagagcactgccagcccccctcggcctgcagcctgctccagcaccttgctaagaggttgctgaggctcacctgcagcagctgccctcccgagtcctctttcctttacacccctcagagcacccgggccagccatcctccatgtggtgcagcagaggcgccggtggtccgggaaccagagtgggtggccctggcctggaggcacggtgggttagtgtgtgacacacgtggctttcccccgacccccagctgcctcctgggagtgaagaggaggtcttatttgccaacacataccgcaccacacacccacaacacacttggtgccagaatcagccttttgcatcgctcttggcgctgaatcagagtctgtcttggggagggatgtcttccttctctcattacatgcgcccagcttaggtggtgtagtgagggagtgtacagggctgggatgccacagcctgctttcctccccgtgtcctggggtcccccgtctgtccagtgcccagagctattaataacaccttcattgaaatgggtgtaatggaatcccagttgccccccccagtgggactccaacacatggggagtggggagcagaataataatagcaaacacggatgcagtacttattacgtgccaagcgttattcttagttatttacatcatgcacatctattaactcatcttgtatagcaagcccatgaggtggggactattactgtcctattaatgggtaagggaaccaaggcacaaaggggttggaaacttttcccagttcacatagctagtgagcagtggcgcttgtgaagggggtcctcctgagggcctggggcctgctccttcccagtcttgtcttcatgtccaccttgctgacgagtggcacatcaggccctgggtgccggctgctttcctgtcctctggctcagccaggcttctaatgctgaccactcctgagtctttccacgtggctccacaatggcagacttgcaggaggagatgaggggaaccatgcataccttgaatagggggaggggtcctgtccttcttcccctcaggtgctggaagagacagagaggcatgggactgtatttaggcagctcccgcagctccctcactgccgctgtcctagagcttccttcccaggcaatgcgctctgtggcttgggcccctgcccctgccacagttggcagggggccttgcctgtggcgttgcagctgagcacacgcaatcattaaccttttctacgtgtaagagaatttcaggcacaaactgtggggctgaggtgagtcacaatgttggaccggggcttagtttgggcttaaaatatttcacaattcctccaggcattctttgactaatgatctatggctttttagtgggaagacccttccttcttctagtctccagtcctcagagcatggttcagggcctgttggccttcactgcccatggccatgcccatgcccaaggagcaggggccttggcttctgggtggacctgccgcctcgctctgctggtggcctctggcagtgccctaggagtcctgctttccttccctgtctcttctttggcttggagtgcaggccacctcccctgctgttctttacttagccctgtactccagattagcacattcttggtttcctctctccaggccttctgcgctccacacttgtccacagagccactttggcacttcagggctgtgcccccaggacgtcagccagcctgcctcgcccatctgaagggctttcattgcttgggttgattttcttatccagtcagggatttctgataaacatgtgcctggatggatgtcaatgaccagtcctttttttttttttttttgttaaatttaatttaagttctggaatacaaatgcaggatgtgcaatgaccagtcttcatgggaaattcttgctaagtttctctaagaaatttaaaatactaccttttccaatttatttcaggatggaaaggacagctcaccctcagtcactgggggagagagtttagtagggagaagaagcaacagaatgagggggtgttagctcagaagttcctaaccactaggtgagggaaggaagaggggagggagtaaacagaaatcaaattagatcttgcccattagaaactcagttaggttgggcagataaggcataaatatgcaaaatggtaaattttttcaaagtggaaactaccctatatagagtttctgaagcaccttcaaggatattatttcacgaagttgaatctaattttacagatgaggaaaccctttccagaaagataggtgggcttgcatgacacaagctaggaagtgcagaactgggattcaaaatgcatgcgattgcaaagcctaggttcactgtgctacatccgtctcctctaatgggtagagagtttgtgcaagtctggaagtgtgatgtgaacctagcccttcttgcacaaactctcctttgccttgtgccacgcactcctaacgtgttcagggcagaaagtgcggaagttgcagtgagcgcttggaattcagggggtgctaaggagcatgcatttagatttggatcttggtgcatcctcacttagcacagctctggttggcagatgtcctggtggtcgtcactgggctgaagacagaaacccagcctacaatcttggtgataacttgtgctggttacatccacatgctccaagctcaactcagtggtgacggaggaacccccctgtactgtggcattaatggtactggttgacagtgatgaatgcctttctgataataaagcacttttagaggtattatttcattagatgctcataatgtttctatgagggggaggctaggcaggtatcatcgctcctaaatgcatgtggcacaggctctgaaaggtagacctctctgtgaggctgtgcaagaagaaattgacaaatttcagactgggccaagtcttccctgattgtaactctacaaccaggcattgcttctgagtaaatctgacaactttgattcttctcctctgggctccagttcctgtgtgcctgtagggggcgatcgaggttctttctgcttggctgctctggaaaccttgttcctcctgaaccctttgaatttagcactcttacagcatgtaatctcactggattttaaggattttctgtgtctcccctcatatcttcttctgccccccactagcctaggcttttccagatcaggactgctctatttggttttgacattcagtgcaatgcatggcccatagtaggagctcagtaaatgcttgctggattgaattatatacaaaggaaattggccagtgccttctcttgctccccttagagcatgggaaagtaaacttttttcctggtacatccaaatgaatgaagttgaaggctgggcatggtggctcacacctgtaatcccagcacattgggaggccaaggtggggtatcacttgagaccaggagttcgagaccagcctggccaacatggcgaaacccggtctctactaaaaataccaaaaaattagccagacgtggtggctcacacctgtaatcccagctactcaggaggctgaagtgggagaattgtttgaacccgggaggcggaggttacagtgagccaagattgtgccactgcactccagcctgggcaacagagcgagaccctgtctcagaaacaaacaaaccctaatgaagttgaaagtggcagaactcaagacccatgaggtgtcctcatatggccacaaggtggcagtgtgacctcctgggaaccttgcctcctgcaactattggctccggccacctgttactccatgggagagaccgagttatctagtcattgattccttctagtcacctgtttggggaattgcctctgcaaagtcagtctgagaaatcttggcttccagcctcctctaaaagctgggtggtgtggtggaaagacttggtctttggagtctaccaggcctggattccaaccttggctctgccttttctcagaaacttagccttgggcatgctacttctctgagcctcagcttccccatcctgtaaaatggcaaatgtacagttaggaaaaacccaacatatcatgggccatagcataaatgtatgccagcattcttgttggaaatgctcatttgtccttcccttccctctgcaagctggctccatcatggccatctgatcttatttgcaagcttcagacactttccagcaggttcttaggcctccctgctgtatcaccccagctccactccatctcggtcagtcagcacctgcttcccacgtttccctctgccttcatgccttccctctgcctgtccatttccttcccagcatgtctcttggacaccccagccctctgaatgtccaaagcagttggagtgtggactgtgtagggctcatcttgacttcccatgaagatgctaaatctgtgagtgtccttgtcttaattattttggcacctgcgcttgcacttagacaattggtgataaaaatgacagctattagtgagtgcatgtcagatactctgtgaggtgctttgtggaaatatttcatttaatcctcacaacaaatctgtgaaacagaagccattatccatccccactttacaaaggaagggtagatcaggatgcttttggctccaagcaatagacaatttcatgaaaagcagcttaaacagtaagaagagtttattatcttgtcaaaaagaagtactgagggatccctggtgatggcagcgaggatccaggtgattgccatttctcctggttgccttcctcagtgcattggtttatcctcttaggccccccttactggtaataatgtgactgtcatggtcccaggtgccatatgcaggagagatgatgtacatttcttgtgctccctttaagaagcctcttagcagatttcttttttttttgagatggagtctcgctctgttgcccaggctggagtgcagtggcgtgatctcggctcgctgcaagctccacctctcagggttcacgccattctcctgcctcagcctcctgagtagctggggctacagtcgcctgccaccatgcctggctaattttttttgtattgttagtagggacggggtttcaccgtgttagccaggatggtcttgatctcctgacctcgtgatctgcctgcctcggcctcccaaagtgctgggattacaggcacgagccaccgtgcccggcagcagatttcttacaaggctcttggccagttgagttgtaggcttgttcccaagccagtcactagcaaagggactggaattaatgagactggcttagacaggtcaagattgaacccctgaggctggtgagaagccagcctcctttaatacccctagccaattggtccagggagaagaaggggcatcagtgaggttcgacgagttaagtaacttgctcaagcttggaaatctagtaataactggattcatactggcatccggctgacttccaaggccatctgttgccaggttgaagtcaactacagaggtagagagaatattgctctggatttgttgtgctgggtctgagtaattgctgaggggccttttcctatggactctggagtctctcttctctctagccccctttccaatactgtattggtttttctcagtctgcctttctccccgaagccccttcaccccctgcttcccagtacctgagtgctgcctgccttccacagtagactttatggcctaagctggagacaggtctaagctggaccgaatggcctgagggctgatctcagtgtagctgtcaaggccccaagagagtcatcatgagatttcatatagagcagataaggaactgcagaggcctcaggaaatgtgccaagggggctggtggggggggccagcaggagtggggggtttgtggtatgtcggtggcgatgtcagggcatgtgggccaggggcttagagcaggcccatgtgacagcgcagttactcagaaagctgtttggcctgcagatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatggtaagcagccactgttctagtcccggcccagcctgttcccactcctcactcaggcaccttaccctctgaggacagcccagggatgggcctgaagcctggaatgtaaacacttgattttttggggggcagtggagagtggcggcgggctgttgtgttctctggatctcactgtggcttcatttcagtttggacggtggagaactctttagccgaatccaggatcgaggagaccaggcattcacagaaagaggtagaaagggtctgttgtgggagcacgtgcaggcaggcagggcagtgggggtctgaagggggcctttgcagtgcctgctcttggggaagggtgctgaggctgctgccccctccagcatgctgcaaggggtgcctcagctgaccagggaagctcctggtggctttgtttctggggtgggtggtggctgtggggagcctcaggctgcacagaggtgggacccggtgcactgggttttcaagcctaatgatgtgtctttgtgactttctttcccactcactcttccctcccctctacagaagcatccgaaatcatgaagagcatcggtgaggccatccagtatctgcattcaatcaacattgcccatcgggatgtcaaggtgccagctgttcataaccctgagcccgagtgctgtggggggcaacaaaggggctgtggccaccccagagatggttgccaggccaccctgcgtccttgctgcctggttcctgagcatgccattctctgccttgtagggccttgccctctctgcccatgggcaaacccctaaacccagtagtgaagcattctctggccccactcagccctgtggttctcctcaggcagaacccctcagtcacactcttggtttctctgttcctgtggtgtttactgcgggttctgtgtgtcagtctgttatctccaggcactctggaaaccctgcagaggcaggcacctgcccatagagagctgccactcctcgtggtgggcagtgcccaggataggcaaatggttgctggatgagtagaggaagggaggaaccaggatccttttcgtttctgatagcccctcccaggtccagcagggttgctatttttctgtctctctttctgtagcctgagaatctcttatacacctccaaaaggcccaacgccatcctgaaactcactgactttggctttgccaaggaaaccaccagccacaactctttgaccactccttgttatacaccgtactatgtgggtaagtccacagggggcccagggacctaggcttttcccagaacttttctcagcccctcctcttggctatctggggggccgcaaatcctaggagagttgtgtctgtatggccccttctggtgctggttctgctgggacctgctgagaagtagggcttgtcagagcgaagctacagttgagaaattgtaggaaaggatctgctgggatctttctgagaagagccatggtttccatcagattctccatggagtctggacccaggtcttgttctggagccacagctgattggcatggaagaagctttcaaagcatgttcagagcatctgtgaaattaaatgaacggcatgggcctgaaagtctcatgcagttcaggatttttagaatcttaagctcctagttccaggttcctcatggaggaggatgttctgttccagtccctgggctgggctttggctcttccttctgtgccccaactgctgccacctcatgataggctgaaaggttgggatggggagcatctttcacagagaaactgagtggatcacagggttctgagggccggcccacccatgttgacctttgatttgcagctccagaagtgctgggtccagagaagtatgacaagtcctgtgacatgtggtccctgggtgtcatcatgtacatcctgtgagtgtgctggggagggggctgggtggggcagggagtcagggcggcctgtacttctccaggacaagaggaagaggcagacgttagcattcccctttgtacaggggagtcccctgcgtgccccttctctcagttccgatagctaagtggcgggtgtaaaccagctcatgggctggaaagtgtgcgccttagatacttgctatgctggattcccgggccccgggcttgactttgtatattgtgcctgtgtcaataagccctgatttctctgtgacctttacaaggagaagagcctgtttctcatcctgttcctggtacagggccactaagtgacagctgttctgtctcccacttccttcctcctgttgatgcaggctgtgtgggtatccccccttctactccaaccacggccttgccatctctccgggcatgaagactcgcatccgaatgggccagtatgaatttcccaacccagaatggtcagaagtatcagaggaaggtaagaacccaggctttcaggacaaggggaagagcccgtgtgtgtgtgtgtgtgtgtatgtgtgtacacgcagacacatgtatgggcctccatctcatgtgcgtggtgtaactgtgggttagcacctatgcccacgcctgcggggtgcgtcctgcttcattttgcctgtgtggagggctggaggcagggccaaggctgtggggctgtgcagggcctctcaagtggtacagccgtaatggtccttggggccagttgctccggcagcctgcctccatgcaccccctctttgaacctggtttccccatgaaaactggggaaaggagcaggccagggagagtgacccctgagctgtcactgccccctgtcccaccccacagtgaagatgctcattcggaatctgctgaaaacagagcccacccagagaatgaccatcaccgagtttatgaaccacccttggatcatggtaagctcggcaggctggggagccttgggtctcacgggactattccacaggacagagtcttagccaggaccctaccccaggctttcactcggaccccttttctctcttctcagcaatcaacaaaggtccctcaaaccccactgcacaccagccgggtcctgaaggaggacaaggagcggtgggaggatgtcaaggtgaggggcaccactgggtgagaggggctccaggtggggtgggcggcttgcggggagtgcccaggtgtgaggcgtggtgctggtaggggagagcttgattctgcctctctcatcccaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 35881 - DNA, 17087 bp, Homo sapiens
cccggcaaccacgagcccagccaatcagcgccccggactgcaccagagccatggtcggtgagtgctgcaaagggcggggtgcttggcggtcgtctctcgagcactggtgcctgtggaggaggttgtaggggcttggccctgaattttgttccttgactcaaaacccacaaagggaagagattagggacctgggatgagccttgatcggactccgggagaaggagagcttctgtttgtatccggtgtcgcggatccttcctcactccaccccacgaactctagtgggcatttaggagaaacttgaccttggaagcagaaattccctccaaaactgtggtcagaaactggccgtcagaggccaaatcaggcttacggtcacagcccatacctcttttggtctatagtatctaaaacactttgaaataagttgctaacattaaaatgggtgatttcacttaaaaatgtggattccgagcttctgaagaaaatgagaatatctggcgattggtggacaggagtggaggaaactgatgcctttggtttgacggagaccagaaccggctccaggctgccaggcacaggttttgttttgttttgttttgttttgttttgtttgagacggagttttgctcttgtcgcccaggctgtagtgcaatggcgctatctcagctcagcgaaacttccgcctcccgggttcaagcgattctcccatctcagcctcccgagtagctgggattacaggagtgcgccatcatgcgcggctaatttttatatttttagtacagacgggtttcgccaagttggccagcgcggtcttgaactcctgacctcaggtgatccacccacctcagcctccccaagtgctgagattactgacgtgagccaccgtgcctggccttgggaggcattttccattgaggcccttggattaggcaaacctgatcagatcgtactggatccgtttctagtattgggtccacttcagtgatagagccttcccactcggccatcgaccctaggggaactcagaggtcaccccagctccacccaaggcataaataaccagctgagacaactgcagggattgagagctgtttcccaaataatctcactctgagattggacagtactaagatttagaaagctgttgcctcatctggggcagaatcctgtgttttgtaatttccttccctgtggacctggtcctgcctctaaaaatgcgcctgtacacaaagaagcccatcttggtcaaagtgagtggaggaacagactgcccttgcagttgacaaactgaaattatcaggatctctgagaaagggactaagctggggattggtagcccagcatgagttactggcagagacagcagggaatagattctgacagctgagaggcttgccgcatacacggtggttgctgtttcccttgtatttcattcttcagcgtcgaggcactggcaccctctcctccaatactagggcaggaactatttcctgacttttcaatcttacagaatgttctgtatttacgtgtagcttaaacacaaaaaagggcggtggtaatgaggtgaaaagggaagacttggatcttgtataattagttttagctgtacccagctaaccaaatcttgaggttaactaaagcatccaggttttttgtttgcaactaatagatgcatctgatttgcactcatgttccctggagcactcaagtgagaagagaaggcagaaggagaatgcatgaaactgatacaaaggcttatctttatcatacttctttttttctttttgagacagggtcttgctttgttgcccaggctggagtgcagtggcatgatcagggctcacttcagccttgacctcctgggctcaagtgattgtcccatctttgcccccgagtagctgggactacaggtgtgtgccaccacacccagctaattttttttggtcagagcagaagaacttgaaacccagctaattaaaaaaaaaaaaaattttggctgggagtggtggctcattcctgtaatcccagcacttttgggaggctgaggcgggaggactgcttgaggccaggagttcaagaccaagattcagctcaaatggcaagctcctctgagggcctttccgaatgggccagccctgaggtcctgaagttttcctctgttgaactttttgagatggagtctcactcactctgttgcccaggctgtagtgcagtggcgtgatcttggctcattgcaatctccacttcccaggttcaaacgattcttgtgctgcagcctcccaagtagctgggattacaggcgcccaccaccacgcccagctaattgtgtatttttagtagagacggggtttcaccatgttggccaggctggtctctagctcctgacctcaagtaatccacccgcctcggtctcccaaagtgctacgattacaggcatgagccaccacacccagccttctgttgaactttgtcccttacctctcctaacacactaatgccattgtaccctgaagaggttatccgtgtgtgcatcttgtggcctctctcagggtaaactctaatagtctaactcctcccaggtcatgttgctcagctagttaagtggcaggaagggaaaatgaaccctccagggcccagaaaacttttaaattgcctattcacaagcatctttttgtttgtttgtttgagacagaggcttgctctgttgcgcaggctggagtgcaatggtgcgatctcggctcattgcaacctccgcctcctggattcaagcaattctcctgcctcagcctcccgattagctgggattacaggcacctgccactacacctggttaatttttttttgtatttttagtagagacggggtttcaccatgttaaccaggctggtctctaactcctgacatgaggtgatctgcccgcctcagcctcccaaagtgctgagattacaggtgtgagccaccgcgacccacccacaaccttcttttgatcatttttcttttgagttgttttggggatctacctattccaggtactgcactttgatggttatatttgttgcaaatatattattcctgcttgtgtgttgccttacatgaaaaattgtaaagtcacaggcctgcttatagctattagagtctgagctccttgaaagagcaagagatggatatcctgatttgctcattttctgagaagtgccttgactgtcttactacttagaaaatgcttgttaacattgatgagaagtcaataaaataaaaactgttggctgggcgctgtggctcacgcctgtaatcccagcagtttgggaggccgagacaggcggatcacgaggtcaggaaatcgagaccatcctggctaacacggtgaaaccccgtctctactaaaaatacaattagccgggcgtggcggcgagcgcctgtaatcccagctactctggaggctgaggcaggagaatggcgtgaacctgggaggcggagcttgcagtgagccgagatcgcgccactgcactccagcctgggcgacagagcgaaactctgtctcaaaaaaacaaacaaacaaaaactgtcagagcggcgatcagtaaacattgataagactaatggcaaggtaagttacaaagaaaatgcctgttagagctgaatatgctcacttccctcccaatcatgttaaatccatgggttaaagaggtaggaatttgttgaggcagcctcagagcttccttttcctttttccaagctatcccaagcaagtcaatcacttccagcgcattgaaatcatcaccagacacctattccactgagtcttagttttaagagtccaaaaccctaggaccaagtttggaaatcccctggtttggcatattgggccctgaaagttacacttcgctgaatttagcccaagaggcacttgccttgctagatgtggtcaataataaaagcaggaagagagcttaaggtttaaatgtgcctttctagttattttagttatttctagttattcagatggtgcaaaaaagttgcagatgccggctgggcgcggtggctcacgcctgtaatcccagcactttgggaggccaaggcaggtgggtcatgaggttaggacatcgagaccatcctggctaacatggtgtctctactaaaacaaaaaatacaaaaaattagccgggcgtggtggcacgcgcctgtaatcccagctattcggaggctgaggaaggagaatcgcttgaacccgggaggcagaagttgctgtaagccgagatggcgccactgcactccagcctgggtgacagagcaagactccatctcccccgcccccacccccaccctgccaaaaaagttgcagatgccttctctcccagctccacccactgttcatggtagggtatgaagtagcagcgcacattatcaggagcaactgtgggggtaagcgtcctttctctggcaattcgctctatgcccttgtacgctgttgtttgtatttctcactgtttgtaagtctcactgtcgcccaggctggagtacagtggtgtgatcacggctcactgcaacctccacctccctggctcaaatgatcttcccacctcagcttcctaagtagctgggactacaggcacacaccactacgctcagctaattttttttttttttttttttttggtagaaacggggtttctccatgttagccaggctggtctcaaactcctgggctcaagcaagctgcctgcctcggcttcccaaagtgctgggattacaggtgtgagccaccacgcccagccactctctgtgtttttaaattattccagcttcaccacttaatgactacacacttgggtaacttgcttctctcctgtgcctcagttttctcatctgtaacatggggctactcatggtattgacctcatagggtgtgtctcagtctattttgtgctgccatacataatacttgggactaggtagttaataaaaaagagaaattgatttctcacagttctggaagctgggaagtcgaagatcaaggtgctggcaggtttggctgtctggtgagagctgcatttggaggaatgctgcgtccttacatagacggtgggaggtagaaggtggaagggcaggtgagccccgtgctgggcgaagcctcttttatgagggccttaatcccactcatgaggaaggagaccccctcgcctaatcacctatcacaggccccatctgttaatcctctcacattggcagcacctgaattttggagggggacacgtttaaaacatagcaggttgtcctgacaaaggaagaaagtgcaggccgggcgtggttgctcacacctataatcccaacattgtaggaggctgaggcaggcaaaattgccccagcctgggcaacacggctccaaatttgaccagcctgggcaacatggcaaatccctgtctctacaaaaaaaaaaaaaaaattaggtgtggtggtgcacacctgtagtatcagctactcaggaggctgaggtgggaggatagcttgagcctgagaggtcaaggctgcagtgacctgagatcatgccactgcattccagcctgggcaacagatcgagaccctgtctcagaaagagaaaaagaaaaaaaaggaatgcaaagcacttagggcagtgcctagcactaaggatccactaaatactgttcttgcaaattgaagcatgctgcctctgacaaccttgttaatataaaagaggcccatttcccttctacctgtacctctttgccatttcttataaaggaagctgagctgttaatagttcaatgtgattggcctggcacggtggctcacacctgtaatcctagctactggggatgctgaggcaggagaatcgcttgaacctgagaggcggaggttgcagtgagccaagttcatgccactgcactccagcctgggcaacagagtgagactgtcaaaaaaaaaaaaaagtttaatgtgatcactgcacatttttccccctcataccaaggtgctgcaagtctacatacaaatatatgtcatttctttttttcttttttttttgtattttcttttttcttccttcccttccctctctcccttcctctcacttctttcattttaaataaaaatgggttcatattcacttgcttttttatcagttaataatatagcatggatatctttttgagtcactacatatagttaattcattttaatttttttaatttttaaaatttgtttatttgagacagggtctccctctgtcacccaggctggagtgcagtgcggcgatcacggatcactgcagcctcaacctcctgggttcaagtgatccttccatctctcagcctcctgagtagttgggactacaggcatacaccaccatgcccagctaatttttgtacgttttgtagagaagggatttcgcttttgtcatgttgcccaggctggtcttgaactcctgggctcaagcaatgttcccgccttggcctcccaaagtgctggaattagaagcgtgagcaaccgtacctggtcaacagtctctaaaaatttttttttatgacaaggtgtcactatgctgcccatgctggtctccatctcctggcctcaagggatcttgccgcctcagccttccaagtagctggattacaggctccagccactgtgcccagccagtttaactcattcttttttatatattttttacttttatcttaatttatttatttttctgagacagggtcttactctgtcacccaggctggagtgcagtggcaagatctcagctcactgcaacctctgcttcctgggttcaagcgattctcctgcctcaggctcccgaatagctgggattacaggtgcccgctaccacacccagctaatttttgtatttttgtagagacagggtttcaccatgttggccaggatggtcttgatctcttgacctcgtgacctgcccgcctcagcctcccaaagtgctgggattacaggctcgaaccaccgtgcctggccaactcattcttgttaacagcaaaatatcctgtagtgtggatgtacccataatttcttaaaatgttccccatagacaatcaggttatatctaatttttgccagtgaaaagcatggtgtaatacacatctttgctcttatagcctgaagcttttagtctgtagaacagattcccccaaattggagagcgagataaaagatttatgtgtctttaaagtttcaagagattctgcctcattactttccctaaaggttgaggcagttcttatccccaccagtaaggtgccaatttttctgttggtacaatcttaataaccctgggtgttatttgttttacattttgtgggtaaatgtaaactcacggtaaatgtaaacacagtacccatgtaaacgaatgggtaaatgtctcattttaattttgcttttcctgacaggtcacgcagagcatctttttttttttttgagacggagtctcccattgtcacccaggctggagtgcaatggtgcaatcttggctcactgcaacctccccctcccgagttcaagtgattctcctgcctcagcctcccaagtagctgggattacaggtgcctgccaccacacccagctaatttttgtatttttagtagagacagggtttcaccatgttggccaggctggtctcaaactcctgacctcaggtgatctgcccaccttggcctcccaaagtgctgggattacagttatgagccacagagcccagttgtcaacattatttattaaatcagccactgatttaaatgcttcctttaatcttcagtgcttttaaggggaaaatacatttctggctacaggagatggaatgcaataacctaatgtcaaacaaagccgccccctcctttacagactgcaactcccctgtagctgaaggtttgctggttggtaatgggttttccgtgtgtgctttgtgtgtgtctctgtaggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaggaggagttcctcctcccctctttaattagttctttgcggatctccttgcctgtgggtcctctggcccagctttggcccctctggccccagcctctctttttcttctctgcaggtaaactgaaggaccctgcgaactttcagtatcctgccgagtctgttctggcttataaagaaggccatctgagcccagatattgtggctgaacaaaagaagctggaagccgcagaccttgtgatattccaggtatggggggacatcggaaggggtgtcagggacatttgcgtgcttattgtcctagacatgtacctaattagctatgagatcttaaacagttacccactttactgcattctctgcaaataagggtgattactttaaaggtgcagtattacatggatttcacagatattgggaatctggctgtattactgttgcatgtgtaaatgcaactgcaaggccaggcacggtggctcacgcctgtaatcccagcactttgggaggccaaggcaggtgaatcacaaggtcaagagaccaagaccatcctgaccaacatggtgaaaccctgtctttactaaaagtacaaaaattagctgggcgtggtggcatgtgcctgtagtcccagctactctggaggctgaggcaggagaatcacttgaacccgggaggtggaggttgaagtgaaccaagattgcgccactgcaccccatcctggtgacatggcgacagagcgagattctgtctcaaaaaaaaaaaaaaaagaaagaaagaaatgcagctgcagagatgatgtacagtccttgagcttgctttcttccaggtacttagtctccccttcagttagcgattccttcagttagcgattccttcagttagcgaatcctgcggttagcgattcctgttggactctctcaaaatttgcagttctcctcctttctccataagaatcccaaatactttgtagaataatccatgagacattgacttctctgccattgtagcctgccagctgaagggggctttgaaaccctgctgaatgtgttcctgcagcaaaccacggcctttcttcttcgggaagctgccttaccgtttagcagacaatgctgggattgtgcgtgcatctcgtcagtgatctttcctataaatgtgactgtactcaatgactttgcttttacaattccagccagtcttttgatattgaacatagaatgtatatgatcctggaaaccacgaggagggtggtacaggctgtgttttttttttctctctctctctcttttttttttttagttattcaatcagctacaaaacatccaatccttgaagtcctttattttacccacaggcctgttgctaagaatcaaagccacatgccactagccagtaccccaaaggacggctttaaaaaaaaattaaattggagacaaggtctcacggtcacccaggatggagtgcagtggcatgatctctgctcactgctgcctcaacctcctgggctcaaatgatcctcccacctcagtctcccgaatagctgggactatcagtgcacaccaccatgccctgctaattttttaatttttttgtacaaatagggtctcaccatgttgcccaggctggtctcaaactcttgggctcaagtgatctgcctgcctggacctcccaaaaggctgggattataggcatgtgcctttcatatctttaaatcatgaatcaaggataagaaaacctcctggtatagtccttactctgcttttattaggataagaggtcagacaagactttctcatgggaagtccctgatgaaccttagtcaccctaattattatttattataatttttattttttaacattttatttatttatttatttgtttttgagatggagtctcgctctgttgcccaggctggagtgcaatggtgcaatctcggctcactgcaacctccgcctcccgggttcaagccattttcctgcctcagcctcccaagtagctgggactacaggcatgcaccaccacgcttgactttttgtatttttagtagaaacagggtttccccatgttggccaggctggtctcaaattcctgacctcaagtgatccacccaccttggcctccaaaagtgctagaattaaaggcatgagcaactgcacctagccacgttgatgatgatgatgattattattattattattattattatttagagatggagtcttgctctgtcacccaggctggaatacagtggtgatcacagctccctgcagcctccaactcctgggctcaagcaatcctcctgcctcagcctctcatatagctgggactagagatgtgcaccatcacatcaggctaatttttaaatttttttgtagagacaaagtctcactttgttgcccaggctggtctcaaactcctgggctcaagtggtcctcccaccttggcctcccaaaatactgggattataggcatgagcaaccacactcagccatcacactgattattagtttgcatttttgagtgattttgtttattctaagtgatatgatttttcatccacgataacaagggacagtcataaaatgaagaaggcctacatttttttccacgatggggtctcactctgtcacccaggctggagtgcagtggcacgatctcggctcactgtaacctccacctcccgggttcaagtgattctcctgcctcaacagcccgagtagctaggactacaggcgtgcgccaccacgcccggttgattttggtatttttagtagagatgaggtttcaccatgttggccaggctggtctcaaactcatgccctcaagtgatccacccgccttggcctcccaaagggctgggattacaggcttgagccactgcgcctggccaacagtcatattgttgataccacacctactaaagcaaactcttgggaaaatactgattgaagcaacagcatgaagcaaaccttgtttgcaatccttgctatttagactttgctgccaaatgtgatttcatacaaacaagtttcatatcaacaagtcttctgtgtatctagctttactcggacccactcaatatttgcattttcagggaaaaagaagactgtcaagttggctgaccaaggacaataatgatctctttccttaaagtgctaactccccaggaggaatgggaaaggtgtgaagaggggcttcccacacagtgccatcatggggagcggctcagcactccgagccaccttctgggcttggggagcccctggtcttacctcaatgatgtcttctgtcccacagttccccctgcagtggtttggagtccctgccattctgaaaggctggtttgagcgagtgttcataggagagtttgcttacacttacgctgccatgtatgacaaaggacccttccgggtaggtggatggttctgaatgctctgacagccagcttctgggtggtctgtcctgatgcaggggtgtttgtttgtttgtttgtttgagatggagcttccctcttgttgcccaggctggagtgcagtggcgggatctcggctcactgcaacctccacctcctgagttcaagcgattctcctgcctcagcctcccgagtagctgggattacaggcatatgccaccatgcccggctaattttgtatttctagtagagacggggtttctccatgttggtcaggctggtcttgaactcctgacctcaggtgatctacccgcctcagcctcccaaagtgctgtgattaccggtgtgagccactgtgcccggctctgatgcagggttttgagcacaattagatcctaagcctaggctccaggtccttcgggagagacgcatgatcaagtttttacagatggaatgacatgatgtttgggatttgttttaaaatgctccagaggccgggcgcagtggctcacgcctgtaatttcagcactttgggaggccgaggcaggcagatcacctgaggtcaggagtttgagaccagtctggccaacatggcgaaaccccgtctctaccaaaaatacaaaaattagctgggtgtggtggcgggcatctacaatcccagctactcaggaggctgagccaggagaattgcttgaaacccaggaggtggaggttacagtgagccaagatcgcgccactgcactccagcctgggcaacaaagcaagactccatcttaaaaaataaaaggccaagcacggtggctcatacctgtaatcccagcactttgggaggccgaggcaggcggatcacaaggtcaggagatcaagactatcctgcctaacacggcgaaaccccgtctctactaaaaatacaaaaaaacttagccgggtgcggtggcacgtgcctgtagtcccaggtactcgggaggctgaggcaagatagttgcttgaacccgggaggcagaggttgcagtgagccgagatcgcaccactgcactccaggctgggtgacagagcgagcctccatatcaaaaacaaaaacaaaaaaaaaattagccggatgtggtggtgggcacctgtaatcccaactatttgggaggctgaggcaggagaatcacttgaacccgggagacagtttgcagttggttgagatggtgctactgcaccccagcctgggcaacagagccagactctgtctcacaggaaaaaaaaaatgaaataataaaataaaataaaacgctccagagaaaaagggggtcatgggtcgagctaaaactagaatagcagaatactgagaggtgaaggtgagtgatagatgcagcactattttctcatttacatgtgttaaaaatttccataataaaaacaaaagaaggcctgtcttcattttttggaggcccaaatcctgcacagggaacccttcgagaccttccagatgaaagagcttgtcctacgccatgcctagcccgtgggaggatggataagaacaaccaataactccacctaggcagccagcagccagcactgattttggatatggtgacagcctcgtcctaagccacatgtgggggtttggaatccttcatttgccccaggccaccggtctgtagaccatctaggctggcactcctgcagagtcatattatgtagctcaggggagccaaagtatgaagtaatataaacagcaaataggacagacttgtgtgttcttttccctggagctgtttcattaacttcttgtcaccaaggggatgtggagggaagtgaagtttgttattgctttttcttttgcagagtaagaaggcagtgctttccatcaccactggtggcagtggctccatgtactctctgcaagggatccacggggacatgaatgtcattctctggccaattcaggtacctcattttcttttcttttcttttttttctttgagacggagtctcactctgtcatctaggctggagtgcagtgacaccatcttagttcactacaagctccgcccgctgggttcgagcaattctcctgcctcagcctactgacaggcacccgccaccacactcggctaatttttgtattttttagtagagacggggtcttgccatgttagccaggctggtttcaaacacttgacctcaaatgattctcctgcctcagcctcccaaagtgctgtgattacaggcgtgagccactgcacctggccaggtacctcattttcaacgaaccttcaggggaattcattcattgagccttcgtggggttcaaaacctcaagatagcatctgaaaatagatcttgagttgtgaagatgaaagcatggtcataattcagaatgatgggagcctcctttaagaacctgcctgccttcccaggtgcctgtgtgtgaacacacctgcgtgtgcatgtgttcaaacagcattctgtcccagccaaggactagtgtgaatcactactcttgatttgtatagccgtgggccctggtctcaccagatgactgacatctctctccagccttcctgtccttctccaggttgctgatacagtcccatagactattagagcccaagacaatttaagaaatgatttactgggaggctgaggcagaaggatcgcttgagcccaggactttgagaccagcctgggcaacatataagacctcatctctacaaaaaaaaaaaacaaaattagctgggtgtagtcatacacctgtggtcccagctacttgggagtctaaagtgagagacccaggagttcgaggctgcaatgagctatgatcacaccactgcatgccagcctgggatacagggcgagaccctgtttcgaagaaaaaggaaataatttagtccagccagtttatacatggataaaactgaagcctggggtgggcttattggtgttaccaaaccctcaagataatttctataaagagggaggttggagagaagagccagtgagtggccacttatgaaaatcatttatcaagactcatctgggcctgtaatcccagcactttgggagactgaggcaggcggatcacttgaggtcaggagttcgagaccagcctggtcaacacagtgaaaccctgtctctactaaagatacaaaaattatctgggcatggtggcgcatgcctgtaatcccagctactcgggaggctgaggcaggagaaccgcttgaacccaggaagtggaagccgcaatgagccgagatcgtgccatggcactccagcctggacgaccgagcgagactctgcctcaaaaaaaaaaaaaaaaagaaaaagaaaaaaaggactcatctagttatatggagaggcagagaaatgcacccacgcaggtcttggtgagtcacctgccaagaaactgagactccctaaagtaacagaacttccagccttcttggcaaaggatccaggttggcacagtttcaaggtttatgcatttaaagaagaacacacctgagaaggctaaaattggtaacggctaggtagagggtaagagagagacgctagctctgaactgattctctagtgtgcctgaggcctccttatcagagtgtcttactgagaagcccagaccaacttctgttgtttatagtacaactgcatggaattggttgacttacctctctgtgctttctgtatcctcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagaccca

SEQ ID NO: 35882 - DNA, 29358 bp, Homo sapiens
tgttgttgataggatggatatgtacactaacttccactttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccaggtgacagagggagacgccctctcacaaaaaaaaaaaaaaaaaaaaaaaagtgcagtctagcccgcatctgcggcctcttcatctcgatgatagtcttttcctgtgtcttagcgttgcatgatgggagaaatagtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaaggtactcgtgctggtgctggtgggcggtggatgggggggcgggaccgaaacacgccagattctctgcagctgtctttgccaaacccctagccctcgccacacaccccaatcgaccacttctcctattatccttgatcactccacgccttcttccctcccagtcacatctttcacttcctttaattaccctcaatataatacccttcccttatctctctcctcccctcttccgtcttcccggtccccgcctcaccccagtaaactgctcttcccttcccaaccttctcctacacctatcaggcatccccctctgctctttagttactagcatgacagcccccaggcacccttttgtgttcttaggaaatccctctctcccctcctaacacacacacacgttcctttctgtttacctcttctcattctcagccgattgtttgggtgactcttaggaggttctcttgtaagtcttctcagttcttttaattttgttctcccactgtgaccttcagataattatgaagatatcccagttactttcagtcgttaagttcttggctgcagcactatcccaataccaccacctcctctgcagtccccatctgttgcttccagctggcagtttcagctgaacacctgctggcctctccagcccattccggaccaccccctttcagtggtcctatcctggaacttctgggttgagactgcccatctttctttttttactcactgaacaatgcaaggttatcctaagttgacaaagtatttcttttcttttccttttttttttttaacccattttccattcttgcatcagattgtgtggtcccgttcctgacccggcctaaggtccctgtcttgcagctggatagcggcaactacctcttctccactagtgcaatctgccggtcagtattggtccttggtgtagggaggtggctgaatcaaatcaggcctcactgtcatttgtgtggctttatttgcagccattgtttccctgtgtgatgagaaatgggctaaatgggcccctctaagtccatcatctgttgctctctctctgggcagatatttttttttgttatctggctgggagcaagatgacctcactaaccagtggctggaatgggaagcgacagagctgcaggtaggactaaggtatgggggatgtcaggcaggcccttgttctgcgtggccatcctgactcatgtcccctgcattttagccagctttgtctgctgccctgtactatttagtggtccaaggcaagaagggggaagatgttcttggttcagtgcggagagccctgactcacattgaccacagcttgagtcgtcagaactgtcctttcctggctggggtgagttgggtcttgagatgaggactggggaaggcttatggtgtaaggattaagagggaagactgtattcagagtgttcgaacccaacactgccacttactagtagtgtaatcttggcaaatcacttaatctctctaatcctcaatttttttcagttgtgaaatgggataatattagtacctatctcagtgagttattgtgaggattaagtgagatcatataaagtgcttaatacagtgcttgacatataaagtgctcagtaaatgttagatattaccattgggaagaaactgagtgtctcatttgtgtacattttccttttctatccccaacaaaggagacagaatctctagccgacattgttttgtggggagccctatacccattactgcaagatcccgcctacctccctggtgagaactgtgcatatcactccaaccctaggagcttggtgtaggggttacagaatgggcagtagaatactgagaactcccttcaaggtacagcttgactgggcaactatagcagaagatggttgagggaactggggaaagcaactggagaaacctcacaaagaaggggaaagatgcccgctcctgcctaccaggtccttatgtttgctgattttcttttcttccatacccacagaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggtttggaatagggcagagccttggggcctgaggtgggaggtggctaggagatggactttgagcatggccactaactttttcaggtagtggcaaggagaaagtttctttaccctgtgggccctcctcacctggtaagggattctctccactctttataggaggaggagctggctaccctatctgaggaggagattgctatggctgttactgcttgggagaagggcctagaaagtttgcccccgctgcggccccagcagaatccagtgtgagtagacatggcacatgtgagtggggcttgattttgtagtggaaattgttgatagagccagaacctgcctgctaggtcccgtttgctgatctctctttaatttttcatcctctccttttaattcttacatctctttttttttttttttttttttttacattttctcttagcctatcattttggacactccatctgtcccatctgcacccatgtttttcttgtctatccttttttttttttttttttgaggcggagtttcgctcttgttgcccaggctggagtgcattggcgcgatctcagcttactgcaacctccgcctcccgggttcaagcgagtctcctgccttagcctcccaagtagctgggattataggtgtgcaccaccacgcctggctaattttttgaagagacaaggtttcaccatgttgcccagacaggctggtctcgaactcctgacctcaggtgatccaccagccttggcctcccaaagtgctgggattacagacatgagccactgtgccggccctgcacccatgtttttcagctactttttacccaccgataggagctaactctatttttccagtccagatctgtattctgaactccagacacatttgccatactatcctagactccttcacctctacaggcatctcaaattcaacatatccaaaaccaaacctgttacctttcctgctaaatgcccttttatttattcacctgcctttgttgaacagcctccaccttccacctaaaaatccaagccagaaatcttggtgttatctagacttcttcgtttctccctagctgtattattcattcccttaccaagtcgttgactctaactgttaagtagtctttgaatccaccccttctcctctctgttgtcactgtcactacacagatactaacagaccttgtcatctgttatcctctttccctgacactctgtactccacactgcctccagagtgactgcttaaaactgcacagactattatcactcctttttagaattctatcgatggttcctttgtgtaattcacaaggcccctgactgcaggctcagtaacatattttgtcactctcctgctacactaagataatatttatacatacgcagttttttccgtcaaaatgaaattatttacagttctgagtatgtttgccattcaataaacatttgagtgtttactcctttccagtccctgcatgctaggagctgggtatacagaggggaacaagacagacaggatctccgctgtcatgggactttctgtctggtaggatagacaggtattttaaaaactgtcacacaaatgtagaattacacattttgaaaagtccaggccgggcgcggtggctcatgcctgtaatcctagcactttgggaggctgaggtgggtggatcatttgagtcaggagttcaagaccagcctggccaacatggtgaaaccctgcctctactaaaaatacaaaaattagccgggcattgtggcgggcacttgtagtcccagctactcgggaaggtgaggcaggagaatcgcttgaacctgggaggcggaggttgcagtgcgccaagatcatgccactgcactccagcctgggagacagagcaagactgtctcaaaaaaaaaaaaaaaaagtccaatgaaggaaaagaagaggttgctatgcgaggaaatatcagaggtgactaatttagaggcctctctaaaacattgagtgaagacttaaaacggccaggtgcggtggctcatgcctgtaatcctagcactttgggaggccaaggcggcagatcacctgagatcagcagttcgagaccagcctggccaacatagcaaaaccctgtctctatctaaatacacaaaaattagctgggcacggtggctcgtgcctgtaatccctgctactcaggaggctgaggcaggagaatcgcttgaacccgggaggcggagtttgcagtgagcggagattgcgccagtgtactccagcctgggcaacagagcgcgactccatttcacacacacacacacacacacacacacacacacacacacacacacagacgtaaacaaatttgagacttgcaagattaagtaggggctagttaggcaagagtaagagtggagagagggtgtttcagagagaggaaatctaatatgcaaagacctgagaagcaagagagtttgcctcttaaggaattcctaaaaggacagtggcagcaggctggtcagtcgggggcacatgggtcaaaatgagttttgagaggcaggtggggctggcatcataccattgtctctcacctctgtgcctttatgcatactgttccttctccctggaatgccagcatcttacctgcctgatgcacaactcttcttgcagagaggagttctgccttttccttctctatagagtgtgagacagtcttaagtgcttcaatttctgggaggtcccattgtcatattatgttgtaattgtcacattacatgtttgtttcttcactaatttgtaagctcattgaaggtagaggtgtctcttttatggggctcagttgctagcacagggccaaatgttctgtagatattgataacatttgaatgaatttatgaaagtccatccttgttgttttgcttgttttgagtatatatatataatatatattatataatatattatatataatatatgttatataatatatattatatgatatgtataatatatattatataatatattatatataatatatgttatataatatattatatgatatgtataatatattacataatatataatatattataatatataatatataatatataatatataatatattataatatataatatataatatataatatattataatatataatatattataatatataatatataatatattataatatataatatataatatattataatatataatatataatatattataatatatattatatataattaatatataatatacaatatatattatatattatatatattatatataatatatattatatattataatatattatatattatatattatattatataatatatattatatacattatattatatatattatatataatatatattatatattatatattatattatataatgtatattatatatattatattatatattataatatataatatatatatttatattatataatatatataatatataatatatatttatgttatataatatatataatatatataatatatattatatattatatatatattttttaattttaattttttttttttagacagagtttcgccttgtcatccagtctggagtgcagtggcgtgatctcagctcactgtaacctccgcctcccaggttcaagtgattctcctgtctcagtctcccgagtagctgggattacaggtgcacaccaccatgcccagctaatttttgtatttttggtagagacaaggtttcaccatgttggccaggctggtctcaaactcctgacctcaggggatccacctgcctcggcctcccaaagtgtttggattacaggcgtaagccactacgcccagccttgttttgagtatatcttgagcatatattgtggattcagtttaatactaagcacttacttcttcttttttttctttttttttttttttttgagatggagtctcacactgtcgtccaggctggagtgcaatggcatgatcttggctcactgcaacctctgcctcccgggttcaagtgattctcctgtctcagcctcctgagtagctgggattacaggtgcctgccaccacgcctggctaatttttttttttttttttttttttttagtatttattgatcattattgggtgtttctcggagagggggatttggcagggtcataggacaatagtggagggaaggtcagcagataaacatgtgaacaagggtctctggttttcctaggcagaggaccctgcagccttccgcagtgtttgtgtccctgggtacttgagattagggagtggtgatgactcttaacgagcatgctgccttcaagcatctgcttaacaaagcacatcttgcaccgcccttaatccatttaaccctgagtggacacagcacatgtttcagagagcgcagggttgggggtaaggtcatagatcaacagcatcccaaggcagaagaatttttcttagtacagaacaaaatggagtctcctatgtctacttctttccacacagacacagtaacaatctgatctctctttcttttccccacatttcccccttttctattctacaaatccaccattgtcatcatggcccgttctcagtgagctgctgggtacacctcccagatggggtggcggccgggcagaggggctcctcacttcccagacagggcggccgggcagaggtgcccccccacctcccgggctgggtggcggccaggcggaggcgccccccacctcccggatggggtggctgccgggcgggggctgccccccacctcccggatggggcggctggccaggcgggcgctgccccccaccttcctcccggacggggcggctggcggggcgggggctgccccccacctcctggatggggcggctgccgggcggacacgctcctcacctcccggatggggtggcggtcgggcagagacactcctcagatcccagacggggtcgcggccgggcagaggcgctcctcacatctcagacggggcggcggggcagaggcgctccccacatctcagaccatgggcggccaggcagagacgcttctcacttcctagacaggttgacggcggggaagaggcgctcctcacttcccagactgggcggccaggcagaggggctcctcacatcccagacgatgggcagccaggctgagacgctcctcacttcccagacggggtggcggccgggcagaggctgcaatcttggcactttgggaggccaaggcaggcagctgggaggtggaggttgtagcgagccgagatcacgccactgcactccagcctgggcaacattgagcactgagtgagcgagactccgtctgcaatcccagcacctcaggaggcccaggcgggcagatcactcgcggtcaggagctggagaccagcccggccaacacggcgaaaccccgtctccaccaaaaaatacaaaaaccagtcaggtgtggcggcgcgcgcctgcaatcccaggcactgggcaggctgaggcaggagaatcaggcagggaggttgcagtgagccgagatggcggcagtacagtccggcctcggctcggcatcagagggagaccgtggaaagtgggagaccgtggaaagtcggagacagggagagggagcaattttttgtatttttagtagagacggggtttcactatgttggctaggctggtcttgaactgacctcatgatccacttgtctcggcctcccaaagtgctgggattacaggcatgagccactgcacccggcaatataagcactttcttttttttttttttgaaactgagtctcactaggatggagtgagtggcgcaatctaggctcacggcaacctctgcctcctgggttcaagtgattctcctgtctcagccccccgagtagctgggattacaagcacgcaccaccaggcccggctaatttttgtacttttttagtagagacggggttttaccatgttggccaggctggtcttgagctccgacctcgtgatccgcctgcctgagcctcccaaagtgctgggattacaggcgtgagccactgcatccggccaatactaagcactttcaaggctcatatagaataggaagtactgccgtggctcatgcctgaaatcccagcactttgggaggttgaggcgggaggatcacttgagcccaggagttcgagaccagtcctgtcaacatagactgcatctctacaaaaaaaatttaaaaattatccaggcacggtgatgcctgcctgaagttccagctacctgggaggctgagatggaaggatcattttgagcccaggagttcaagattacagtgtgctgtgttgtgccactgccctcctgcctaggtgacagagggagaccctgtctccaaaaaaaaaaaaaaagggagataacctttctcaggcatgtatacaggcaaatacatttaaatgcataagtggaggaggagacagttggcattgaagatcctatgggcagactaagctgtgttgggctagagtgcttgccttcctttgatctcctttgacactttgcacctcttcattacactgatcccagtcagcagttacataatagaatgtaatacccttgggagcagaacctagggcatatttgcctctatacttgccacagcagtaagcacactcattctgagagataagtgacagggtaacacaaaaggagcactactcaatatggtacaaagtggttagggggttgggatacaaaaaagactgtgtgggaagatggccatcagtgaaggaaggttttcttggaggaggtgatttctaagctggatttcagagaaagttacgatattcagttatggagagaaagggtgatggatgcacaagaaattagtgagatgcgttttatggaaataagctgtaaatgttctaggaagtagttgggccatctattgggatatatagcagcagctgggaagaagggttgaggttaatgtgagggaatcggggaggcagtgactgtaggctaagaatggttggaaagatgataggagccttagtgtagtgtcagtgctaaagaggggatgttgatacaggatgtgtacagctcagatgtcaaggatgatgaaacttgaaaaggaatactgcattgagtgccttcagacagcaggttgaatggcatgaccagcaacgatctagaaaagtgggaaggagagggtgacggtgaaggcaaaactggtgcctgctggtttgagttaggccatgaggaagtgacagacatgggttagagagtcggtacaaaaggacttgttacgggtcgtatctaggctggtgagctctttggatttcagatagtggctagagattatagtaacatagcacctggaaagaaggggagaagccagcgctgggaaagtgttcttgggagtggtgagagggtaatgattggacagagcctagggagagtttgagcctgagaatgaggtaatagaaaacaagcagtcatgacagtaaaagggacagaaattggtgttgaacaaggctccttcatagcagtacaggagacttcctcactgtggcagtgccctgtatttgcatctctggggatcttagagtgcctcgggaagctgtggtcctgtgggtttgtgtgcagaaagacttcaagtgtacatgaacacatgacagtagaacaaatctgtgtccgggtgttctgtgcacttttcgtccctgttgaccctcacatccccccatgcactgttctcttcctctttccttactaggttgcctgtggctggagaaaggaatgtgctcatcaccagtgccctcccttacgtcaacaatgtcccccaccttgggaacatcattggttgtgtgctcagtgccgatgtctttgccaggtggagccagctgctcggggagagacctcctaagggaagggcgggtcccaggggaataggatgcttcaagggtggggctggggagatcccaaggacaaggaagcgctgaagcggggccccctagcgatcaccatattcccttgcaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaagtaagtttcctctaatgaggcagaaatggggcttgaaggctgagactgggaacagtgggagtatcttggagacagaaggaacccgggtggctgtctgggcactcctaaacttaggatctcaatatcaccctgggcagttatccaggcatttttgagggaagatggtgtgtgtagaagcctgaccaggagctgaaggagcagctgagggagggcagagaccagacgcaggctgatgggaaatatctatcttccctctagtgcctcccttcctctctgtgtcctgaagtctaagacacttcttcccactcctgtatgcatttataacacataaactcattcttcctctgcctaatactcatccttataaaaactttgcatagccgggtgcagtggctcatacctgtaatcccagcactttgggaggccgaggcgggcggctcaccggaggtcaggagttcaagaccagcctgaccaacatggagaaaccccatctctactaaaaatacaaaaattagttgggcgtggttgtgggtgcctgtaatcccagctacttgggaagctgaggcagaagaatctcttgaacccaggaggcggaggttgtggtgagccaagatcatgccattgtactccagcctgggcaacaagagcaaaactctgtctcaaaaaaaaaaaaaaaaaaaaaaaggctggggctgggcgcggtggctcacacctgtaatcccagcactttgggaggccgaggcgggcggatcacgaggtcaggagatcgagactatcctggctaacccagtgaaaccctgtctctactaaaaatacaaaaaaaaaaaaaaattaaccaggcgtggtggtgggcgcctgtagtcccagctactctggaggctgaggcaggagaatggcatgaacccgggaggcagagcttacagtgagctgagatagtgccactgcacttcagacttggtgacggagtgagactgtctcaaaaaaaaaaaaaaaagggctgggcgcagtggctcacgcctgtaatctcagcactttgagaggccgaggtgggtggatcacgaggtcaggagttcaagaccagcttggccaacatggtgaaaccccatctctactaagaatacaaaaattagctggacctggtggtgggcacctataatcccagctacttgggaggctgaggcagagaattgcttgaacccgggaggctgaggcaggcagtgagctgagatcgcaccactgcactccagcctgggcgacagagcgagactctgtctcaaaacaaacaaaaaaacccccaaaactttacatagtagacaggccgccaactgatagtgctatgcagtttagtttagcacttggactgacttaatttttaggatatattaaagaacaggcacagtcctatcctattggagatttttgttaatgaaaaatacaaaacagataaatctgtgttcaacaaaagtgaattctaaagtgttgaggggaaagattatgtgggcagttggggaatatgtgtgatgggtctgagctcatccagtaaaactctcaaaagatgaatagatgcccttttccttgaggagccttctgcctgatttctttgtcactgagtttgggtccctggttggagtggcaggaggaaggggtccaccacgtcttctgactgtctcttcctgatccctggcccacctcaccagaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaaggtaagaggagggtctccatgggagcccggaaggagacagtccttattcttaagggacgcccttcctgtcccatttaggatttttattttagcattctagacctttaaccagtggccctttctgccccatctcagcaactcgtcatttagttcatttgaaaaatactccctgagcacttactatgtgctgagcactgtgctaagaaacagacaagttgagtttatatttcccaacctttggtcttgcatcacaccacctgatctacatttgtttagatccttctctcttctttaaatatcttctcttctagccatttgttaatttatttcttcattcatttattcaacatacattttttgaatccttagaataggccaattacaattctgcgtgctgggggtatggcaatgaataagacagattttatttagtatggtcaggagaccaacactaactaaggaaatgatatagaataaactgccaggaaaatgtgacagagagtgacttctgggggaagatctaacttaggtagatagggaaggcctttcagaggcagtaacatttgaactgagagtttaaccaaagaattaggagcaagccaggcaataagaggttaagaatgttctaagcggaaggactaggaaatgcaaaggccatgaggcagctaagagctgaaaaggcagaattggcaaggccagtatagcactagcacagtgagtgaggaggagggtagactgagatgaggtgagagagatggcaggggccagatcaccagggcctgtgaagccattgtgggaatttagattttattctggtgaatgacaagctgctctgtggaaaatggatggcagggaagcaagaaataaagtatgttgaaggggctgggcattggtggctcatacctataatcccagcactttgggaggccaagctgggtggatcacttgaagccacgagtttgagaccagcctggcctgtaacatggcaaccctgtctctactgaaaatacagaaatggctaggtgcggtggctcacgcctgtaatcccagcactttgggaggctgaggtgggcagatcacttgaggtcaggagtttgagaccagcctggccaacatggtgaaaccctgtctctactaaaaaaatacaaaaattagctgggtgtggtggcggacccctgtaatccccgcttcttgggaggctgaagcttgagaatcacttgaacctgggaggcagaggttgcagtgagctgagattgcgccactgcattccagcctgggttacaaagtaagactctgtctaaaaaaaaaaaaaaaccacaaaaattatccaggccgtggtggcgcacacctgtaatcccagctacttgggaggctgaggcagaagaatttcttgaacctgggaagcggaggttgcagtgagccaagattgccactgcattccagcctgggtgacagagcaagactgttccccctccaccaaaaaaaaaagtatggagaaggatttggaggcaacaaggctacaacccagaaatgggataatggtggcttgcactaggttagtagcactagaaatggaaaagaaaaaatagacttgaggtatatttttggaggtaaactccacggagttggatagactggaatttgggatggtcaggaaaaagatgccttgtaagtttttggcctgagtagatggtagtaccatctgtgaacgtgagtgaggagaacaggctttcaggtgggatgcagccatactgtttgggtttgttaagcttgagatgcctgttagatagccaggcagagaagtcaggtagacagttggatattaggcatatggagttcaggagagaggtcctgaggaattataatttctcaccttcaaaaactcagatcaaaactcacttggggccaggtgtggtggctcacgcttgtaatcccaggactttgggaagctgaggcggccggatcacctgaggtcaggagttcagaccagtctgaccaacatggcgaaaccccgcctctactaaaaatacaaaaattagctgagtgtggtggtgcgtgcctgtaatcccagctaccagggaggctgaggcaggataatctcttgaacctgggaggtggaggtttcagtgagctgagattacgctactgcactccagcctgggcgacagagcgagattttgtctcaaaaaaaaaaaaaaaaagcaacaacaacaaaaaaaaaacaagccaggcacggtggctcacgcctgtagtccgcgcactttgggaggctgaggcgggcagatcacgagatcaggagtttgagaccagcctaaacaacatggtgaaactccatctctactaaaaatacaaaaataagccgggcgcggtggcacgtgcctataatcccagctactcaggaggccgaggctggagaatcgcttgaacccgggaggtggaggttgtagtgagccaagactgcaccactgcactccagtctgggcaacagagtgagacttcgtctcaaaaacaacaacaacaacaacaacaacaaaactctactacaaagccctctctgaaagatggaaaaaagagcaacaacaaaaaactcgaaagttttcattcattagctccacctaactgttcactccattagccatcacccttccatgtttatatagtcagtttatgccacacaaataaatttattttgtaaagatctgcacttgtttctttttttttttttttttgagatggagttttgctcttgttgcccgggctggagtgcaatggcgcgatctcagctcagtgcaatctccaccacccaggttcaagtgattctcctgcctcagcctcctgagtaactgggattacaggcacgcactaccaaacccggctaattttgtatttttagtagagacgaggtttcaccatgctggccaggctggatttgaactcctgacctcaggtgttccacctgcctcagcctcccaaagtgttgggattataggcgtgagccacggtgctcagccacatttgtgtctttttccttttttttttttttgagacagagtctgctctgtcagcagcctggcgtgcggtggcatgatcttggctcactgcaacctctgcctctcaggttcaagcaattctgcctcagcctcccaagtagctgggactacaggtgcacgccaccatgcccagctaatttttgtatttttagtagatacggggtttcactatgttggccaggatggtctcaatctcttgacctcatgatccgcctgcctcggcctcccaaaatgctggaattacaggcgtgagccaccgcgcccggcccacacttgtttcttatataagccatctctccctgacttgtagcttcctcaaagagaggggctatgtcttcacttcatcactccttcctcccctcacacagccaagtacagtgcagtgctctgtacctagcctatgttcagagaatgttttttttactctggtgtgatgggacagagatctgaaactctgagaacaaatggagttatactgagaagatttgagtctccatgtttagagtaggccacatagtagagttattggagtgtgagcctgaagctaaactagatggcagactgaggagctaatccttctctgctcctccccttgcctggacccctcccctggcctgcaggcctgatctgtcctctggaattttccttcgcagaagcctcagtgtaaagtctgccgatcatgccctgtggtgcagtcgagccagcacctgtttctggacctgcctaaggtaagtgagcttttctctcaacctagttttcaggaggcctcttctgtcccctctgccttagccacaaatactgagagcagattactcttaaaagttttaaatttccattaagaattgtacatactattgtcaagagatgaaatagattaaagggcacaaagtgaaagccccaggcccacttgcgagaggtatttactactttttcctttgtgtctattcagaaatgtcatatgcatataaaagtatttttatgtctctctttttttttaagggatagcttctcactctgtcacctaagctggaatgcagtggcatgatcatagctcactgcagccttgatatcctaggaccaagcaatcctctcacctcagcctcccaagtaccatgcctgactgatttttttttttttttttttttttttgagacagagtttcgctcttgtcgcccaggctggtgtgcaatggcgcactcttggctcactgcaaccttcgcctcctgggttcaagtgattctcctgcgtcagcctccagaatagctgggattacaggcgtctgccaccatgcccggctaatttttgtatttttagtagagacagggttttgccatgttgaccaggctggtctcgaactcctgacctcagatgatctgcctggctcagcctcccaaagtgctgggattacaggtgtgagccaccgcactgggccacctgactaatttttaaaatgcttttgtagagatgggttctcactgtgttacccaggctggtgtcaaactcttgggctcaagcagttctcctgcctctgcctgcaaacgtgttgggattagaggcatgagcaactgtgtccagcattgacctcctgatttgttttttttttttttgagatggagcttctctcttgttgcccacactggagtgcaatggcacggtctcggctcactgcaacctctgcctcccaggttcaagcgattcctctgcatcagcctcccaagtagctggggttacaggtgcctgccaccatgcctggctaatttttgtatttttagtagagatggggtttcaccatgttggccaggctggtctcgaactcctgacctcaggtaatccatccacctcggcctcccagtgtgcagggattacaggtgtgagccaccatcccagcctgacctcctttttaaaatacagtgttcctccttctgtaccctgggcttggagaaaaaaaaaaataggctgggcgcagtggcttatcatgcctgtaatcctagcactttaggaggctgaggtgggaggatctcttgatgccaggagttggagaccagcctggaaaacatagtgagacactgtctttacaacataattgaaaaattagccgggtatggtggtgcgatcctgtagtctcagctatgcaagaggctgaggtgggaggatcatttgagcccaggagtttgaggttacagtgagctgtgattgtgccactatactccagcctgggcaacagagtgagactctatctctaaagcataaaaaaattaaaggccacatgcagtgactcactcctgtaattccattactttgggaggctgaggtgggaggattgcttgagcctaggggtttgagaccagcctgagcaacatggcaagaccctgactctacaaacagtgaaacaattaacctggcctgggtgcagtggctcacgcgttaatcctaacattttgcaagggctacctaggtgggccgatgacttgagcctaggactttgagaccagcctgggcaacatggtgagaccccatctctacaaaaaatacagaagttaactgggtgagttgtgagcagctgtagtcccagctactcaggaggctgaggtgggaagatcacctgaacctgggaaggtttgaggctgcagtgagccatgattgaaccattgcactgcagcttgggtgacagactgagactctgtatcaaaaagaaaaaaagaaaaaattagccaaatgtggtggtgcacatctctggccccagctacttgggaggctaaggtaggagggttgctttgagcccaggagctggaagctatagtgagccatgattgtaccactgcattccagtctgggcagcaaagtgagaccctgtctcaaaaataaataaatacataaaatataatagtcctcaggttgggtttgttgggtgtttcctcatgatttcaggctatgcattcttggttggaatactacataaatgacattgtgtccttttcagagccacgtgatggccatccccttcactgggaatcttaattttgtttggtcaggtgttattcaatttgttcactgtgtgattaatattttccccattgcaacttatgagcagtctgggaatacactttatttttttcttttcttgagatggagtcccgctctgttgcccagactgtagtgcagtgttgtgatttcagctcactgcaacctccacctcccaggttcaagtgattctcctgtctcagccttcgagtagctgggattacaggcacataccaccatgcctggctaatttttgtctttttttttttttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggttatagatcaacagcatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacggggtggtggccaggcagaggggctcctcacttcccagtaggggtggccgggcagaggcgcccctcacctcccggacggggcggctggccgggcggggggctgaccccccccccacctccctcctgcatggggcggctggccgggcagaggggctcctcacttcccagtaggggcggccgggcagaggcgcccctcacctcccggacggggcggctggccgggcgggggtctggccccccacctccctcccggacggggcggctggccgggcgggggtctggccccccacctccctcccggacgggacggctggccgggcgggggtctggccccccacctccctcccggacggggcggctggccgggcgggggctgaccccccacctccctcccggacggggcggctggccgggcggaggctgacccccacctccctcccggacggggtggctgccgggcggagacgctcctcacttcccagacggggtagctgccgggcggaggggctcctcacttctcagacggggcggctgccgggcggaggggctcctcacttctcagatggggcggctgccgggcggagggtctcctcacttctcagacgcggcggccgggcagaggcgctccttacatcccagaaagggcggcggggcagaggcgctccccacatctcagacgatgggcagccgggcagagacactcctcacttcctagatgggatggcagctgggaagaggcgctcctcacttcctagatgggatggcggccgggcagagacactcctcactttccagactgggcagccaggcagaggggctcctcacatcccagacgatgggtggccaggcagagatgctcctcacttcccagactgggtggcggcacggcagaggctgcaatctcggcactttgggaggccaaggcaggcagctgggaggtggaggttgtagcgagccgagatcacaccactgcactccagcctgggcaccattgagcactgagtgaacgagactccgtctgcaatcccggcacctcgggaggccgaggctggcggatcactggcggttaggagctggagaccagcccggccaacacagcgaaaccccgtctctaccaaaaaaatacgaaaaccagtcaggcgtggcggcacgcgcccgcaatcgcaggcactcggcaggctgaggcaggagaatcaggcagggaggttgcagtgagcagagatggcggcagtacagtccagcttcggctcggcatcagagggagaccgtggaaagagagggagagggagaccgtggggagaggtagaggtagaggtagaggtagagggtagagggtagagggagagcatttttgtatttctaatagagatggggtttcactatgttggccaggctggtctcaaacttctgacctcaaatgattcacccgccttagcctcccaaagtgctgggattacaggtgtaagccactgcgcccagccttgagggaatacactttaaagaccatgcaatactttgctcttcgtgaacaaaatattccctataaatgtagcattcattgatcattcttacctgaatcaatctttattatggtgattttccaactctaccactactctctatatttatccttctccctccatttattttttaatttagttaactatttattatcagtatagactcatggattcctatttttttcaatttcttataatcctttcctgtcctaaatttattttcatgttcaaattgttacttatttcatcagtaggaacgtattcaaggtggcttgtctgcttttgagatctcccatcatgttttaaacacttccttaatttgtggcataaaaaaatactctaggttcatctggttcagccttgaaatcaaccatgtcaccaaccttgagtttaatttagtagggaacagtattagataccaaaatctaggtggtagatgtgctcattgctactgggtgtctttgctactaggaccttttatcaaagagagttggtatttgttttttgttgtttgtttgtttgttttgagacagggtcttgctgtcacctaggctggagtgcagtggcactatcttggctcactgcaactgccatctccaggattcaagcgattctcctgcctcagcctcctgagtagctgggattacaggcacctgccaccacacccagctaattttttttgtatttttagtagagacagggtttcaccatgttggccaggctggtctccaactcctgatctcaggtgatctgcctgccttggcctcccgaagtgctgggattacaggcgtgagccatcgtgcctggccagttggtatttattttaagttcacactgacacctgcaatttcagtccatccccacagagttcttcgtcactttctcttatttatttcatgtctctatctaccttcttccactgtaggtgtcctggttctcaataggcatcagcacatttacttattagctcaatcctacaatatacctaaaacaatttcagaattgctttgctggtacgtctacaaaaaaaataacctattaaaaagagtttaggatttgttggcaatcctgattcctcccctagactaagggtatatagccaagtgtgttcaaacaaaatttttttctagagacagggtctcactctgtcacccaggctggagtgcagtggcacaatcacagctcaccgcactctcaaactctcgggctcaagttatccttttgcttcagccttctgcgtagttgggactacaggcgtgtactatcatgcctggctgattaaaaaaaaattgactaggcatggtgactcacgcctgtaatcccagcagtttgggaggccaaggcaggcggatcatgaggtcaatagaccgagaccatcctggccaacgtggtgaaaccccatctctactaaaaatacaaaaattagccaggcgtggtggcaccgacctgtagtcccagctactcaggaggctgaggcaggagaatcgcttgaacctggaggtggggaggttgcagtgagctgagatcgtgccactgcactccagcccgggcagctgagcaagactccagctcaaaaaaatttttttttggttgggcatgctggtttacacctgtaatcccaatgctttgggaggccaaggctggaggattgcttgagccttggagtttaagaccagcctgggcaacagagtgacaccctaccttaaaaaaaaaaaagaaaattttttttttcttttttgcacttcctcagctggccatggtggttcatgcctgtaattccagcactttgggaggctgaggcaggaggatcgctggaagccaggagtttgagagtagcctgggcaacaaagcaagaccctgtctgtatttaaaaaaagaaaaaattggttgggcacggtggcttatgcctgtaattccaacttccaacactttgggaggctgaggcgggagaattgcttgaccccaggagtttgagaccagggtgggcaacttggtgaaacccatctctactaaaaatacaaaaattaaccaggtgtggtggcacgtgcctgtagtgccagctactcaggaggctgaggtggaaggatcacttaagcctgggaggttgaggctgcagtgagccatgatgtgccactgtactccagcctgggtgacagtgagaccctgatatggacaagattagcacatcctctgcacaagaatgacatgcaaacttgtgaagtgttccatatttttaaaaattaaaaaaaaaaaaattttttttagggacaggattttgctgtgttgcccaggatggtcatgaactcctgccctcaagtgatcctcctgcgtcagccttcggagtagctgggattacaggcgcaagccactgcccctggctgtgtgttaaaaatctagttaaggctgggcagggtggctcacaactgtagtctcagcgcttttggaggctgaggtgggcagattgcttgagctcaggagttcaagaccagcctgggcaatgtggcaaaaccctgtttctacaaaaattacagtctggcatggtggtgtgcacctgtggtcccagctactggggaggttgaggtaggaggattgcttgagcccaggaggtttaggctgcagtgagctgtgattatgattgcaccactgcactctagtctgggcaacagagcaagactctgtctccaaaaaaaaagttatatattgccaaattgtgctccaaaaaggttatatgtgtttatccttatgctaaccatatatgagactttcctaaatcagccctctttctccgttatctcagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtaaaaacccttttttattcatatcattcagccttagtgttgaaaccctgggctagcagagtagactgctgattatgtcttgtttcagtttgagactttggattggtccctaacatgtttacctccttctgacctccaggtattctatgtctggtttgatgccactattggctatctgtccatcacagccaactacacagaccagtgggagagatggtggaagaacccagagcaagtgagcagttcttggttaggctgtgcatggggagggtaggcggtagggtgtgggtgttagggttgggtgtctggtcttccttgggcctttgaaggaggtctcaggaaatctctcctaaccacattcccctaggtggacctgtatcagttcatggccaaagacaatgttcctttccatagcttagtctttccttgctcagccctaggagctgaggataactataccttggtcagccacctcattgctacaggtaagtaccctggaagactactgatggggtgttcataggaaatgaggggtgaggcagtacttggaaaaagatcttggagagctgctatcttgagttaggagttgagctgaaataggaaataattaaaatgagaactcaacctagagaaacgaacaagaacctgaagaaagcaaaagtctaaagctaaaactctttagtagatataagcaaagagaaaaaagggccagaatggataggaagggactcccaaaatctgagcataccagccccttaaggagaaatgttgctagacacccatagttgaggttagaaagaggaaagaaggaagagttagtgggctagagaggggaaggatgtgatgtgagcagatggttctcactcattctcctctgtccagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacaggtaggacttggtaaggggtcagagttagcagtgagctggggtggggctcattttccctcaggagatgggaatgtggagagaactagaaaatgggcaggaggctgtgaggacactgtggaaagttgatttctattaattgggatctgttcctagcacatactaggctatgtgtgcttgatggaacagttagctgtagagatgtgatttagcaaagttggttataaagtgggtttttgtaaattgtttccttattactgttctttgtagaattgaagatgtattctctcccagcaaaatagttcacctgcagatcattgaaaagtttggctgaagaaaggggttattttggtgtgggggtaggaggcttctgtgggctgggcatggtggcttacatttgtaatcccagcactttgggaggctgaggcaggaggatcacttgaggccgggagttcaagacttgcctgaccaacataatgaatctcccatctctacaaaaagaatcagccaggcgtggtggcgcacacctgtagtcccagccactcaggatgctgaggcgggatggtctcttgaacttgggagattgaggctgcagtggagcagtactcgtacccctacactccagccttggcaaaagagggagatcctgtctcaaaaaaaaaaaaaaaaaaaggcttctgctatactcttcagagttcagagtttttgttaccttaggctcacattctatcattggtgcctatctcagctcttctgcaatctaaagcagtattctccagaatttaggattctttagtcacactctctgagccctggacccttataggtcagtcctgctactcactttcagctttggtaattaaccacatttaataaatagtccttacctacaggagttcgagaccagcctggccaacctggtgaaaccccgtctccactaaaaatacaaaaagtagccgggcgtggtggcgcacatctgtaatcccagctactcaagaggttgaggcaggagaatcacttgaacccgggaggcaaaggttgcagtgagccaagatcatgccactgtgctccagcctgggcaacagagtgagaatcctcaaaaaaaaaaaaaattaaaaaaaaaaaaaagtacttgcctagagtgtttgtttgatagcagttaacacatactcagcttggtcattttgagtaatgactttttttttttttttttgagatggagtttctctcttgttgcccaggctggagtgcagtggcgcgatcttggctcactgcaacctccgcctcccgggttcaagcaattctcctgcctcagcctccagagtagctgggattacaggtgcacaccaccacgcccggctaattttttgcatttttagtagagacgaggtttcaccatggccaggccaggctggtcttgaacttctgacctcaggtgatctgcccacctcggcctcccagagtgctgggattttaggcgtgagccactgcgcccggccgagtaatgacttcttaaaaataagaggtacagttgtttaacttaatcaggtttcttatgtgcagagtcagattcttaggggagagaaagagtaaataattaggccttgtctactagcttgagggagccaggagttacctgttccaggcaggaatcctgagagaatgtacagctgtggaaattgggtgaaattctaacaaggagacgggataataacttcccctcttttttccacttctgctttcctactcccaaccaagagctgggatgtttgtgtctaagttctttgggggctatgtgcctgagatggtgctcacccctgatgatcagcgcctgctggcccatgtcaccctggagctccagcactatcaccagctacttgagaaggttcggtaagtaactgacacctctgtcttttctgctggcatgttgagagcctccttgtattggtctctgtaggacattacaccttggcctgcttcctcccttcccaggatccgggatgccttgcgcagtatcctcaccatatctcgacatggcaaccaatatattcaggtgaatgagccctggaagcggattaaaggcagtgaggctgacaggtaggtaagcggggagggttggctaaaggcataaagtggcttgtaagctgtatcctcctggaggtcttgactaatgtctcctcttcctcaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtaggtggaagagccagcctctcttaaaattgatactcttgccatgcagcttttggagtgggtgagagaagacctaacatctctccagtgttactttggtcatgggactcctaagtttctgatataaagtccttggtagtcgttcacaagtccggaattatctgtacatcttcattgttcttcatgccagaaaccagaacctggcacacaaaactaactggtaaacagatatttgaagaaacactgtgatcacctagtctccataatgctagcagatagtgggcagggaaaatacaggaaagccatttcctctttgacacaaaatgaaaaagtaagtacattgctaaacttctggatcagcctagcatccttagagagcttaaagaatctttgaccctacaaattatttggggtttcacagggaaagctacagctaatttcctaaaatcagcagatattagctcagtgttaagctcgttctttctaaaacacatcagagattggggttggagaggtcatctgtatagtctatggtagagtctgtatccaatcagtagatgattctggaactctttttttacaggtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatat

SEQ ID NO: 35883 - DNA, 44095 bp, Homo sapiens
attcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtgagggggggacgaggtgggcgagaaggaaggtgaggggatgcgggctgccgccgccggagctgatgcccagaccgcccgcccgccttcgctgcttcccgcctttcccgcatttcccgccgcggccttccgccctgtcagcccgctcggccttctgtcttcagtcagcctgccccgaacctccttcgggccttcaggctgcgccccctcggctttgtcatcctgccgcctttcaaaaggataacacttaccccgtatcgagtagtgactgcgtacgccgagcacttgccaggcactattttattcctccctgcaagcctctgagagatgattagcttattacagatgaggaaactgacgctcagagcgaggtgtcgccgactgacccaaagtcacccataggtgacaatacggtttgatttgaaaaccgtggggttggtgagctgtcttaggcacagggtcggggggcagctaggaaagaaggagggggcctctctaccctccgtaggcacttgtcagtttactgatctcttttgtggggtgaggataggagtgtggcgtggaaaaaacagatcccagacagacagcaccctcgagttcctttcccttcatgggaagagatgctgaatcagagaagggtggctgagacatcttctgacaagatggggactgggaagagtcaggaactcgtattctttctcaacagttctttttcattagacttgccaagtgcccgctttgtgcccagccctttgcttggctttgtgagattgtaggaggagacagtccctgccttgggaacaggcttcatcgggttggaaaaacaagagcaacatacttttaacaaccgcatgagatacgtatgaacaagttttgagttgaacctacttgcctttgttaaagcaatacaatgatttcaaaattgtaggcacttagtaaatactggttaatcgactggttgtttctattttgtcctctaggctgtgaacatttcaaagatggagacttgtttgagacagagtcttgctctgtcacccaggatggaatgcagtggtgtaatcatagcttactgtaaccttgaagtcctgggctcaagcgatgctcttgcctcagcctctcaagtagctgggactataggcatgcaccaccatgagtggctaatttttaaaaatttctggtagtaaaggagtcttgctgtgtttcccagtctggccttgaattcctggcctcaaaccatcctcccttccttggcttcccaaagtgctgggaatacaagcaagatggagacttttctgttcacgtttagcacaggacctgacatgaacagattcttaaagaatgaatgaaaatagttgtatcaaaatgtaggacacgatgaatgctgtgaataagcaggtagttgatttggtttaactacagccaatgtccagattggtttaactacagacaagagttggaaaggtggacagtagtggcctttcttgtttttggtatcttgagaacatcattctgtgaattttcctagctcacattttagctgaccaaagagcaaaataacatagtgcacttttattgatccattcataagagtgagagctgagcatctatttttgtatttttatttttttacattattatttatttgtatttttttagagaaggagtctcgctatgttgcccaggcttgtcttgaactcctgggctcaagcattcttcccacttcagcctcccaaagtgcttggattacagtgctgggagccaccgcacctggcttgagcatctattttttaaatctttagatatgggagagatgtttaggatggtctatgataagtcagtaacaaagatgaattgaaaatgtatggacttagatgaccagaatgggtaaaattcaaccctgtgttgaattttgaacttttagagtctacttctaaatactttcgtttaaaaagtgctaccttggcctggcgtggcagggcatggtggctcacgcctgtaatcccagcactttgggaggctgaggtgggtggatcatttgaggtgtggagtttgagaccagctgggccaacatggtggaaccccgtctctactaaaaacacaaaagttagccggacggtagtggtttgcacctgtaatcccagctactcaggaggctgaggcaggagaatcgcttgagcctgggaggcagaggttgctgaaatcgtgccattgcactccagtctaggcgacagagtgacactctgtctcaaaaaaaaaaaaaaaaaaaaaaaccacaaagtgctagctataactagctctaaaaagcagagcttattttctcattccttcatagagcacaatttgatccagatggttcatgctgtagattctgccattgtagcattcagcaagacttaatatacaacatgtacttagatttgtttgtttctttttttttttatatttctatgtttctatattttaatgttttttaatatgcatagggtttttggttttctggactttttttgtacccccttatttttggcatgtcagtggaatagcagactaactcctacagtttttgttaattttctttgagatggggtcttgctctgtcatccaggctggagtgcagtggtgtgatctcagctcactgcagtgtctgcctcctgggttcaagagattctcctgcctcagcctcctcagtagctgggactacagatgtgtgccaccacgcctggctagtttttgttatttttaataacaagggcaactggaagttgactttgaagtacctactgaatatgctaatgtcttgctaaacactgtgagggcagtaatggagaaggcagctctatcttcaaagaacttaaaattgttagggatttaggaacaatccatatgaaaattattagatagaagagaatagtagatgagtttttttcatctgctatcttgagctatttttcctaatgggagagtatcattcctcaaggagattatggttaaaaaaataaacattgagaaccattgcagtaaatgacaaagtagctaactgagttgtaaactgttttggaatttagtgtagtattttcaaaactttggattgtaactcacagtaaaaaacaaaacattttacagacatgtgtatatatgtggatacacataaaatgatacaaaagtttacgaaataatgtctttgaaagcatccatttgcactctaatctttcttttattccagattctttccctatccctgcctccctccctcccttccttcctccctttcttcctccctcccttccttccctccctccttgcttccttccttcctttctccctcccttctttcctgccctcctccctccctcccctccctctccccctccctccgtcccttcctccttccttccttccttccttcctattccattcacagcctgctaatattattttacaactctgtggataccgtgctgttcaccgggattgcagtgatgagtaggcagacatggttccagcttccaaagatcctacaatcaattgagaaagatagacaaataaagaagtaatatgataaaatatgataaatactctgataggtaaagtataggcagtagaggccattcattcagttattcataaagcatttattcagcacctctttgtgctaggaaccgttgtaggcattagagattctgcagtgaacaaagctaaattacatttctcattgagttgacttcttggtgtgggtgggagtggtaagtgtatataagaaataagaagtaaacataataatcagttaatttcagatactgattaatgagatgatagtaaaacaggatcatgtgataaagatgaatgagaaaataaccttggattgggtagccaggaaaggcttctctgagaagccaacatttgagctgaaccctaaatagtattaagagctagtaatgtgagatctgtggcctgaacattctcggcagagggaattagaaagtttgtatcctgtggaaaaggcacgcatccttggtcttacaggattagggaagtcttcctgaagagagaagaatgaaagacagtttatagccaagaggaaatcacactagtatgctagaggattttttaattttattttttattttttgagacggagtcttgctctgttgcccaggctggagtgcagtggtgtgatcttggcttactgcaacctctgcttcccaggttcaggcaattctgcctcagcctcccgagtagctgggattacagcatacccagctaatttttttttttttttttttgtatttttagtagagatggggtttcaccatattggctagactggtctcgaactcctgacctcaggtgatccgcctgctttggcctcccaaagtgctaggaatacaggctgagccaccatgccctgctggctagaggattttaaaagaggaaaaggtcagtgtgagttaaaagtggttgaggcaggttttatggaggtgtgagatttggagggtgagtaggagttagatgtatggaaaggtggaagaggaacctttaggcagagtaaggtataagcaatgatgtggatatgggaatgggaagccctcttgggacttatatttcacagggaacagttgaagagatctggggccaaactaagaaaggctttgcttgagagaagaggataatgtaggcagtgagaagcagggattagtgatgtgataaaatcaacatctggcttgaaaaactaaccaagtggaatgacagaatagagaactgtgtgtcattggacctttagatctttagtctgcctcctattttcaagtgtgagttaagataattaccaatgcacttttttttttttgtcagtttcctgattgacttcagaacttctggcagttgtagaattttctttttgctaagttgctttccccccccactgcatgtataattgcagaacgctaatgttgctttgcagttacctgcctgcttagttatccaattgctagagcactgaggtttcagtcccagtgccagccagttaatttaccccatttcagagttaaatgctgcagatgtgagcctgatgagaaaattatcacaatggtgatcagaaagagaggggctaacatatcagtgtagaagaaaaagcaacttgttctagtgataatgggttaatagtgatgtcttattgttcatttattcttcatcaaatgtttgagaacttgccttgttctaggcactaaatttgagaatacagatgtgaatcagagggccaaataaatgtaaacatatttagcatgtttcttattggttacttcaggttgagtatcccttattcaaaatgcttgggcccagaagtgtttcggattttggatttgtttcagattttggaatattcgcattatacttactggttgggcatccctaatcagaaaatccaaaatctgaaatggtccaaggaacattttctttgaacattgtgttggcattgaaaaagttttggattttggagtgttttggattttggaattttggattaaggatactcagcctatagttacaatggattgtaggtgcacaaaagagacaaaaactaaatcagtgtgagacactaacatttattgagtgcctattgtgtatcacatactgtgatttttttttcccccataggagcagctttattttataacgaggtatagttgtaactatgccaaagttgttacaacaaaagcactttttaccttatctaattttattgtcacagtaaactgattaggcaagtaaaatagatataataattaacccctttctacaaatgaagatctgtgaaatgactgattgtgttttgtggcttgtctaaggttaaggctgtttggtggttggatatattcactattcctggtaagaataaataaaggtcggatgagctactatttgaggttaaactaagagtagtaagacttttttgtctagaaggacaaagatataatctaagtccaaaatcatgaaaaatattaggtaaaatatatagtatgtcagatggggtaagtgcaatggagaaaaagcacagaaggggaagggggataagaagagcaagggtcctatttggggcattgcaatttaaaatggaatcatcagggaaagccacattgagaaggtgatgacattgagcaaaagacctaaaggagatatatagcaagaaggccaagttgtcaaggtacaataggaaggaaggtgggagagttggaggtgaaattgggaagtgggtgcacaggacaagtggtataggattctgtggatttttttttttttttagttggagtttcattcttgttgtccaggctggaatgcaatggcgtgatctcagctcactgcaacctccgcctcctgggttcaaacaattctcctgccttagcctcccgaatagctgggattataggcccctgccaccatgcccagctaattttttgtatttttagtagagacggggtttcaccatattgatcaggctgatctcgaactcctgacctccagtgatccacacccccccccgctcccttggcctcccaaagtgctgggattacaggtgtgagccactaggcctggcctgtggattgttataacaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggggcctcaatcttttctgtgaaatagcacttcatgttggtcaatttacatgttaattacatttgattctttgacattgtagtcttaataattgctaacatgaatttaataattgctaacatgatttgattctttagatggccgccaagaacgagtcatgtttgacaaaattacatctcgaatccagaagctttgttatggactcaatatggattttgttgatcctgtaagtaaatatggtttttatcttgggttccttctttcatgtgtttctttccatttgtctcttatccctggaccttcattcacctgatatactttggtattctggctatgcccttcgatataaaatttgaattcattgcttaaaacatttttttttccttaattttggttctgtcctgtgagttctcacttttcagagaactatgaatgtgagtaaagaggaaaatttgatattaacatttaatatcagatatttccttgagtaaattgttttattcattagtggaaaagcctaggccaggcgccgtggctcacgcctgtaatcccagcactttgggaggctgaggtgggcagatcacctgaggtcaggagttcaagaccagcctggccaacatggtgaaaccccgtctctactaaaaatgcaaaaattagccgggcctggtggtgggcgcctgtaatcccagctacttgggaggcaggagaatcacttgaacctgggaggcagaggttgcagtgagccgagatcgtgccactgcactccagcctgggcgacagagcgagactccctctcaaaaaaaaaaaaaaaagggaagcctagagtaaagcttgttttggaattgtggttatttaggtagggactggtttaaaatttgttttttgttatttatgtaaaaagatttaagtaatataaagtagatttcatggacaatatttaagtcaagaacaaactattcataaaccagttgctctgcttttctccttatcctttataacttctgtattctagactctcatcatcagttatctggactgttttctgtggtctctgcagtgtcctggacttcctctaatcttaccctcttcaaactcgtcttccacctgacttctaaaatgatcttccttaaatgagaatctctaagaactctttttttcaaatccacccatatttccgtctccttatttaggtatcttatccgcactgctaaggtatcttaggtatcttatccgtaaaacctgtgctcatctcatagctttaatcatatagtatggaaattaattatggatctttgtcctcccctagaattgaggatgggctgtgtatcttattcttgtgatatcctcagtgcttgacatgtatctaattagccacttgaccaaagtaagtttggtcaagagaaaatgattttatgtatcttgaaaatatgtttattgtaaattctcttttatattgaggacttaggcaataattagaatagtagaatgttagagttggaatgaacttaagagtccatcccatttcatctttggtttatagataagaaagttccaaagagagaggggagtgacttaagttagtgggagtgtagggagaagcacctaggtctcttgactcctacatgttctattgcctcatgcagtagtacattttagagcgcaagaatgttgcagcatcctcaaacttcctagggtagattctgttgaaaaactgtcggtgcacatctgtaatcccagcactttgggagactgaggtaggcagattgcttgggctcaggagtttgagaccagcctgggcaacatggtgaaactgcccaggtgcagtggctcaatcttggcccactgcagcctccacccctggggatcaaatgattcttgtgcctcagcctccctcagctgggattacaggcatgtgccaccacgctatttttttttttttttttttgtatttttagtagagacagggttttgctatgttggccaggctcgtcttgaactcctgacctcaagttatctgtccgccttggcctcccaaagtgctgggattacaggtgtgagccacactgtgcctgccctcaaccctgtttctacaaaaaaaaaaaaaaaaaaaaaattggttgggtgtggtggcgcataccagtagtcccagctacttggtggtgggaggatcgcttgagccctggaggttgaggttgctgtgagctgagattgtgccactgtactccagcacaggccacagaatgagaccctgtctcaaaaagaaaaaaagaaaaactgtgtgctgttagatctggcacagttagcacacagatggtattttattctgagttctaattgtttgccttattgctctagaaactatttagaagacttcactgctcttatactgaacacaccttatctgctggatctgggaagaaagtgatcaggagcaacttgggcttagctatattataattagaatagattgcagactgttaaaatagttacacacgtatgtgtctttttttgaggggagtatgcattgttcagctgggaaacacatttattttctgttggattaagcggtttcttaaagattcaataaataaaccactcacaacttagaatttgtttttcttaaaaatgtatgctaataccctgtgcattacctgtcttaaaaactggaacttataatgtggccttgaaaacagtgaaatgcagtgaggtttaatgggattggggccagaagacttgtataataatataaccttgggcaagtctcagtaacctgagcctcaggttcttcatgtaaaataggtatagtaataatcatctcacaaagtgattgtgaaatgtcagagattatcaaagttgataattacttatcaactttggttgagaatcatttgaacctcgggggcggaggttgcactttgtaatttgtgaagtgctaaagaaagttgtcattaaattatcataattcagccccagacctaatttatacttctgtctcctttaattggcctgattaaagtttgattcatttgcttttctgtacttaccttatgtggaatttgggaaaagtaagtatggagctggagccctgatcacttagggagaatctgaatgaaaaatggggaaacccttatatagaatcagtctgttgggagaatttgaatgaaaaatagggaaatatagaatcattagtatgttttcagctatttccctgtgagactaatcgatttaaaggctatacttagattttttttaatgacactttcattttatatgtagtatacattttctgatagttctgctggattatgcattctcattactaagtttcccactgcccaccattctgaaagataaattttcagagaagtaagttgtcttgttctttgtttgagacagggtctcattgtgtcgcccaggctggagtgcagtgccatgatcatagatagctcagtgcagtcttgacttcctcagcacaagcaatcctcccacctcagcttaccctgtagctgcaaccacagtcacttaccaccatgactggctaatttttttatttttagtagggatggggtctcattatattgctcaggtttgtcccaaactcctgggctcaagcgagcctcctaccttggcgtcccaaagtgttgggattacaggtgtgagccactgtgcccaacctgtcgtttttattgtgatgtgaatttgattgttttcttttttctttccttttttttttttttttttttgagacagggtctcactctgccacccaggctggagtgcagtggcataatcacagctcattgcagcctcagcttcccgagtagctgggatcacaggtgtgtaccaccacacccagctaattttttttattatctgtggagattgggggcggggcagggtggtcttcctagcttgcccaggctggtctcgaactcctggactcaagccattctcccacattggcttcccaaagtgctgtgattatgggtgtgagccacaacgcctggcttttttttttaatagtgtcgtgaactgctaagcttaagtgatctcctcacctcagccactgagtagctgggactataggcatgtactaccacacctggccatgatggttttcttaattactcttttaaggaagctattgtttcttgggaaagctcaagtaattcttggttttatttttgtaggctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtggtaagtctggggtgaaaaagtaaaaatttagtactctcagaaaagtaataagggtactagaaataaatcttgactgtttaaagaagcaaatatggctagatggggtggcttacacctcgaatcccagcaatttgggaggccaaggcaggcaaatcgcttgagtccaggagtttgagaccagcctgggcaatgtggcgaaaccccatctctacgttttaagaaaaatctaaaattataaaatagactaggtgcagtggctcacgcctgtaatcccagtgctttgggaggctgaggcaggtggatcgctgaggtcaggagtttgagaccagcctggccaacatggcgaaaccctttctctactaaaaatacaaaaaattagctgggcgtggtggtgggggcctgtaatcccagctactggggaggctgaggcaggagaattgcttgaacccgggaggcggaggttgcagtgagctgagactgtgccactgcactcctgcctgggcaacagagtgagactccgtctcataaataaataaataaataaataaatagcaaatatgtaaattagtgggaaagagcagactacaatttcgtatttctccatgctgcctatctgctgcataaaaaggttgatggatctttgttctttttttcattttctctttttaaaatttttttattttttttgagataaagttttgctcttatcgcctaggctggagtgcaatggtgtgatttcggctcactgcaacctccgcctcccgggttcaagtgattctcctgcctcagcctcccgagtagttgggactacaggctcccatcaccacgcccggctaattttttgtatttttagtagagacgggtttcaccgtgttagccaggatggtctcaatctcctgacctcgtgatccacccgcctcggcctcccaaagtcctgggattacaggcgtgagccaccgcgcccggcccaggaatctattttaaactacaagaacttataatcactttaactctagaagattgtttccttaaatgaggcattacatatttcttcaacatatatgtgtttattgagcactttatatgctaggcattgaggtgggttgagatgacaaaaagggttgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctggtggaaattttttgagagtcttttttaataatgcacacattttagaaaatttaaacactgcaaaagatacaggtaaatactaattctgtttcctaccctgattcctgattttcctctctagaaacaactttatcattttaaaatgtatttttccagagctattttgtacatacgtgtgtgcatacatgtgtatgtgtgtacatacatatttttcttctcagtggtactgtactgtgcatacagttttcattgatactttcttcacttgtaagtatatcttgtttgttctatatcagcctttatgaatttacccttttttataacagttgtataacgttccattttgtagatatattgtcattgtatgtatgtgtaagaattcctttagtgatcaatatttgtttttcatcttttcactgcagtgaatattcttgtatggtaggtgttttgctcatagatgaatatatctgtaagataaatcccttcagtagaattgctgagccaatgtgtatatgaattcaaaattttgataggcattgccaaactgactcccaaaaaggttgctcaggtaaaattttacaagctcatgctcagcaacttaaaaattatccacttgtgtttgaacctgtttcttaactagatgccagaggacagaagggaaaagatgtagcctagccagcccttttacacacaggatttatttaccgtgtatatctggacagattagagaccagttttaactttaggtaatataatgattaggccgggcgcggtagctcacgcctgtaatcccagcactttgagaggctgaggcgggtggatcacggggtcaggagatccagaccatcctggctaacacggtgaaaccccgtctctactaaaaatacaaaaaattagccaggtgtgggagctggtgcctgtagtcccagctactcaggaggctgaggctagagaatggcgtgaacccgggaggcggagcttgcagtgagccgagattgggccactgcactccagcctgggcaacagagtgagactcagtctcaaaaaaaaaaaaaaaaaaaaagaatgattaattgactatctctctaaacatgtatctgatgttaaagagactaggagaaaactgagttgtttgtgtgttgttaatttgtgtaatctcgaagacaagttgaagacaaaaatacagcagcagcaacagcaaaacctgtgtctaaaaatatacctattgatagtcaagtatttcagttctctaatattcacactgggcccatacctgcctttggcaacaaagatgaccttaaaattttaagagaaaaggaaagcaagctttcgtataggtttttctagtccttagatatggatcattatgtagaaacactgtcagtattttgaaaacctggctccttttttttctctccaaaatgattatttgtacgttattgcttttattttcctctgaatgactttgtagcctacaaaaactctgtaacaaggaccagttatgctctaaaatcttactgttacaatagttctttgttggaaacttgttaaaggactatagattttgaagagcctcagaattaacataagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgctcatgttttttccctctttcaaaacatactataaacataatagtaaaagtttggaaaatcacatttaatctcacaacatatatttatgtattatcttctagtgttttcatatacatgtttttaaacctaattaggatacttaatttatatgtattgtttcttttttttagaatgttagatggacttctattctacagtaataatgcttagtgttatctcattgtatcctgtgttgattttagttctggagtcagggccgagagataagagattttgtgaaaataagtaattattttaatttaattatgggttctttttcacccctatcagcgcctgaattctgctattatctatgaccgagatttctcttacaattacttcggctttaaggtaaataatgggtttcaagtatgtgggaatttatacttaaatcatgaaataaaggattttgtttatgttttggtgacagttatcaaggccataagttgtttggagttgagatggacctggggaattagtggggttaaggtagcagtggtggtttgaattaaggcaaaggtagcttatctatttgcagtttttgaattttccacatattacttctggattacctgaggagttatgcagataaattaccataagtatttcataacattctaagtatttttgcgttgataggcagtatagtatagtgtagtgactgagaacatgaatgtcagtgtccacctgaattccagtctctgctctatttcttattagcaagttatttaatctctctgtgcttgtttcctccattttagaatggggagaatataaaatttcaacaacaaatttaattaaaaaaaaattttttttttgagtctgtgtctcactgtgttgactaggctggagtgcagtggcgcgatcttggctcacttcaacctctgtctcctgagtataagcagttctcctgcctcagcctcctgagtgactgggactacaggcacacaccaccatgcccagctaatgtttgtatttttagtagagacggagtttcaccatgttggccagtctggtcttgaactcctgacctcaggtgatccacccaccttggcctcccaaagtcctgggattacaggcatgagccactgcggccaatttagtttaaatttcaatttaaagtgcctataacaggctgggcatggtggcttacgcctgtaatcccagcactttaggaagccgaggcgggctgatcactcgaggtcaggagttcgagaccagcctgggccacgtggcgaaatgccttctctactaaaaaatacaaaaattagctgggcatggtggtgcatgcctgtaattccagctacttggggggctgaggcaggagaactgcttatactcaggagacggaggttgcagtgagccaagatcgtggcactgcactccagcctgggtgacagagtgagactctgtctcaaaaaaaaaaaaaaaaaaaagtgcctgtaacagaccaggcactgctctaaacaacatatacactcatttaatccgctgaggaatccctgatgtatatgttgctcatttaatccccatgaggagtcttcaggggattaaatgagtgtaacgagtgtatatgttgcttagatccgtgcctagtctgttacaggcgctttttaagtgttagctgttgtgaagttgatgatgatgatgaatactacaacttctgttaatgtgtgtagagctggctttttccagaaattttcatgcagtctctgccgaaacaaaagtgccagtgaggaggctgagatgggaggattccttgagcttaggagtttgacaccagcctgggcaacacagggagaccatgtctctacaaaacgttttaaaaagttttttttaaaaaaagtgccaatgataattctggctaacatgacgaaaccctgtctctactaaaaatagaaaaaaaaaattagctgggcctggtggtgggcgcctgtagtcccagctactcggtagcctgaggcaggagaatggcatgaacccgggaggcagagcttgcagtgagctgagattgcgccactgcaccccagcctgggcgacagagcgagactctgtctcaaaaaaaaaaaaaaaagtgccaatgataatgttccagatgaagctaggaagagtaaatgtgctattcttttcatttgaaattttatagaaacggcgaagatttaaagagattgccttattgtggatgatatatccactgcgtctttaaaaacggtgctctgaaaattttttgttgtttctctctttctagacgctagagcggtcttatttgttgaagatcaatggaaaaggtgagaaatgaacatgtttgtctgttacattttctactcattatattgaatgtatagctttgagctataagtcttaatattcttgcttagactctagataacattttggactttaggtttagtttgtggataattgtcctgtttattagtataaagtttttctagtttccttttggtgtccttttctgaaattcaaatacgtatctcaacctactttttctgacgtctcatcatgtgaaaactcctcttttgtctatagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctaggtaggtgttttgagtagggaaatacgccttgacctgaagaaactgggcagttagttcatcacataaaaaataatttaatgaccttttagtagctgcctgctctgattaaatgagatttagattctggaaagatctctgactgtaatgtggtaaatgaattggagaaaaggcaaatgcttataacaaaaatgttctaaaattgattggattgtggtgatggttacacaagtctatgagtatattaaaagccattgagtagtacactttaaatggggaattatattatttgtgaattatattcctttttttttttgttgttgagacaaagtctcactctgtcacccaggctggagcgcagtgttgcgatcttggctcactgcaacctgtgcctccttggtacaagcaattctcttgcctcagcctcctgagtagctgggattacaggtgcccgccaccacacccagccaatttttgtatttttagtagagatggggtttcaccatgttggtcaggctggtcttaaactcctgacctcaggtgatccacccgccttggcctcccaaagtgctgggattgtaggcatgagccaccacgcttggtgtgaattatatttcaataaggttgttttaaaaagaaggtaagtgccaagaactagttaggggactcttatagcagtttatataagaaattgtggtagtctagattagggaggtgaaagtagaaattgacagaagcagatagatcaaaagatatttagggccaggcatggtggctcacatctgtaattccaacactttggaaggctgaggtgggaagatcacttgaggtcagaagttcaaggctgccgtgagccatgattatgccactgcactgtagcctgggcaacacagtgataccttgattaagataaaaatatatataaaagatatttaggctgtcaaattgacagaatatgggtcaagaatggttcttgcatttatggatacagtaagtaacaggattaatgatgatgccatttgttgagaaaaggaacactaacggtctggtaatacattaaaaaaaaaaatatgccattatcaagttggtttgtttcaggaattcaagaacatggtaacatcaaaaaatacattaatgtaattcattgcattaacattttatgcagtttaatgctctttcataataaacactttagcaaaattgatatagaaaataacttccttaatttggcaaaagatacccaataaaaacctagatgtatcgtctcttttttcagcatggtagtggaggcctgagccagcattgtaaaataagaaaaagaaaagattggaaatcagggaacaaaactgtaatgatttgaagaaatgatttttacataggaaactcaagagcatctgcagacacattattagaaataaaagatttcagcaaaatatctggatataggttcaatatacatcaatcagttatgtttctgtactttagctgttagaaaattaagtcttaacctacagccatgcattacttaacgatggggatatattctgagaaatgtgttgtaaggtgatttccttgtgcaaacattatacagtatacttaggtaagcctagattgtatagcctactacacacataggatatatggcatggcctgttgctgctcataggttacaaacctgtgtagcatgttactgtactgaatactgtaggcctttgtattaccatggtaagtatttgtgtatccaaacatatcacagtaaaagtaccctataaaagataaaaaatgggccaggcgtggtggctcacgcctgtaatcctagcatgttgggaggccgaggcgggcggattgcctgagctcaggagttcgaaaccagcctgggcaacatggtgaaaccctgtctgtactaaaaatatagatataaaaaaactagccaggcatagcagtgtgcacctgtagtcccagcgactcaggaggctgagacaggagaattgcttgaacctgggaggcagaggttgcagtgagccaagatcgcgccactgcactccagcctgggcaacagagcgagactccgtctccaaaaaagaaagaaaagataaaaaaaaagatacaaaatgatacatctgtataggacagttatcatgaatagagcttgtaggactgaaaattgctatgggtgagttagtgagtgagtggtgaatgaatatgaaggcctggctgggcgtggtgggtcatgcctgtaatctcagcactttgggaggctgaggcaggtggatcacgaggtcaggagttcaagaccaacagggccaacatggtgaaaccctgtctctactaaaaatacaaaaattagctgggtatggtggcaggcgcctgtaatccactacttgggaggctgaggcaggagaattgcttgaacctggaaggcggaggttgcagtgagccaacatcgcaccactacactccagcctgggcaacaggagcgaaactctatcttaaaaaaaaaaaaaaaaggaatatgaaggcctagtacattactgacgactgtagactgtacaaacattgtgcacactaaatttattttaaaaatattttcttcaataataaattaaccttcgattactggatgaccactgtcgtatgtgtagtccatcgttgactttttttgtttgtttttaagacagagtctcactcttttgcccaggctggagtgcagtggcatgatcttggcttactgcagcctgcacctcccaggtccaagtgattctcctgcctcagctttacaaatagttgggattacaggcgtgcaccaccacacccagctaatttttgtatttttaatacagacggggtttcaccatgttggccaggctgatctcaaactcctgaccttgagtgatccgtcttccttggcctcccgaagtgctgggattacaggcatgagctaccatgcccggttttttaagttttttagaaatttctctaaaacatgattaaaggacattaaataataaataaatggaatagattcaattttataaaaatgtcagtttttcccaagttaaaatatagattcaaagtaattctaggcaaaatctcaacatactgattctaaaattcatgtgaaagagcaaaagactgcccaaaaatgtcaggtcgaaattcctggaacctgtaaatgttacctgataaggaaagtggtctttgtagagatgataaggattttgacatggagagattatcttgaattatgtgggtgggcccttaatccaatcaaaagtatccttgtaagagagaggctgagggagataacgactcacagaaggggagaaagtgatgtaaagatggagggagaaattggagtcatgtggccacaaaggagagcaattagccactaaaagctggacaaagcaaggaacagattctccctcaaaacctctggagggagcactccaaaaaaaaaaaaaaaagtgagttgcagacattgtgactcttgatacctccacttacctttttttttgagatggagtttcgctcttgtcactgaggctggagtgcagtggcacgattttggcttactgcaacctctgcctcccgggttcaagcaattctcctgcctcagcctcctgagtagctgggattacaggcacgcgccaccacacccagctaatttttgtatttttagtacagatggggtttgtccatgttggccaggctggtctcgaactcctgacctcaggtgatccacctgcctgggcctcccaaagtgctgggattagaggtgtgagccactgcgcctggccctacttccacttatatctcgataggagaatatataatatgacctcagagcaaaacaccatagagcaaaacattggaaaaattgactacaattaaaaacttctgtgtgaaaggcaatggaagggcaccgtggatcaataaggccgagaggcgagacaaagagggcaaaaatcttctttattgagctctcgggcgaggttcactggtccgcagggggagggccagggaagtctcgctgtgccaaaggtgcagcgtgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtgaaccaaaaacgaagtcaaataacaagtttcacactttgggaggccaaggtgggtggattacctgaggtcaggagttcgagaccagcctggccaacatggcgaaaccctgtctttactaaaaatacaactattagccaggcgtggtggcgtatgcccataatcccagctactcaggaagctgaggcatgagaatcatttgaacctgggagacggagcttgcagtgagccaagatcatgccactgtactgcagcctgggcaaaagagtgagactctgtctcaaaaacaacaacaacaaaaacacccaaaaaaacaagtttcagactgggagaagatatttgcaacatgttaactattgagagattataagaaaaacaaggccaggtgcagtggcttctgcctgtaattccaacactctgggaggccaaagcaaaggctggcttgagggcagaatttgaaaccagcctgggcaacataatgagagcctgtctctacaaaagtagaaaattagccaggcgtggtggtgcacacctgtagatttagctacttgaaaggctgaggtgggaggatcgctcgagcccaggaggtcaaagctgctgtgagctatgatcatgccactgcactccagcctgggtaacagagttaaaccctgtctcaaaaaaaaagaaaagaaaagaaaagaaaaacagaaagccaaatagaaacatgggcaagggctataaacaaataatgcatggaagaagaaacttgattggctaataaacgtctgagatgttaaactgtgcaataggaaaatgaaaattatgtatatatatatttgataaaaatgaaaaggctgacaattccaagcactgataagaatgtggagcacaaggaaatctcatacattgctagaaatagatttgtccatccactttggagaatctttagtaaagtgaaacgtgtatatcttttgacccagcagttcctctcctaggttcatattctacagaaatgcttagagataaacacaaggtgttgtgttcaagaatttttatagcagcattgtttggaattgcaaatgaattggaaataatccagatgttcatcaacaggcacatgggacaaatgttttggtatatttatacaatagaataccttatagcaatgaaaataaagtttgtttacatatatcaaaaggattaatttctgtaaagcaatattgaattaaaacaagttgcagaatgataaacagatatgcaaccagaaaaattctaagtgtataacatgtaaaaatgtcataaaggaaatgcttgaaaatgttagaggattgcaatgagggtatatttgtggtgtctaattttttgaggtaggtggcaagtacagagtatttgttacatcattctctatatttttctgaatgtctgaatatttatataaacacctagtcaatagatagaatccatttgcatgattgaatattcaaggcagtgaagagattattgatagagtaaggttcctgaggtggggagcaggatgagatccaaagtgaggtaaaggggttgtctttaaaaagactgtaaaggagctatgattttggtagacgtatcaaagaattggttgacaattggagagattattttcataaatgtttgtttttcttggcttactaacaacctgaaaagacggtgatgtatgtttatgaatatgcatgagaaaatgtgaaaatagcacgtttgcagtctggtgaaaatgtaagccaatattttagacttatctataagacttcctactaggcttatttacttactatctaggggaggcagcaagatgattttaaaatgatatttcgatatgttttattgtgtcatgtacagtaaagtgggttttcttctttgaaaatcatttaggaactttctaaacttcaactcttttttttttttttgccttagtgtctttgtgttgagtaatcatttttgtgactctgcttcatttccttgctctaagttgagacattttttcccccgtagctgttttcttctgagtatgaaagatgacagcattgaaggcatttatgacactctaaagcaatgtgcattgatttctaagtctgctggaggaattggtgttgctgtgagttgtattcgggctactggcagctacattgctggggtaggtttctgccatttgacttttaaagggggattcaagtctaaaagcaaacagattcatggttgagagggcatatgctattttttgggagtcctgggtctctgttaaattactaaatggctatgtgacttggagtgagtcattttacttctggcttcattttcatctatgatattagatatttagatttgactagataatctctagaatcctttttagctcaggttttagaattctggcttattttagcagtaataagagcagttatcattgattgattgcttactgtatgttaagtttgttataaatgttttacatgaggtactcatttgacccttactacaacgctatgaggtaactatgattatagactcatgccaggaattttattccttaaaataaccttgtgaataaaggtaccattgtctaattttacaagtgaggaaattgagacttagaaagttgttactttctgagatcaatcacttaatatgtggtagagccaggattcaagatttatgcattgacactttatgatgtaaactttagccctttgttagtttactgttcaatgggagtcaagataatagttttggatttaaatcctagctccactacttaactagtaatgtggcctagagttagttattttgtgtctgagtttgtttccttttctgtaaggtgaagaaaatatctaactctgtagaataaagttccagaaggaaattattccattatgttgtgttttggaggtgctgtgatatatacagcactttacacagtggtagagtgagctattgctcacttatctttctagactgtttaaaggcttgtgttgggatcagaagggttaaagaatttgatgaagtatcttctagtcgtaggagtctctattttcttaacatcattctagagtccacttattgctgagaatctccttttaccttatttattgccctgatatagctatcgcatataattcttattgtaaattgccttgatttcttttgggaaaaaggcattgtagtagtgtttatattcttttttactctacccaaagtgtatctttatataacgacctttagaagatgtagagtttaaatttagctaccttgattttggatccctttggcctgtaattgttacatctcattataaattagaaatgccatgaggtaacttagtacataattgtaatttattcaacattttgttgattttatttgggcatttttccaaagcagaagtagagatggagagcaggtaaaacttcatagattgctacctagaaattaggcatcttttttgataaaagaatggggccatttttttcttttctttgctgagtgccctctgtcatttctatcatggtctctcttttagactaatggcaattccaatggccttgtaccgatgctgagagtatataacaacacagctcgatatgtggatcaaggtgggaacaaggtatgctccatgaattgaaagtactggaaatcagaactaaaggtgatttagtcatatacacttaagatggttcatttatgtgtagtttctaattaccttttttttacttgtaaaatcaatttgaggaggtataattattttaatatgcatatactttaaatgtacagtttgatgggttttgacaaatgtatacacttgtgtaatcaccacattgataaagaggtagaacatttccattaccccaaaatcttttctccctcatatacctttacattcagtcacccctgtcacccctacccacacatactttatccctggctctagacagccactgatctattcagctttcttacatgatagttcgtttgcaaagaatttctcaagttgtaattcatataaatttgttacttgaaatggggttgtaacatgtgctctaggtttttctttcgtttttttttttatctctctcttatcacccaggctggagtgcaatggtgcgatcttggctcaccgtagccttgacctcctggacttaagtgattcttctgcctcagccctcccatgtagctcagactataggcctgtgccaccacacccagctaatttttatattttttgtagaggcgggggtctcactttcttgcctaggctgatctcaaactcctaggctcaagcaatctacctgccttggcctcccaaagtgttgggattatgggtgttagccactgcacctcgcctaggttgttcttaaaacaaaaacaaaaactacctggaataacaaaactctccctaattggctggatgcagtggctcctgccagtaatcccagcactttgggaggctgaggtgggctgatcgtgtaagctcacaagttcaagaccacgagttcaagctcacgagttcaacatgacgcaaccccatctccacaaaaaatacaaaaattaaccgggtgtggtggcgaacgcctgtagtttcagcttctctggaggctgaggtgggaggatggcttgagcccggtaggcaggaggttgcagtgagccgagattataccactgcactccagcctgggcggtagagctagaacttgtctcaaacaaaacagaacaaacaaacaaaaactctccctaattgatagaagaaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcactttagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttatttaccactagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggtgagagataggtacttgttggtaatagcaacttgattcacatgagctttctcttttttagtcatcttaagtcatgcttaggaagagcccatatgtgtgtgatgccacagaaggcattctgaacaagttaagagatgccgtgcttgtcttcttatatttctattctctaaagtagatgctttgtgacctaaatgcttaaaaggtcatgtataaacaggcagacctagatgtttgggcctgaacctgaaaatgattatttctacagcaaatttccaagagagcttgtaaaagtcaccttatgcttgcagtgtttctaatggattatggttggctatttgaagtttcttatgagtgattttgtcctttcctttttaggactggtctttgatgtgtccaaatgagtgtcctggtctggatgaggtttggggagaggaatttgagaaactatatgcaaggtatgggaaaaatatgaaagaaaacaataatgttttaatcatggtttctcttatttcaggggtccaaatatcaaaagtacttgtcaagaatcttttgaagcatctaagagaaaaagtgactaataattttggtcagatttgcttcctgactcttcaccaaaattgagttgtgtcttcttctttcttaaaactttggaatgtataaataggttcttgggatttttaattgatccttttaaaatttaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcatttgaggtcaggagttcaagaccagcctggccaacatggtgaaaccctgtctctagtaaaaatacaaaaattagctgggcgtggtggtgcacacctgtagtcccagctacttgggaggctgaggtaggagaattgcttgaacctgggaggtggaggttgcagtgagctgagattgtgccactgcactccagcctgggtgatagaacgaaactccgtctcaaaaaaaaaaaaaggaaaaaaatttagcacagtcttaagagatttggcttccttagtttttactcctttttattatgaaagatattattggtttagtgggattgcgatcatctgaaggcacctaaaactgcctcattttcccctatggctttagctagagtaaaataaatatcatattcctttttttctttagcaaaacttagagaaaatttaagagttttcataactttatattttaatgtcttcaagttgtctacaataaagtttttttagggaatatatattaaataatattatctgtgcctttcagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggtaggtagaaaaaattcttcctagagtactaagaagagaaccttaggcagttattatttgtgaattcctcacttgatttcacttgagataagtgaagggagtttgcatagttgtaagcagaagaacactgttaaaggcagagagcaaaggaaggaaagggtatgatctgtgcctataaatgttttttagtctaagccgtgtgggaaagacacagttttttcttatacacacatcactgtaataacatttactcaagaaaaatagaaatatacagttatgttagtttaggacacacacaaaaatgtgttaggatgtacattcaatttaaactatgtaagccttgagcctggaaagtggaggctgcagtgggctgagattgtgccactgtactccatcctgggcgacaaagtgagaccctgtctcaaaacaaacaaacaaaaaaccaaaaacaacaacaacaaaagtatgtaagcttataaagagagtcctttcagtgaatggtgagatcaaattctaatctcaagtctgtaaagagacttcacagaagaatcaaggctagaaatgggacatggatttggtgttttaaaaaaaagtttgagagaggagctttccatttggaaagagtggtctgtatgatacaccagagacagggctgggttttatgcagtgtggcaagtaagtctgttttgatggtgcaagtagattaattattggaatatggagagatggctatggctgggggaagggagatagaaggtagaagctgacacgtcacggataggtagcccttgtaggtttctgagaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatatactgctaaggttacagtttaattcaaaatttattgtgcagtagctatatgtaaaacacaatgttaagtgctctgagaatataaataaatatgctgccctctggaaacttctaatttagttggaagacatcgacatatattgaggtaactattatgcaagacagattatattatagaggctagagtgacatttttaaaataaaaatcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttatttttttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagtacatttttatcactgtagataatgaaaccctttatccattagcagtcactccctgttcccttcttccctcagcccttgacaaccactaatatattttctgtctctagatttgtggacattgtggacattccataggaatggagtcatataatatgtggccttttgtgtcaggcttctttcacttaacatgttcttttattcatgttgtagcatgtatcagtacttcattcctttccatccagagttcttacagtgccctacaaggtcctacacaactggataacccacctcatctgcggttactttcccctttgttcactttgctccaaccctattaattttcttgctttttctcaaacatgtcaaccatgctcctacctcaggatttttgctccttcttccctcttgaatgttaaaatgcaccccctcttcccatagccacatgatttgctttctaacctgttcagttctttgttcatatgtaacattttcaatgaggtccttcttgacaattctgtttaaaaattatacccccttcatctttatccccagtactctctgtcttcttttcctgcctatttttcttcctggcatttattagacttctgtgattcaagctatatttaaaaaaatgggtatttggcaacatgtgtagaatggagtagatgtgaagggcatcaagagttcaactgggaaactttcagtagtccatgtgagagaagttaagactttggcttgggatagtcataatcaaaatggaaaagaaagtgtattcattcaacattatcaagacttactgtgtgccagatgtgttgctagtgctaaacatataaatataaataagatgatccttgtgtgaagaagctcactgcctcgtgtagtggagaaatcactggaagagctttttcagaaatcacaaattgagatccattgttgctaagggcttgtcagaatatcagtgaaggtgaggtggacgtgtgtgttttgaagaactctgcagtgatggaaatgttctgtatctgatggctattgagcacttgaaatatgactagtgcaactgagaaactcaaattttatttcattttaaatagatatatgtagccagtggctaccatattgcagggcactcatctactgaataatgagataggtatatgtaaaaagctaattataacatagtgtgatatatgtctggtaatagagctgtgtactgtggaacatagggttctctctctctcttacctattttgctgatgcatgttataactaacacatatgactaggtattgaagaaatagaatcagtgggatttagaaatggactgatgaatgatgaagagggagaagtcaaatataaaaatttaaaattttaatgtctgagtattagaggctcacatggtggtgtaattgacacaggaagtagaaataaaaattgtgtgattcttgacctgttttttgcattccaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgagaaaaagaggtagtctgtctcatttggtacagaatgttgcttttcctgttcagtaatgttttctccttttctttaaaatctgttgacacaaaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggagtaagtatatggatggaattgtttttgcctgtgagtacctgtagtgggctgaatggtgaccccacaaaaggatatgtccacatcctaattcctggaacctgtgaatttaatttcatttggttcaaaaaaaggtattttgcagatgtaattaagaaccttgagataaggagatttacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcagaactatgagagaataaatttttgttaagttaccaagtttttagtaatttgttgcaccagccataggaaacttaaatacctttgtcctctggagtaaaaaggatactctgttttaatctcttatttagaactagtcattgctaaaataatgtaagagggatgctgccaatgttagttttctgtgggttaaaacatggcattcgttatctcacagtttccacaggtcaggagtccagacttagcttagctgggccttcttttctgggtctgtgttcaagatgttggtaagggctgtgatctcgtctgagacacagagttctcttccaagcttacctggttgttggcagaatatatttcaaggactcatggcatcttgcttctttaaggccagtgggagagaccatctctcgtttcaaaaggggcacagtctagtctcttttgagggttttcacctgataagttaggtccacataggataatgtcctcaccacccccctgtcccgcttttttttttttttttttgagacagagtctcactttgttacccaggctggagtgtgtggtgtgatcttagatcactgcaacctctgcttctcaggttgaagcagttctgctgcctcaagtctcccgagttagtagagatggggttttgccatgttggccaggctggtcttgaacttgtgacctcaagtgatccgcctgccttggcctcccaaagtgctgggattacaggcatgaatcactgcacctggcgtaatcttccttttatttaactcagaatcggctgatttgcaaccttaattacatctgcagaaacctttcacctttgccataatcgctggagtgacatgcatcctattctcaagtcatgtccatactcaagtggagattataaatagcctgtgcaccaaggtgtgggaatctgggaagctgtcttagaattctgcctttcccactgcctttattatcagtactatgattctttactatataaaatgttaatttcatttctgacattcctgctgatattagaaaatctaatgtgtggttattagaaaataggtgtttttagctaagtaaacagatcaagggacagatgaaggcactgaagaaagtaacatttttagtgttaaaaaaagagaatgtgtcagccacacccttttatgaatgttagagttttctggtttgtagatatgacatgggataatcagttttcttagcctgcttctgatcaatatgactacatggaattttgtccaggaaaatctctggagcttgtattcctcatagaggttgattagaagacagcatttgttgggatgtggggacatggcagctagtcatttgtgggttttttttttttttggtcatagttttaacttgctgtagaataaatttgagttgtgtattccttagattcttcagtatgatatgtggaatgttactcctacagacctatgggactggaaggttctcaaggagaagattgcaaagtaagtgaaaagatgtaaagtagctttgaaggcagaagggtttaggttcaccttctggatcttcagaagttagatatgtcattttaacttcttaaactcatttattacaaatggggctaaaatggcctatctcacaaaactattttgggaaaaaacttcgtaagataatatatatagtaacctggaagttgcttggcacaatgaaagcatttcagtacctggtaggaattactattattagttgatcttattttagggacttaacacacctagattaggtaattttctttctcattaaggcttttttccaactatgatttttttttttaaatgtttttcattcttatttatttcccaatttagttacatcgggcatataaatggcttttgtttgaattgattgtcataggaataatggattttggaagagtttttggagggtaatgtgtttagactatatgaaaaaaaaatttttaaattgagtttttgtaggcctttcaaactaataagcataagggattcgaaggcagacagaatgttttgcagagtgaataacaaagcaaattgtttttgttttctatcgtgatgactttgtcatttatgggttaatgcatatgcaaagtgattaatatttggagaatgaagcagtagctttaaaatgctctttaaaaaaaataaccgtttgccttaaaattgttaaattaaaattgttttcctactcaaataatacatgttagaaaatttaggaaaacatagatttggaaagagaaaatgaaaattatactaatactgcctcccccagaaaacctgtgtgcatcttagtgtctgtcatcctttaggttttcttccaagagtacacatacatgtgtatttacatggaaattcaacttttaagaaaatggacctgtactgtatttatatatatatatatatatattttttttttttttttttcccctcaaaatactatggcttagttttttatatacatgactttttttctaatttcaaaattagtatatgaacacaaatttattattaataaagctcaaatacagaaataaaatagaaagtaaaagcccttcttcatacttctgccaaccatttgtctcagaaaacaaaccaaaaaagtaacttattctttttcccagagataagacttgttaatggtgtgtatttttctagatctttttcagtacatttgcagataggtacacatacacggttttgtcatataaatgtgatcaaacttgatgtattctgggctgggcaccatgactcacgtctgtaatcccagcactttgagaggctgaggtgggtggatcacttgaggtcaggagttcaagaccagcttgggcaacatggcgaaacttagtctctactaaaaatacaaaaattagctgggcgtggtggtgcatgcctgtaatcccagctacttgggaggctgagacatgagaatcacttgaacctaggaggtggagattacagggagccgagatcatgccactgtactccagcctaggtaactgtgactctgtctcaaaaaaaagacttgatgtattctgagacttgttatttagtgatttattttggagctctttctcttttagtacctgtaggtctacctaatgtttttaattattatagacaattccatagtttgaatatatcatatatgtaggacttttcacaacatttacctgtctgtagacagatgatgttgctattttacagatgaggaagtaaagacatgaagatagttggtggtttgcttgatacctcactacaaagtgacagagtaaggtggagaaccaccccccaaaaaaagtaaataaaaaaataataataactaaaaagtagagaacccagttgtattagtcgattctcacacagttataaagaactgcctgagactgggtaatttaaaaaggaaagaggtttaattgactcacagttccgcagggttggggaggcctcaggaaacttacaatcatagcagaaggggaggcaaacaggtccttctttaatacggcggcaagcaaagtgctgagtaaagggagaaaagccccttataaaaccagatcttgtgagaactcactatctcatgagaacagcatgagggtaacctcctctgtgattaaattacctcccgccaggtccctcccgtaacgtggggattatgggaactacagttcaagatgagatttgggtggggacacagccaaactatatccagttgtacagactccgtcaggatatgaggctgtatgctaagcactgtatgaatccataggtatagaatgtaggaaagacaggctctttgtgttttaaaaacttgagactaagaaaacaagtagttaaggtatacggaaaggtacaggtcagagaaaatgtttgcagagtagatatttgtatttgacatttgtatttgtgcctgcctgatgaggaaagatgttttaaaattgctatcaattaggctgagctttgaaggtgagccaggggcagttgggagatttctcagtgtgtcagatagtgtattttctcttattagtcaaaagatgttaaccttcttgcaggaacttataattgaagaatatactttgagcataatttcttcctctttacaggataatggagaattgtggtgatatttctctgattctgaacactttctcatcattatttttccagaaggggcctagcacaatgattttataggcacttggaaaagagtgagggttggatgagtgtaacctaatacaggtggggagcgcttcaacagtgatttgaatatttccctacgcaagatagtgtatcaagtgttatgattcctgagtgccacagtccaagtggcataaatcatggtatgataaggatagccaacaataaaaattgtactaattcagtttaggagtcaggcatttaagaggagagtgggctataatagcacccatactgtggaattgcctccctgtaggagtttaatttgaaagtcaacgtgtgagttcaatgcatgtacgatgttacatttacatttactacatttatctacatttactacagtgacttaaagtagctgctttcctggcagattgtagctttgggactagtacctgataatctccttttctttaggtatggtataagaaacagtttacttattgccccgatgcctacagcttccactgctcagatcctggggaataatgagtccattgaaccttacaccagcaacatctatactcgcagagtcttgtcaggagaatttcaggtgagcagttcacaaccagccttacagggagatctttcaaaagcctgatgttgggagtaaatgctcactcatgtttaatttgcccattttcttagtttgggtgcaaactttgataaagacagtcatcttcatctctaatattattatttgttattaatatttcagcacaataggcatttaataaataatctgttgaaagaatgagtgaatgagggtcgagtatgaaagtaagttgttgatagttaaacatgatgtttaaccattatgtaatcatagtgatatattctataacttctcccagatgcttaagttaggatactcaaaatgtataaagaagtatcatttaaggcagtggttctcagacttggttaccaattagaatttatggtgggtgagaccagtggttttttctttgtttttaaggttcccaggtaattcttatgtgtagctagggttgagaacctcaatttaaaagactatttgtgaatttccagatatcttgaagtaaagttctgtaaagttcgagaaggatacgtttccaatttttttaacctaagtatttatagatttacccatcttaggcgctattcttttcacttttgcaaacgccatatgtttcttttttaatgaaaatattttttcagctttattaaggtataattgacaataaaaattgtgtataaaaccaaggtatacagtgtaatgattagatatgtgtatatattatataacgattaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggctgagttggacattgtggtacctcctcactcatgctagacaatggagagaatgacttcattgtgttcatctaggttttgcttgtgtagctctgttcacctctgcattgttgtgctaggattgtacacatctttacataacccttaccatcttgtttttatgcaataatataaaaaagtagttctcaatttttctgcatcttagaatcaactggggagcttttaaaatcctgaagcttaggttgcattccttaccaattaaatgtctaggaacaggaaccagacatcaattttttttttttttttttttttttgagacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatgagccaccgtgcctggcctcagacatcaataatttttaaagattcttttggtgattccaaagtatatcaaaatttgggggatcatagatagaaagactgaaattaagagagtcaagcttaattaaaaatcatggttgacgactgatagtccaaaagacagagtcacaaatcgtgtaaatatttgcaactaagagtcaagaggcatttatttgcagatagaggtgtctggctaaatgttggtctgcttagcaacacagatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcaggttggtagagaatatcaaggagtacttaattgccagcttgagatattttggcattggaatgattttatgttttagccacctattaaatattatcacctagaagttctttaagttcaaatccagaacgttaaaaccaacccatggtttttgtaccagaacagggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttattgcttctaggatctctgctcccagccattttgtgtgcattaccaccattcctcagataaaactttgcacacgtcaacccgctattcaaaaacatccattgttttctcactttataaagtgaaagccagcttacttagctagtcgttgccagctgtaaagtctggtgattttggattatgttcttattccctgataatgtattgggtatttaagtagaattataaatttgttttttaatttaacatttattgaacatctagtatgtgccaggactgaggatactgaatagaagatgatgatctttatctttgaagtcttatagtctgttgttacacagagacacagtctagctctctaaacagttataacctaaggcagacatattgtcttgggcaaacctggaagtcatatgcataaaaacaaagacaaaagaataaaaatgtttgacctttccaaagagataagcctgttttaggagtgaaaagaacaggatatttctgtctgactcacaaagcatttttgagagtactcctagaggagatagaattccaagtttaaaaaaagtttgatctggttcatgggaatgtattttattttatgtatgtatgtatgtattttgagacagagactcactctgttgccccggctggagtacagcggcatgatcttggctcactgcaacctctgtcctgggttcaagtgattctcatgtcttagcctcctgagtagctaggatcacaggtgtgtgccaacacacctggctaatttttgtatttttattagagatggggttttgccatgttggccaggctggtctcaaactcctggcctcaagcaattcacctgcctcggcctcccaaagtgctcgaattacaggtgtgagccactgtgcctggccaggaatgtattttattttattttaatattattgttttattttattttatacttttttagacggagtctcgctctgttgcccaggctggagtgcaatgatacagtcttggctcactgcaacctcagcctcctgagtagctgaaatttataggcatgtactacccctcttgggggattacaggcatgagccacagcgcccagccaggaatgtatttttttgtttgtttgtttgtttgttttttctttttatttatttatttatttatttttattgatcattcttgggtgtttctcacagagggggatttggcagggtcataggacaatagtagagggagggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcactgatcaacaggctcacaaggcagaagaatttttcttagtacagaacaaaatgaaaagtctcccgtgtctacttctttctacacagacacggcaaccatccgatttctcaatcttttccccacctttcccgcccttctattccacaaagccgccattgtcatcttggcccgttctcaatgagctgttgggcacacctcccagacggggtggtggccaggcagaggtgctcctcacatcccagacggggcggcggggcagaggcgcccctcacctcccagacggggcggctggccaggcggggggctgaccccccacctccctcccggacggggcggctggccgggcggggggctcacacccccacctccctcccggacggggcggctggccgggccgggggctgaaccccccacctccctcccggacggggcggctggccgggcagaggggctcctcacttcccagtaggggcggccgggcagaggggcccctcacctcccggacggggcggctggccgggctgggggctgactccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggctgggggctgactccccaacctccctcccggacggggcggctggccgggctgggggctgactccccaacctccctcccggacggggcggctggccgggcggggggctcacacccccacctccctcccggatggggcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtg

SEQ ID NO: 35884 - DNA, 14928 bp, Homo sapiens
caaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgacttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggaggctgaggcaggagaattgcttgaacctggagaaggaggttgcagtgagccgagtttctgccactgcactccagcctggggaaagagtgtgaccgtctcaaaaaaaaaaaattatatatatatataaatatgtgtgtgtatatatgtatattatatatgtatgtattatatgtatgtatattatatatatatagtacacaaggttataagtggtgcacccgtagaggagggcacttaccatgaatggagcttgctgagctggaagttgccctggttgagtcggtgactgaatgtgaaggcctcagacattacactactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgttgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactgaaagatggcaccataatagttgaaaaaactcagtcacaaaacagtggacaacataaatgtgatgtcctctccttatcaaaccattggcttctgggtgaatgtaaagggaggggagaatgtgatcaaaagaggtctaggtgagtggagatggtatgaggcagatgggtgcattgggtaccattgaacctctggagaggtagccttaacttgtacccactgacctataaattctgcaccaagacttttgtgtgattggttcaacagggctcagtaatcttgttttcaagttctttaagagcctgttattgcctggatctccagtaaatctgttctttctcctcataaggaggagagaggagtaattaaggaatgccaaggctatttttatgtttcaaatgaaaatatggaccacgtgcggtggctcacacccataatcccagcactttgggaggccgggccaggcaaattgcttgagctcaggagtttgagaccagcctgggcaatatggtgaaaccctgtctctattaaaaatacaaaaattagctgggcgtggtggcacgtgcctgtaatcccagctccttgggaggctgagaatcacttgaacttgggagatggaggttgcagtgagccgagaatgtgccactgcactccaccctggacaacagagggaggttctgcctgaaaattaaaaaaaaaaaaaaaaaaaaaagaaaatacttgtgagtctctagaacctgaaaacctgaaagtcttctttactacttttgagtcgtgtgtaatgtgcggagagtggtacctatagcacagtgaggtggctcttctgagtaccactcatgccccttgcagctagtgggctataagtgtcatccctgtttcctggtgtcaggccccactcccttgttgtcctcctttactctggtgtgggagtggggtggagggcagcagctgggccccttacacttggtgccatctctgcaggtaaatgccatctgctatggggccaagattatgcttccaggtgttcttcgatatgaggacggcattgaggtcaatcaggagattgtggttatcaccaccaaaggagaagcaatctgcatgggtaagaggggatgtttattttttaaattctaaatgtttgtggttacatactaggtgtatatatttatggggttcatgagatgttttgatacaggcatgcaatacataataatcacatcatggagaatggggcatccatcttaagcatttatcctttgtgttacaaacaatcctattttactgttagttatttatcaccttagttattttaaaatatacacttaagttattattgattatagtcaccccgttgtgctattaaatagtctcactcttcttgttcattcttttggttttttggtggtggtgttttttttttttttttttttttgagacagtcttgctcttttcacccagactgcagtgcagagacgtgacctcggctcactgcaacttctgcttcccaggttcaagcgattctcgtgcctcagccttccgagtagctaggattacaggtgcacaccatgacacctggctaattttttgtatttttagtagagacagggttttgtcatgttggtcaggctggtctcgaacttctgacctcaggtgatctgccctcccaaagtgctgggattacaggtgtgagccaccatgccgggcctgattttttttttttttgtacccattaaccatccctacctccctgccagccccccactaccctcccagtctctggtaaccattcttttactcttctctgtccatgagttcaattgtttcgattcttagctcccacaaataagtgagaacatgcaatgtttgtctttctgtgactggccgattacacttaatataacgatcttcagttccatccatgttgttggaaatgacaggatctcattcttttttaaggctgaatagtaatccatcgtgtatatgtaccacattttctttatccatttatctgtcgatgggcacttcggttgcttccaaatcttggctactgtgatctctttgataacactgatttcctttatttggggtatatacccagcagtgggattgctggatcctatggtagctcaatttagtttttcgaggaacctccaaactgttcttcatagtggttatactaatttacattcccatcaacagtgtacaaaggttcccttttctccacatccttgccagcacttgtcattgcctgtcttttggatataaaccattttaactggagtgaaatgatatttcattgtagttttgatttgcatttctctcgtgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtgatcatggagagagacacttaccctcggaagtggggtttaggtccaaaggtaagtggtactgggttgcgtgccctgccaggttcttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtctgtgtccctgattacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaat

SEQ ID NO: 35885 - DNA, 43202 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaaggtgagaagcgggggcggcccgctcccccgtgccccgccgcccggacccctccacctgcccggtgggcagcctcctactccgggagcgcgtccctcttccagtcacctccgcccacctcttcctctccgcgcatcccacgcccaccaccttcatgtttctcagctccatttttgcctcccgctcccttgccttttcctcttggccctcatcccgagcttctttccctctccgcggcctgggcccccagacctgccctgctcgcccggttcgtcccccgccaggttactgcctccttccctgcgagaggtctcctttgttccttcctccgcatggtccgctgacaccttaccgtttcctgggccagccttgtggcagtcctcttcctctcgtccagggacccatgtcatcttcctgccaggttccctagctgctgtgggtcagtgctggggagaaaagggaacggacatccattttgcctccctgccacctttctccactccctcgactggttgaccaggtggtacatagacttcctttctcatttttgtctttgatgtgggtatgtccacctggcagttttcctatctctgttccgggcctctcctgacctgccgcctccagctccttagcttctgggccacatccttctctctcttcccccgctcagacccttatattttaaacccatgcacccagaggcctttggtgcgtgtttggctcttgctccatgttcccaatccctggttggggcaccaaaactatatttcctgaattccaagacaccatcaactgtgagacacactgttcattttatgacagcccaaggggtagaaggataggaaaaaaccactacatgtataaagatttgaaggtgaactctattacagaaatgctaaaattttgaaacacttaagacttagagtcgaggaaatatggtaataatagtaattaatatttacggagcacctatcatttcaggcaccttactaagtactcggcatacattgtctcatagtttcctttccacaatttaaagattcctgtggtgtcacacatccacctaatccaggtagtgggtatttggcgggcaggagtggtatagtgatagtgatttgttcctgacttgctgcctctgaatggagttacttcctgactctggtgctaggtcgctagcacggcctcctaccctgaaatggtcattgaatgagaactgtgggcatctttggaaataggcctttttctagagaaaggggaactggaaccattgttccactgttggtatttcttgataaattcaactctttgtggtagaacagtgcctttgtagatgttagttttcagactcaccctcctcttttcctgagcagcttgcagattggtttctgaagaggcgagatggaaccatgtgtacatcttttagccatatggtcctggaaaattatttttaaatgaaacttataagctgttttgacctccagtttacacttgcctacatgcctcactggtcccattagctgaacgtgcctttctgagcagtgcttcacaccatttcaacacatttggtcaggggaggagtgatgtcaacacatctggtcaggggaggagggaggaagaacatggatcatggaactggaacacctaagataaggtaatctcaggggacattgtgggcatgaacatcataaaaattcccagatcgctttccactttgaggttataagaggtgttcagtggctgcagatggacttattctagaatttcttccttcttgagagtgctggggggaaagattagcttccagctgactcacatgtttggcctcttgcaatgcagagtttttagttttcctatgagttgcatgtctagatactgacccattctgctcctggatgagggttaccacttccaaacaggattccccagtgcatggagcctttctctaaaataagaaagcgaaatcagaatttaacctctgaaaaggaaatggaaggatcaaagtctgtgggggtgagccagggtaaatgggaggtgggagatttcagtggaaactggaggtctcctgtgagccattggtgtgagtcagtccttgagccagatcgtgttgggagggcactggcagaatctgctgtcagcctgcaatgaagaatgtcctccactctaacccaaaggggtgttccctggtgaggccctgctgagaagctagggttggtctcgcttcatctctgtgtcctgaggtttcttgagaaaggttggttgtgggcccgcagagggctgtgctcatcccaccctgggctgtgtgagtactgcccatgctctctgctgaggacacctgtatcttgaggcaggaacagagacagagtgaaggtcacagggagagagaagaattttgcagccatatttggctggcttcaggcatttaatctgactgaatagggttcatttcttcagtgactagggcagtagattctctaggcacctgctgccccggggcagagcatgtgtttctgagaacctggtttatcccctttctattccagagcagctccggttgtctcactgtatgttttggaaactggttgtatccaatttagaccttcattgctattcactggctaatcaatcagcaaatatttgttgagtgataagcattgtttgcattgcagttggggaaatgagctactcatagaaggaaaattggcaactgttacaaagctgtgtttgaaaaaggccaaaggagtggttcagccatttcttatgggaacccaggggaggggaaagtcacagagggctaatctgatcaccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtggaggaggaaggatactccaggtggaaaaacagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtcagccaggtgtgaggggtagagaaggcattttgtccatccagtgacgtcactgcccagaaactgtcagcaaggaggaaggaaggcatgagttggtgaccgcatagtgctgactagctggacagggcataaactaactctctgtgtcaggagagctcctgaattcttcggtgtagagtccagagctgagggtcagtagattctagtcactagaccaccaggtctgactggctcttggtggtttgggtaaatctgtgcctctgtcttcatggaagtccagacccacttaacactcggaggctgcatgtttcttgttaagagttgtttgccatccagcacctcaacggttgtcagagctagaaggggcattagagatcattcatcctggccctcgctgatccaggaggaagcagaggtccagagagacatgtggagctcacggtgctgcagccagttaaactccaagcaaggcttcctgctccacccagtgccctccctgcacttgtgagtggggcaggggacgctgcccttgactccagaccaagcccccagtgggggctcagcagaatccccacaacaccccctaccagagggcatcccctcacccatcaatccaagatttacagctgtccaacttctcttgcctcgccacccttcccctctccattagtccatttattctgtggttggtagaaaaattacgctgttcagagcaataattgcaccaggaaagggttttctccccagtagtagagctagactgatactactgatcattttggtgttaggcatttaagacacctgacacttcaaaaagcctctgtcacccagctctgcattgcgttgacagtaaagcttaaatgcagctttgctttaacaatggagcactcacataaggaccttctctattccatctcctgttacttgtcaaaagacaaaattacaccacattcaaaaatcttaactggcttctatttgtgattctggaatcggacaacaccacattctgtcttacagaatgagtattctgatgagctgagcagaggagtttggctttatagacagaaaaaggctgaagaaagtagaaacagatcaaaaatctgattggttatttcggtcccttttaaaggttaaagcagaggagacttctgtatgttggctgaaactggcttgtttgaagatttgactgttaactcactctctcctgatcttggaaggtcagatcgacagcttagttttggcttggtggcgtggaacttcagcttgagggactccatcttggtttggtctcttgggccttgtgcaggagctcagtcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagatatttaagactctttgagaggatacagtgtaacagggaaactactgtaatgactctccccaggataatactaagagtttacaatatgacgcttagccagggacccatgaaccaaaccaactaaaattgaagagatcaaagaatgagccagatgaggaatttaccctttttaagcaagtactatttgttcatttttttgcaactgagtctcaatacactatgtgtctatccatgtgcaacagaaagtgtcagcaattgcacagattccctgttcgctagtaggtagcagttctattatctagtatcccatgactgggttaaattaaagcaggaagtgagaacacatgggtctaaaagtctgactctataaaagggaccactagtacagtttgaacaacagttgtgttagggatgttgctgaagttacccactgggcagactaaaggatccctttggtcatgtaaagatctgggtttagcgtgacaaatccaacagtttgtgaagttacccacagaagccactgattgtgaaattctaactacagcattatcctgccagacaaaaaaaggtagatgtaatcaaggataaagtggaagtcttattccaatgaaactcttgttcagaagttttgggaaagcatgaagttgtcaacttcttgtcctggtttgcagtttgattgtctctggttatggcattgggcattttggtgaactctttgtgtagcgtacacgtcaggcatgagacttgtcccttgaaatgtatatcaagttgttcagcttctgtttatagggctttaggcacagaacagttcctgttcttagttggagaattgtagctagttattggaagaaactggaagaattcagaattcaatccatcttataggtagatgataaaaacttgaaaatgatcaacaaggctacaatctaataacagatgtactatagtttttctttaggaacatattttttctctctatagtcacccccatttctaccaaagataatcagggtaagtgggaggcagaggtcacagtgagccgagattgcaccactgcactccagcctggatgacagagcaagactccatctaaaataaaataaaataaaataaataaaataaaattcagactaatttgcttgcagaaaatatttagtcacatcagacttggcctaattatttacataagtgtggcaagaatagtgattgaccacgtaggctcttcttaagtttgctttgctagaacttatcgataaggaatctcagattggacttttaacaacttctcaaggctaggaagtcaacccaagcccaacttcagatttcacctgcagtacctatagattcatcataggtatattctcaagtatggcatcacactcaaaaccttggtaatatgaccagtgtttcctattgtatcctgttgtaaagagagcagatacttattgaacttatgcaaataacagtattgccataaaaataggaatattcacaaatagtttctgaattccagagaggtcttgtagggagaaaatgtttccatttttgttcacaagagtatacttaccaaattgctgtaaactatagatagcttaaaagaaaataagttttcttaaatctggacaacaaaacattaaaaagaaccagcaacgtttcaaatttaaaaaccagaaaaacccataattcttcattagttcatttagtctcatgtaattaattcttgttgtgcttgatcttggttatcagttttgcagacccatcagtttttttcattagagttctggaaattctttcccagtccaatcgtattatctcgaagttatcagaaatggtacttatcagagacgtttccgtggatctccttgaagatgaagcacttcaggattatagttgcttagaaaaaagcttttagaaaaacatcagaataaagcaattaactgtagacaataagacttaaaatggttgtggttaaagatctgatgagagttcatagtaataatgacacaattgacaaggaaatctggttattgctgtgcatacaacattttaacctaataaccaaaattaaggctgataatgtatcatatttctaggaatatcatataattttggggatacaccttaatagcaagtataaacatacatcaataaatataactcaaagaagattaaacatcatttcttgtttgacaatgcttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgaggcaggaggataccttgagcctaggggttcgagaccagtctgggcaacataggaagaccccatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaagtcacagtcattcatctaaccagaatgataattaaaagacttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagttttagttgcttatattaattagtttttactccttagtaatcttaatttctagtgaaaactagcaagcattgtgaactgtcttctattaacattcaccatttcataatttctagaaacatgtttcctcagcttttcatgcttattacagacccaattatattctctatgccatacaaaaacaagatgccaaagcatatatactttagacttatgttcagcaattaatgtttcagtattttaatttacttagaaatgatattttatgaatatctatgacttaatttaacgtaaaataaccgtaagaggaggctggatatgtggacaggggccaaatgaagaactgccttctggttgtagattttcttctaaagtcagttagagcccccagagaatgttgaatagagattgacataatcagatccacagaaagaaaagatcatttggtggctagagagggcagtgaggggtggagcacattagaacctcaccaggagagaaataatatgttgatgtttctctggaagccctgccatgagaacctgtactagctcatgggacacggagggtaggttggaggtgaggtcagtaaaaaaccagatcacgggttcatgccaacctaggacaggcatgaagagatggaggtttgggtgagggaagagacttcagaggagagtggacaggatgtggaggcaggtggggatcagcaatcccctggtaggggcagagggattgcatcctgggcctggcatgcaacaggccctgaccatacctgcctttgtgcaggctgccttgcaggtgaggtttaaagccaaaggatgcaccccagcttgcagatacttggataggctcaagttgctatccttgtgtgctaagggagtcaagaaggctccccaaaaagtgtgtggtgggggggtgttgaggaggttggggaaatggcatcataggatgtagctcacctcactctgctaaatacttttgacgtctgactctggtaaatacctccatctacttcctcttcccaaccccccacccacctccctccttcgaggagtccagaagctacaatgccaaaagcagactaccagcaagaaaggtgggggaaagaagggggtggtgtggccacaggccttcctcccagctcgcagagccccctcccttgtatcagccccaagaagggccagcttagttgccttctttccagggatgcgtcagggtgtgccaggctcttcctgcatctgtctcgtggaggtgagggtaacactccttccccaggcgtaacgtgttcttaggagctctgataccttctgaaattgtgttcttctgagacgtcgtaaggagtaagttctagggtggagtattagggtgtttttgcattgataaaagtaagtacctgaggctaggtaatttataaagaaaagaggtttaattggctcagggttctggaggctgtacacagcatctgcttagcttctggggaggcctcagggagcttttactcatgacagaaggcaaagcaggagaggaagcaggagggggttgggaagtgccaccctattttaagcaatcagatcttatgagaactcagagtgagaactcactcgttatcaagggggcagtgccgagctgttcatgagggatctgcccccaagatctaatacctttcactacctaatctaatacctttcacctcgtctaacattggagatcacatttcaacatgagatttggaggggacaagatccagaccatatcaggtggggtcagaggtcctgctaaaactgtgactatcagggatgttattcagatattagtgttctgtacttaatgggtgctgggtgggctgcctgtgtaaattccactccctgcccctggggcatgagcttcaaatgggaattgtgcctgccaccaggcaggcctcctcctcctctcatctgcttcagagacgcatgtgggtccagctgccatggacgtcatcctgagctgtccaggcagacactcccagtctggtctcttcttgctcccttctattctggctcccatgcctcccaaaaaccctcctctccaggcagcctggtttctgccagtcctctcctcctccaccttgctcaggcagttccctgcccactggaccgacggtctaggttcaactctgtttccacctttcctgctgagcccatgccttggtctgcagggccgacctctccaaacttgagagttctgtgccacatgatttggcccctgccactgccctctcacggcttgtgtgtcttcctctgtgcgcaccttggcttccagctggagcagcctccatgtgggtggaactttggtggatgctcacggggcacctgacctggaacctgagctcaggagagctgcctggtatatgagcttgtttcttctcagttcctgggctgtggcccagaatggtgccattattctctctgccaatgtttcagcggccagcagccttgtggcccggggcctgatgcaggggccagactctggcctcaaggcttctttccccgcagttcctggattccagatgctcctgtttctgtctggggacccagttcctgataccctttaccccagtcactcaagctctgcccactaccagtatctctggccccaggaaacttccctaagggtcccctggggaattccagatcccctaaggcatgttctccaccctctggaactgatcccatttagagccccagggacaaaggcaataccagggcttttcctggggggtggggggctggggggatggcgaggagcagggcaaactccttcaacatctctcagcccccatccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtaccagcccctcttatttacccctgggttttttgtcctttcagcctggaggccggccctgtatctcgccgccctggactgtgctgaggagaccaacagtgcagtctgcagagacttcaacatccctggcttcccgactgtgagggtgtgtgactgacaggaggggaaggcaggctgggcctgctttgtttccctttataagggaaagggaccatgtgggatgtgtcgggatgggcagatttcagctgctctgatttgagctgggaggtgatcatcacttgggctggtgagagctcccacctcccaaggtcctcttcaattgctctccctcttgacctccaagccttaagaggtctgatctaactctataaaaccaggattcaggctctgacccacctgtgggcagggtcagactctagaagcctagtggtcccccacaaagggaccccagacactctggcaagcctcagcctcctcaggcaaaaatgccttgaaccacaggtagctaagaagggacctgtcagggtagcctcaccccactgtcagaatgtcagtgcctcaggcagcagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagctataaataatatgtaccctcccaccagaatggcatctagaaaaccagtttcttctgtagccattaaggattattaggaaatgcctttgaaagctgaaatgccaagcattgtccctggaacaagatacctctgagctgggggtaggggcagccaagtttcaagcagaactgtgagccagaactcagcttaattaccccagcagcatccatccgggaagtaaggccgtggctccaccaggaacatccagctctaactccatgtgacctttctgttcctcgagcccagtgcaacccccactggattcagggtttccacacctaatagaagtcccttcctaaactgttaccacatagggtcagggccccccaggccccaggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaaggtgtgtaattgagaatattcaaacagggcactctgttcctttggctgaaccagggtgagtggccctgagtgggaagctgtgggcaagttagtgtggcacaaggaaccatcattcacaggctgatatttttctcccagtgagcatgagccgcaggggtgcagccactgcccagcccccaggggaggggttgacactggtacagcagccagggcaagacaaccgattggagttctgtagggcctgacacctgagctttctgactctgcctgggagaggctgggcacagcagggatgaaggaggcggcctaggcccaggaggtcagaggctcctcagcgccaccccatgtcacgcagcgcacgcagcctggatgcctcaggtgagtcaccatctcctgaactgcctggctggctgtgggaggggcactgggagggccctcgctgggctcctcagccctcccctgcctccagacgggcagcacctggcagggccagtctggtagtcatctgtccacagaccaacacggtggcctcccccggcaaagcctttcctgcctctcctgaggaacctgtggctcagttttggccagggggaggcacccagtgcccagtccataggccaagtggcttgagctggcaggtctctgctctgaggtcctatgcagcggctctcaaatagtttcttactgtgaccaactgtaagcaatacacatttttacattgtgatcccaaagttggtatgtatctattatcattaaaccagaagtttcataaaacaagattcttactaagtgcagttaaactgtgatattttctgttctatttttttttttaaatccggctgtgattaaatacattgatttgacagctcattacaaggttgtttctagtgtttggaaaacactactcaaacagattccaatatccagagattcggggccatgaagaacctgtgtgcccttggcagaggctgacctggagactgctggtgggccagagacatagccctgttgccctgcctgctgccctctgggggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgtctccagccccttgtcactatgagcaaacagtgagcttctaccagcccagcctgtttagcaaacacctgggccctgaagggcgggccagctgtgtcaggtccccatcaggttggagccagagcccagctggaaggaaacaaaggcgtgggagagggaggggctggttggctgcaggttctggctggagcttggcaacctagaggctggaacttccgggtcaaggggcttctccgtgggcctcaggagtgcccttcagtgggaatagaatgggactttttatggccgaaggcctggccggagcaaggggtacacagcacagcagcataggggtggggaagggcaggtcttctctcttcgaggctctgaggagatcagtgatgtggtttcaaatccaggcctctctgcttactgtgtgtggcttggaaagtcacttatcagtgccccagccgtgggccccagtttccttgtctgtaaacatgggatgataacatccacctaagaggaccgttgccaagtgtgaagtgaggtctcccatatgcaagtgccaccatgctagtgtgatttggacttcagtaaaagttagtttgcttccttcccgttgtcccatctcactcctgggccacccgtggggctgctggtagctggtgtgtggctgctgctggactgtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggtatgccacaggagtttgctgggctcacggagctctttcactggtcagagaggagtgtgtgtaggaggggacttctacttggtgttgaaggacagatggggtttggctgggagagaggaggaatgtgggcgggccttataggcaggcgagaaggtgagagccaaggccctctgtgggcagggcgaggtggcgtgttgaggagactcgtccagctgggcagaggctcatgttgagggatgaggcagagctgggggaggagggagcccagaaatggcaggtccttgaatgcaggtttggaagcagggacgccctgtgagggtacagagtctgggctgttaccttctgtggcttttgctagaaggtgagatgtcagggaggaagacaggactccaggatgtctcctgtctctctctggaaaaaggaggtgggcccctttctcagcagtcagctgctgtttttgaggtcttctccatggataatccacggtgttggaagtggttaaggtaatggatcctcatgggcttaccataaaaatatctggaggctggaccattttccttaaaacgttataaaagctggaattgaatgccatcggtgtcacccctgggaagtgtgctttctcttgagctcttttggccccaagatagcagtcactccatagtttcgtgaagaccagcctggtgttgcctggttttctgccattagggagcagctagaggtcttccagtagctcctgtgtaaagtgatgaaagaaaagggctgggtgctgactgctcctggagaaaagcaacacactcccagagtcttaattgcctgcttccagggagctgtggtggtttcccttgggcagggcacacgccccagtggttgacttaataaggatacattttaatcagaggacaaaaatgtgccctgacttgatttccgcatgggcttccagcatggtcaaagggcagagattctctgttcagctgaacagatgtctattgagagatgccagacactgtggagcttgcagagataaataaaatgtcgtcctgcttcctggtcagaggtgggtgcatgggtgagtggtggattcaggttgaagttcattgcagctggagtggcgggagtggagggcaatgtgaggtgagtttgggtttggagcctggaaggccttgaatgcagtgagtttggacattattcattgacagtggggagtcatggaagagatttgaggaggagcaaaatgttcagaccagaactgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggcagtatccagacacctgagtggaggccatcaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaacagaagagtgtcaggacctgacatgtgtctgtaggagagaccggggtaggagatgggggtggacagtgggcacaggagagcagtcgaaagtgaagctaggaccagggcaagggggccaagtaaggctggtcagtgtcaagccaaccaggggagggtggcaacgtgaaagcaacaaaggagagcaaccacaaaatgtggcacgaaagttgacaaatgctcgccatgggaagacaaagcaggcagtaataacatctgtaccagagagaggccaggagggcggggagagatcactggagtggctgaagagaaggtcaccaaggagcttccctagaacggcttcaactgagggttgtggggatggccagagagcagtctgaggagcaagggcagacgctgttccaggaacattggcagcatggggacacgggaaggaaatgcggttactcgagaaggaaggagggcctctcttcatccccatcctccttcccttcccatcctttccttttttaagggttagactagaaggattcgaatctatctgtaggcctagttgggcggctgtagtagaaaagaggaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgcagggatcttgaggggttgcctttttaaaatttttttattttttgagacagagtctctctctgtcgcccaggctggagtgcagtggcatgatctcggctcactgtaacctccacctcccaggttcaagcaattctcctgcctcagtctcctgagtagttgggatacaggtgcatgtcaccaaatttggctaatttttatatttttagtagagacggggttttaccctgttggccaggctggtctcaaactcctgacctcaagtgatccgcccacctcggcctcccaaagtgctgggattaccggcatgagccactgcacccgtcctggagaggctgccttttggtagaagtaatgcaagcctcttttaatatgggcacctgctcagatgtgggtgacctgatggttgatgacaaaaaaatgaccatattacttttcagaggtgaaaataacagctgtagctgtgggaaagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttaatttttaactttttgtagagatggggcctcactgtgttgcctagggtggtcttgaactccagggttcaagtgatcctccctcctaggtctcccaaagtgctgggattacaggtgcgagccactgcacctgacctggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaataggccaataaaattaaataactgtaaagaacgctatttaaatatgtgtggtatgtataagtggatggttttcatccacaataaaagtttatattaatgttttgaaaagagagagtaaagcagtgagcaggagtaagggcccgggggaggtcacagggagcagaaggttgcagatggggagagacaggtggcttctctgcagcctttgttcctcatgtgggagagggtagcaggtggcttccagattttctgcctacaaatgtctgtaacaaacaagtcctagctgatcatggttcctagtgtttaaaaggtatgaaggagggaaggggatgctggtggtgggtgatgatggtacagttaacatgtaccagttccttgatgtatgcactaggtaccatgctaagcactttagatgtatggtcatggaatcctcacaagtcttcaaggtagatggtgtcatcctcatttcaaagatgagaacacaaaggttcggagcagttgatgcgttgcccaaggtcacacagcaagagcaaagcagaaccagtccttgaacgaggtctgccagagcccggggcctgttctcagctgccagcttgggataaggccaaacagctctatcccaaggagggagaaggaaaccagtgtttggctgttggaggcagaagtccaaggtagtgaaaagtggccccgaggctagagtcccacaggaagaagcctcttcccagcctgcaggctctcccctaggcagttcagtggccggcttccaggacaactcaactgtgttccctcctgaatcggaagagcgcaggcaaaagccttggcagctgtcttgccgcctgggcagaagcccagattgccaggagtcaggctctgttcggtctgtcctcttgccccaaggaggtgacagactaggcttggggtgtcatgtacatgggaaaagaggacaaagtggtgagttaaatcagctagtctgtagcaaggcatgtttccccagggactcaggtccccgcttcaagagaacctgttctggagaccccttccttgactgtgtctgctgtgctgggctgggacttagtggacagagacagcagcctgtaagccccttttcccaagtaaggagcaagggcacattgacatagaagcaagctgacatttcccaagggacgtaggaagtgcctgcacttcatgttttcagatgagtctgcaaaggaaaacagcagtggtacttcatcactcatccattcgataaatattggttagtaattacatgctaggtactgtgctgcatagaaatggccctcgaggaggaaagtgtatgaactgctgcccacaggatccatggatgcttctgaggggtgtgggagggtaacaggggagggagccagtgtccagctcctagagcaacctccccccaactccccccaattcaccattttacagatgaagaaacaggctcggccaggcgcctataatcctgacactttgggaggctgaggcgggcagatcacaggtcaggagttcgagatcagccttgccaacacagtgaaaccccatctctactaaaaatacacacaaaaaaaattagtcgagtgtggtggtgggcgcctgtagtcccagctacctgggaagctgaggcaggagagtcccttgaacctgggaggcagagcttgcagtgagccgagatcgcgccactgcactccagcctgagcgacagagcgagactctgtctcaaaaaaaaaaaaagaaagaaagaaaaaagaaacaggctcaacaacattaagtgatttgcccagccaccgcattgaataagtaggcagattttcagagcaggcctgcgtggctgcactcttggccactatctattactgatgcccacctgtgtgtttgcttccagttcttcaaggcctttaccaagaacggctcgggagcagtatttccaggtgggtgcccagctctggttgtcctgttagcatcttcctcccccaacctccctcttcacctgggtttctattggggtggagaaagccctggcagtcggcagggtcgagggtgaggcggtccccacgggaagcctaacttgtgtcttcccaaaactatcctcccagtcagctttagggaaaggcaggatgaagaagcccttcaggttggacatatccagggccctagggtcggggcaggggcaccatgttcccagaagagctcttctgtcacaatggggttggcgcccagagagcagaccagagcccttggggaaagtcctgacgactcccagttctgagggattctttcctgtctgagggatgggtgtccttgcactacttggggccacaggaggactactcaagccccattcttctagcacagggaaggactgacgcctcgtctgtctctgtcagagctggctgtgccctcggccctttgtttctgggagtgaaggtggccagtgtgctgtggaagcagctctgctctcctgacactccgctcacgcctgttttcatttacagtggctggtgctgacgtgcagacactgcgggagaggctcattgacgccctggagtcccatcatgacacgtggcccccagcctgtcccccactggagcctgccaagtactttgggctggggcaggcttagtgcattgtgggccaggatcccaggcctgggagtgagagggtggtgggaacagcagggcggggaccccagtttattttccttgctgcctttgcctgtggggctcacacaccagtctgctggagctactccagaaccaagtggcagctgatggctggtggtgggcttcctatcgcacaggtcctgctgaagagccctgtttttctggggctgactgatggtgcaagggtccatcccaccaggtgggaaggaaaagatggatggggcttctccaggttgtacctgctgctgtttcttgctaccttccctcaaaatgtttgcgggacgcagcaggatttcacatgctctatccccgggaaggccactgagagtcagaatggcatgaggaggaaaaaggagatcaaatattttgagggaaattggggggaggtggagagaaggtggtcatgcctggggcatgggggtggcccctggctctctgtatggcagagcatcaggtgcagtggccggtgctctgtatctgtcagccaggcaagcttcccagcttgcctcttttccaggaaaatgaagacagtaaggtgcatggtcttgcccatactttcccaaagaagagacagctagattaaaaacactaggccccccacttctggatcagaactcaagataggataatgcccacctcggaggactcttgccaagaaggaacaaatccatgtaccagcaggagctgctagagggagcccagccttgtacacagtggaggccccaggtgctaagaaggcctcacaaggccgctgttggtgcgcagaggctctcttaaaagtttgtgtgcaggtgctctcagagacatggccctgctgagagattgtgtttccaagtgtcagttggggttgaatccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgactgtgtttccatctccctccttacacacacacgtacatcctcatggcacattttcagccctggggtatctcaaaagcaacagctcaagcaatcctgccaaggtctctcaaagtgatccttttttttttttttttttggaagacagaatctcgctctgttgcccaggctgggagtgcagcggcacgatcttggctcactgcaacctccacctcctgggttcaagcaattctgccgcctcagcctcccgagtagctgggactacaggcgcctgccaccaagcctggctaattttttgtatttttagtagagatggggtttcaccatgttgcccagggtggtctcaaacacctcagctcaggcaatcggcctgccttggcctcccaaagtactgggattacaggcataagccactgcacccagcccaaagcaatccttttaaagaactttaggaaggaggtagagatgtgtgatgaaaggtgagctgcctcttctgaagtctgagggtgggagtggggaaaggggtactggcccccatgtaggttgtgctcttctgccagcctagggaagacccagggaagaggtctgagaggctggccacctgatgccaccctaaaggctcaacacctcttttcctccaccccagcggggtgcactctggccctcacctgtctagcatatccatttggactgtcactggctgggctccagcatcaataccatgtttttgtttgttttgttttgttttggatatgttttgttttgttttggaaactgggcctcagtttcctcatcttaaaataaggagattgggttagagatatagatggcttctaaggtctcctgaacccaaggctttctgattctttcattgctttttaatgcctgctctagggaggaaggagcacatctcccccttggtcgtgacttgtcacagttccagacttatagctgttgggttctaataccccccagctctcaggggaccaataaaaaccacatccagtcagcctgggcctgccccagcacatggagacaactggtctcaaagcagcccttcccagtccccctccccacacggcctcctacccacttccgactctttttgtttgtttgtttgttttttggagacggagttttgctcttgtagcccaggctggagtgcaatggtgcaatcccagctcactgcaacctccactccccgggttcaagtgattctcctgcctcagctgggattacaggtgcccgccaccacacccagctaaattttgtatttttagtagagacgggctttcaccatgttggccaggctggtctcgaactccagacctcaggtgatccacccgcctcagcctcccaaagtgttgggattacaggcgtgagccaccgcacccggcccactcctgacttttaaaaagagacaggaagcaaaaacaaaaccaagcacccaaggtaggtcagatgaagagccagggttagataacaagagcaacatcctttgagactaaaggtttggttgactcccttggagggccctgtgtggaagcggaggagggcgggatggccatacctgcagcactgcatcaccagcgtctggcgttgccagcggttttgtcttatttctgctggctgtgcagagtgactgccagaattgtctcttgcaggctggaggagattgatggattctttgcgagaaataacgaagagtacctggctctgatctttgaaaagggaggctcctacctgggtagagaggtgagctgccctgaagttccctgcaattcttggatagccatggagagagagccccagtttgggagcagggcttttcctgccaattctagggtcttggctgcctgggtcttttagcctggcattggcctgacccctgctgggagccatgggaagtgcaggagctggacctttgcgtttcaaaaccttgctgtttattcttatctccttcacggaaatcaaatataacacctgctgttattgagcattggaccagattgctgacacacgtagctgctaatccccaaaattaatgaaggtgatcaaatagcatgcccaagatcacacagctagtaagttggtagaagagggctttgaaccaggtccgtctggctccaaagccaatgttgtttccacagtgtcccactccatgggactggagtgaaatatttgggagggagggaacattagcgacgccctagccccaccggaggaaatggggtcctttacccagatgccggtctgtctcatgtggggcatccgtgagccagctccccagcgcttccagctgcagtgccctgtctagaaagcagggatgattacgtttctccgtagtattgttgggaaggtcaaatgcagcagtttatgtaaagggcctggattgcagctgacacatagtaggtgctttataaggatccattcccctcgcctaatgcagagagctcaccattctgccattggttcatggacttctccatagaccagttgtgagcttttcccagctgcaaaggtgggacgtgccagtgcacgggagatactccaagtcagtgcagggagacaggcatgagagtaggcatgaaattaaactgcactgtcagcctgagtgattttcctgctgaaactcaacaagcacagctgagagtctgagctgaagccagatgctgtctccaggcctctcagccctgagagaggaggcacaggggttggggaggggaaagacagcttggcttaaggagtgcctgaccctctggggtcccagttcatgcctggggtcatgcctgttatgtagaggtgataaatggtgattggaatcaggtcttttccctcccctcccaccacagtccttgagtaccaaggggctggggtcccagtggttggagccaagtgccccatgcccatgcagtggtgcttagcgtgggaccagtggctaagggcccaggttctggagccacactaagctgggatttgtagcacagttcaggcatatgcaagctgtgtgatctggaggcatgatttcacttctaagcctcagtttctccagctacaagataggagctttatatttatttatttattttgatttttgtgagacggagtttcactcttgttgcccaggctggagtgcaatggcactgtcttggctcgctgcaacctccacctcccaggttcaagcatttctccttcctcagcctcccaattagctgggattacaggcatgcaccaccatgcctggctaattttgtattttcagtagagacgtggtttcaccattttggtcaggctggtctcaaactcctgacctcaggagatccgcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggtaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaataatgatgactgatgtatatttttctgattcggagtctagataggaagctttataaatataagaaaaaaggctagggggcgccacctgctccatggtgaagagtgagacgtcagtaacagaagtccgtgcctgccatttgcagatggcctgtccgattatgctcagaacttctcttcccatttctaatgtggggacattgtcatctcaacaaggcctcttgttgccttcagagagccccacgttaagaaacgttttcagatcttcttataactatacacattgaccaaagggcccctctgactactgcacatactgggctcagagttagcctgctgtttagaagtttacccaattccaaaggtttattttgtttgtatcctacccatgaaatttgttaccatatgtatttgaacgcaataaaatcacagttctttaaacatctgtgactcaagcttccataaggaagactgctcttgcccccaacaattgatatttcaaacaaacaataattagtaatttctaaagggatcttttccctttagaaaaatgttatgagaaggccctggggaatcctggacatcagagagcagtcttggggtgtgaaggtcttaaagacaagaacgtgctggctcagtgcaaaaaacaaacgagaattaaaatgaaaccacattttattgtgctctttacaaattgctttcattagaaagaaaatgctacccagttgggactgtcgtaagaaattaaagcgtgtgtggcatgcacagctccaaggcctctcctcctgggcagtgattggcacttgctacctactggttagctgctgttgatggcgagtatctcttgcgcatcagtgtggtccactctttgtgggtttagagtctggaaggagcacagctgccatctgggtgccttcacaggtcaccgagctgggacccagccctggctccctccacccggtggcctggcccccagatgttctgctgtccctgcaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagacctcaaaggcctcagccccccgcacccagtgtcgcctgcaccctcattacgtccccaccacagccctggccctcttctccaccctcttctgttcgcaggcagactcattggcaggctacaggcctggcaagcactcgtatatgcctgaccctccctccctttggttttctaattgcagaaaagttcattagcagccagacaatagccagttccaaaatgccgagagaaaacaatcaggccagcctcagcccctctgccaggctcctgctgctgaatggcccgttaatggcaccagatggtgccttggtgccctccctgggcagatgattgatgtcagccaggccccgcaggcaggagcattgggccagggaggcaaggcttgcctgtggtgcctggtgagctgctcctcggggccctcagtgccgacccacacggcgccgggcagggtggccacttggcctcaccctggcccagatcacctgctagagggcccaggaggtgcgatgccaccaaggacagggaggcactcgctttccgggcaggcccagaaagtgccagtgatggtggggagagaaggcattgtctcctctctccgagttggtggaggggaaaattgtttgtgacgatgctgcctcccgagccatctgctcaccgagaaacccaggatggtggagtggaatgaagccgtgcgtcccatgccagctcccccggggcagccctcacgctgctgctggacccggcgtctctctctgcaggtgccctggctgtgggtgagagggaatatgcactcaggaggtatcccgtgccctggaggactcctccctgtcggaaaaaagaaagaaaccaaaaagaccgtaaaaagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggggtccttggggaagggagtcacactccgccgttcctgtctgtgggcaccgggctgtcccgtgcctttccatgccctgcctggagccagagggccactgggggaattcttgggcccaattgccttaccaggtgaggtttgacatcaggctggtgtcagagaggctttccagagcatgtgcagtgattagaagggttacagcgaggcctgggtgccgtcttctggcctcacagaggacaagatggaatctcgttcacatatttaataaaccttcctgtccgatgagccacccttcttcctcttctgacattggttagctctaatcttgttctctgcacttactgcctctcctccctggttctgtgccctcacaggctcatggaatccaggtccttctataccgcttacctgcagagactctctgggctcaccagggaggctgcccagaccacagttgcaccaaccactgctaacaagatagctcccactgtttggaaattggcagatcggtaaggctacgcctggttctcctcacttcttctccttcctctgatcacagaccaccacaccttcacacccacgccctcttgctcattcttcttccttgtcatatgattagtgtgtacattctgagccaggctgtcccccaccctggggtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactcactatgtgctaggcactgtggcagcagatatgtacaggcagatgcattctctgcttgtgcagaccctacagcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattatgaatgatcatcataatcattcgatcattacagttatgcaaaccattgacgttcttgtaatagcttgggctggtgtatgtgccaggctctgtgctgggcaccttccctgtgttacctcattcagtcatggggccacttctggaggcagggcacaggaatggagaggtaaactgaggcccaaggacagcaaagtggaacacagaggagaccttgccctgaggaggagcataggcagccacaatgcgtaccccattagttgaccttattggctctttccaacctcaggaggttgtcatggaggggtcaggagcaagtcatgtgttttacaggtgagctgactgaggcccaggaaagtcaactgagttgcccaagctcacaaactagctcacagtcaaactgaggtcagaacccaggtctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagacttggtgggcagctaaaccctggtctttcagagagggcccagtttttccagagccatgtcgtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaatttacccaaggtcacacagcacatttctggcagaagccagtggtaacttacaagactctgtgaccatcagcagtgccccttctcttctctccctttagccctggatgctccttgcagcccctgcaccatggttaatacttctttctctctctatctccctctgggtcctcagctccaagatctacatggctgacctggaatctgcactgcactacatcctgcggatagaagtgggcaggttcccggtcctggaagggcagcgcctggtggccctgaaaaagtttgtggcagtgctggccaaggtgagcagggccatggcttcccttgtctgtgcaattctacggatggtcagtgtgcgttcctgtaaggctgggcaccccgtcagcccctccctccagaagcccatggtctggctggacacctggacccacagctctccctgtccaccataggtgataccctccagcctcagccataccccacaccagccccacactgccagggacaaccctgccccatgcagcagtgtgggtgggacacagggcccgtgccccccacctggggatatttccagctgattcagtgactgtggctctgcctgcctgagtcctcagtcagagccccagtgtggcttcccacccctttctgtggtcactgggaaagcaggacccctaggacaccctggcgaaggagaggatgctcttctgatactccttgcttccctcccagtctgacccgatccctggccctggccatgccttccttattcctttatagtttccccgggaaggtggctactccacgaagggtagctcctatttattgaggacttgatgtttgtctaggatttaatccttttaactactctgcgaggtgggtggtttattttgtcctccccgatttaagaggcccagggagctcaagtgccatgccttcgttctgccagcctgaaagtgttgtggtcaggccttgagcctgtgctccttcctctctgaaggtgagaggtggctgccattccctctctgcgcccttccctttggttccagatcctggccattgcgtccctgctggaaaccctggactctgctgctcagtactgctgagtcagatgtggctctgggcgcttcgggtttggccgctggctcagcctcccttggccctggggcccggatctgagcccaccctcctcagtgtgggtctgcaggaagctggggctgccctcgggtgatttgtgcctctccttgggaacttcctgccagcctgatccctccttcccacctccctgtcctggccccctggcttggtcacatgaatgcgtggtgacactgagagggcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaactgacccacgtacagtccctcctcctgacccatgagggagagcacccagcatgctttcccggcatgcctcagacaccccaccaccctagtccagtactctccaaaggagtcaccccaggaagatcggcttgtgtgtcactcgcatctctcagctgtgatcaaacctgctattttctttgtccccagtggggctgtttgcagccggtatgggggaaaagaatgagatacagaaaagtccctgagctgggcagaggcatcaccccctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggggcatgggcctggagaccctctgtttgggttttgcccgcacatcccctggggtctgtagagtattctggcccttgccttgcttgggtagcttcttcctgaatagtagtatcctagcagctatcatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacccctaagggtgccagtggacactgctggctccccctggctagctgccagccctgcaggtgcccggtcagtcaggaggccctctgcatgtcctgccggtgccttcccacccggcctctcccagcctgtgctccctcctgtgagcagctggtaggagtggccactgggtggcgtgtgggcaccagggtttccttgctcccagttgtccagagctccttaattcatccatccttctggcactgtcgccttagaaggcggaagtttctaagtcaggatgatggcaaaggtcagtgagaaatgctgacttcaagctgtaaatttgtgtgtgagttccagaggcccgtgtgggctcaccaggagggcacgtgtcaaagcgtggtcttttccggccatttctcactctgggggaaggtgtccagcccaacgtttgataggaatatttaatggctttctcagaggaatggatctgttagcaggttttcctgttcagttaccattcgtgtctccagtatccttctcctctcaaatgtttgtctttgctttctttgctgtgattttctcagggtcctcatcccctcggccagcctctttgtggttttatctgatcagcctgctgctgtgtccctctttctcctgccctccgccccttgtgctgtgcacgtgcacacacgcacacacacacacatacacacatatgtcctcctccctggagtccttgtggttttaaagtgctgatactaatcggatttgagttgacttattgtcagagtagcttttcatgctcctcagataccactgggagttaccatcaagatctggatcttggctgtgagcccctggcctggctggtcctcactggcagcccatggaatccaaatgaaaggtctcgtgcccacctaacccagctggccagtcagttggcaagtcagctctatccgaggaccacccaaagacaggactgtgtggcccagggctcccagcagccctggcaaggggcacaagtgctccagccttcctcccagtggtggcacatggtcggggggtgctgcacaggagcctgaggtctgagagagggagacttccaggaccccaccccatttagagcgagcaccttccctaccctgtcttctagccttaccaggtgtcccagagcaaaggtagtacagaagtcatatttgtgtcttagttagaatgttttcctggtggttttggaactttgcacaacctcctccccactgccccccgccccccgccccccgccttcttctgcatagcttcctaccatctgcaggacggggaacttggggaattgcttttcactctccagcttccgcttgttcctccccacagtatttccctggccggcccttagtccagaacttcctgcactccgtgaatgaatggctcaagaggcagaagagaaataaaattccctacagtttctttaaaactgccctggacgacaggaaagaggtgagtctgggaagcaaataaagatctctccatcctccgtatttatgagagtgcaaggggttaaccctgtcatttctgaccttcttcgccagtttgcaccagggagtcagtgatcttcgttgggtcctaacaataatcaataaatgactattgattgagctctctatgcgcacatctcatttaatcctcataatgttagtggaaggtagatattctccccatttagcagatgaagaaacagtactttgaaaaggttaagcaacttgtctgggttcatggagccagtaagtgtttgggctgggatgaaaacttggtgagaccccagagtttttaacaactaccctgtgctgcctcttagtttgtggtgctgctcagcatggcctccctggccctctccagggcaccttctgggctcctgctcatgctgctatttgcaaaagtgggtcactgcagccagcagaggtgtaaaaccctgtagacttgtagggtgtcaaatctcgaagggacctcagagataacccccttgtgttacagctggggaagttgaggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttacatagctgatacatagcaggtgctttgagcaattttattgcacttcccactgaaaaacaatttcctgggggaagttggggaaacacgtttcccctgctgcctcggattgtccacaaactgcaccaccatgttctccggccacgctgccccacacctgcttttgaagactgaaaggatgcgcatccaattcagtccacactgattgaggaaccaggtttataccaggctgcggcttggcttggaggatagatacatgggtgaaaagggcgacagtgcccgctcttggtggacctctagtgtgaggcagggggacagagaggcctgcagtgcatcagggctagggccgtggtggagagaaagatgtggggtgaagagagggcaggctcgacgccattgggaaggggcccgaggccttacggggtgagttgaggggtgatgggtgagtagggattccgccaggagaggagcatcccagcagagggagcagcctgtgtggagccccgtgaatcagaggaactgccaggcagtggtgtgggaagccagtgtgtatggagcatctccaccatgccatgtggcgctgcaggtgccggggacacagcagcatatgagacaggtccctgcccccacagggccagtatctgagtggcaggagacagacacagagggatggcttcagccatgatgacgaatgctgaggaagacaaagcaaagcagtgccggagcgggtgctgtctggagaggggtctgggaaaggcttccctgtggagggcccggtgctgggacccatgtggagaggagaaggcagtgtgggacgtctgggaagagagtctcccaggctgtgttggtgtccttgggctgcactcacaaatgtcaggctggggctcagccagtagacgtctgttgtctgagttctggaggctgaagtgcaaggtggaggtgtctgtgctggtttcttcgagcctctccttggctgggcggtggtcgtcttctccttgtgtctccgtgcagttgtccctctcccaatccatgtccaaatttcctcttcctgcaaggacaccagtcctattggattagggcccaccctaatgaccttattttaccttcattacctctttaaagaccctgtctccaaatacggccacattctgagaggctggggattagggcttcaacataggaatttggggggacataattcagcccatagcacaggctggagaccagcaggtgcaaaggacaagcctggtgtgtgggcagcactgaaagaaggctgctgtggccggagggagggaggtgaggctgcagagacaggccgggggcggaggtgagcgctcatgggctcagaggccttggcgagggcagggtttggaggttggtgttggcattttgagaagccactggagaggctaacggaagtgacagttggttaacactttagaaaggtggaggatgggctactgcaggcagggggaggcagggcagctgaggagcaagctgcatgctcgcccagcagtggtggttgggcctggactagggttgtcagtgtgcccctggaggaagtggtcagatttggggatatgttaaaggcagagctgagggacttactgatagattggaggaagggtatgtgggaagcaggactcgggtggactccagggttgtggggcctgagcctctggtggatgatggtcccataagctgaggagtcaggggctcgggttgggatggtggaatcaatggcccgctttgtgtcaatagacctcccaatggaggtgtgcacagttgagtctggagttccagggagaggtggggaatagagagattagctttatagtcattagtagcatcagagctcaagctgtgggactggatgagctccctggcagggaggtagagaagagtgctgaggactgaatcctgagcatcaaaccaccagcaaaggaggctgaacgggggaggccatggtgatttcaagggggccccagagtccagtgtttcaagatagaggtgtagtcactggggccagtgcagctggaggtggcgcaagatgaggacatctctagcaagggctgtgtcggtggagtagtggaggtaatggccttgttggattcggctgaagagagaccaggaggcaagattctggagataatgagcaggaactggggcatgactgggttagagggaacttctttatgatcatccttttccccagttggaatgatcccttatcaggggataaatggatgacgcagtaaagaaaaaacactaacgggagtgaaatcctggaggtgaggagtggggtaacccgagcagcagcggagacagaggctgagcaacgccagggccgtgtggtgaggccttgtggtggggaggtgggcacctgtgctgggtgcagaagaacaagctgagaaggcagaggagagagagagaggcaggtgtgggctgctgcgggtctcaccttgccaggagtgaggagagtagggtgccaacgtcctgctgcgtggaggggtaaaagcaggagattggcttctaaaggcctgggaggtttgcggtaggaaggagcgagcttggaggcaagcaccagcagccctggagcctgagggtgaagggcttaggaggggcgtgttggattaggagtggtgtcctcagcggggagcctggtttcagttagagcaagaaagtggggctggttaacaggtctttgctgatgccagtccagagggtccagtgggtgggagggggtggggggaatggaaggggagagcgaggagagatggagacagattaggaagggcatgtgcaggccaggtccaggcccgagggaggtgacgcatggtggaagcaagtcggacaggcagcatgagtgggcaggggaggaagggccaggggctagggcggtggccctctggcccctgctgacctctctcaccatgtcacaaagagcctgagtttcctgccaaggagtgtggactttgtcctgggtgtgagtgacaggcacccaggttagtggcagggaaggggatccaggtttaggagttttggggggatggggtctcctgtaaagtgaccatggcaggtagagaagtagacaaggggacactgggcctctgctggcataggctggggtgtgtggcacctgtgcaggggtggccacggcaggatggggggcggcagggtggcctggggaggcaacggctgtggggctggcagcctgaagggctggtgcgtggcatctcctctgccctgtagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtaaggaaggaccatccccaaggctggagtcacttgtgggggacgagggggtgaggatacttgggagtcttaggccaaaatttggggaagggacactcattgtcccctcagtcacagcccaggcctgttaaccaatgccagtatcatcagccccatttttgacatgaggaagccaaggctttgacactgtaagaccctggtcttcccatgccgttgctcactttttccctgctctagggcccctctctagcctactggggtccctctcccgcctcccctgctccgtcttctggctgttggccccttactcaaactgctagggcagagggagctggggttctctctccctgggaagggtctgatgagagaaggggctggaggagaccaggtcgttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccgggggggggagaccagggcggagccgaggttaaaggagctgaatggagcaggtggtggtgcaggcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaactcaaaattaccaggcacaagctgagagccccctccacaaggcctgatcactatgactcatgactggacccttgactctgcttgttgtcccctccccaaagtaaccattctgacttgcatgccacttgctgttgctgctcctgcttccttgtagtcaacaacttgtccccctattaaaacctttaggagaagtgcttctacagaagggatgggctgatgcattccctgggcaacactgcgtgaggggctggtggccgtggctcaccctctgggactcatccagaggctgcctagagggctgggcccacctggggtaccaacagcctgcagccccagcagcatcctgactcttccaagtacccctcaggtctccccccaactatcccttggagcccacccctaccccagagggctgctgctgggtaaaagcaaggattgccatgagcagctgcctcttgcttgaaaacgcattttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcaggacagtgggtctggccaacaccgggaaatgactgagatggcgctcttcacgcttccctggaaaaccacggagggccggggctgaggggtaggtggatctgcctcctcctccatgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctctgtaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 35886 - DNA, 18130 bp, Homo sapiens
gcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggtgaggcggccaggccggtgctgggagggccgggcctcgcaccgcggctgccgcgggctttgtcccgggacaaaggggggcggccgggcgaggcctggcaggggcggcctgacaatgggggccgggcggcgcggcactcgctctctgggggtcctggggcctggaaagcctgaggagatagcacggcccaagagctggatcccttctacccctcagatcatggagggtgtgtagggggtaggggccttgaagtgcaggtgcgggtcaccccgaaaccctttggcaagggggtcttctagtagccctgtttttctccaccattttgccccactgatagtaatgcttggccctcctgtgtgtcgcttccccctaaaggaagatgtggatgaatatgttaaactcggccacgaagagcagcaaaaaagactgcaggcgatcataaagaaaatcgacttggactcagatggctttctcactgaaagtaaggactgccctacacgactaacaatggagacaaacacaaatatgttaagcagcggtgtctgctgaatgtatagattgctagtgtcccaagttggaagtcctgtgagaaggagaaaaggacatggagaataggctttatacttacaaatctttagacactgagaaccaagtaaaactcggtgctttctccagttatatataaacatcattgaccctgtactctatgtggaagtcacaccttgagacaccctctttctcacgtgacttttgttagtgtcaacaatatgatttattttagagaaatatgccccaaaactttaaggcagtaaatgatttatcgctcttttgatatatgcttcatttaaattttaggaatttgcttctttttttaagcaagtagaaaaagacctgttgcctgtgaattacgtttattataacattataccaaaatgttagagctggtaggggccttgggatcatcttgtccacatcactttgtagagatgaagaaatgaagcacagggataagtgccttctacaaataagtggcaaagctggactagaatccaggtatcctgctcttaattcaggttttaatatccttcagttaaaaaaaaaaatctgatgctctcaggtaaattctctagtcagaaatgaaatgcacagactattaaaagaatgttctaaataaattgctgtgcagttgtctctccccattgttcaattcaaatgatgttccctgtcagcgttccaagtgggtcctcagaaaaattcaggttgttattgtgactcttaagttagctgtttttctgtaactctcatttaaatgctgttcaccatcaaggaattaagttgctggagacaattaaaaactggtaaatttaagatgtgctgtcaatgacatattcacattggaaccctctggaagattaagggcttttttcttccacttagttagacaataataacaagacctttggtctctgattatccaatctaagaataagtcaatctttggttatactagagtaatcaaagaacacaacacgttgatttggaagactgcgtggtacctatctgtcaagacctagatatgttcaaatatttaatagtaaggttttaagaagtttaaacttagaaaagttttagtccaaatattcattatacagatgagaagaaaagcttgagatggtaaactaccccctgatggcaaagctgaagtgtgaacccacatttctgatccctgttccattctgttttcttctatgccatggtgatctctttaaataaactagaagaaagattcatggtgcttacgaaagccttcattctacttgaggacccttaagataattttggcaatttgctctttgagggccaggtctggaatcagatgttaagaggtagcaaaactcagtaggagttggctttgaagccagacaggtttgaatctggactctgctatttactagttgtgaaggcttggacttttctgaacctcagtttcctcacctgtataatagtgatgattataattgcattgttttgaagattagaggcaacatgtacagaggaacctgataaatggtatactcatgctgtcctcacaaatattcgtgttcgtccctccctttgtttcctttaacgtagtttagtaaatatttttatgaatagttttttgtttttttttttgaggcagagtctcgctcttgtcacccatgttggcgtgcagtagtgtgatcttggctcactacagcctctgccacccaggttcaagtgattcttctgtctcagcctcccaagtagctgggattacaggcactggccaccatgcccggctaatttttgtatttttagtagagacggggttttacccgagaccaggctggtctcgaaatcctgaccttaggtgatccgcctgcctcagcctcccaaagtgctgggattacaggcgtgagccactgagcccagccaaatagattttttaaaagttgattgaaaagtgaacatttgaattttagaaactttcccatgccttcaggtaccaagttaagacagatagctgttgcaggaagggcataaattgctacccataacttcgttaaaatttactccagatgttttaacaacatatttaaaggtaatatactgaagcagtattctcagtcacttgaataccttttcagaatttaggccatatctacttaaccatctattattttcttactatagttttaattcaactcacataaaatttattttaaaggaagactttatgtcaccttcataaataaaaaacactgttttttctcatacatactaaaataaatagctatcaaaatatttatgcttcctgagagatctgtggtagttagcaaaggttttctgcaagattttggataacattttttttaaaagtaaagtgctattttggccagttggtaattcattcaacaaatacttacagagccaggaactttccaggcatttgatgtacatcagtgaacagaacatacccaaacttttatggagcttacattatatttagatcatatgttatagtatggaagctccggccaggcatggtggctcacgcctgtaatcccagcagtttgggaggccgaggcaggtggatcacgaggtcaggagttagagaccagcctggccaacatggtgaaaccccgtctctactaaaaatacaaaaaattagccgggtgtggtggcacatgcctgtagttccaactactcaggaggctgaggcaggagaatcgtttgaaccgggaggcagaggttgcagtgagctgagatcgcaccactgcacactccagcatgggtgaaagagcgagactccatctcaaaaaaaaataattaaaagcttcatgagctcttctaaacagcctttcccacttcctaccccatttctattaatacaactaggccaattctcagtatttgcaaacatcaaagattttgccttttcagagaaggtttggaaatccttactcttaagtatcagaattaacgtcacatgcgttgtgttctgggaaattctcataggtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggtgagttcatgtgcacaagctgtttcttttgatcatgtcagttcactttaccttcctgcatgaatgagcacattgagggcctgaggtcataagctggattgtcttgttctctaggaaatcacctgttccacttcagcagtcattttgatggtttcctttctggccagatttaggactcttattctaaattacctacatgatccttctatctgtttttctcggctgcatcatttaattgtcctcatttccagagttgctttttaaatgtgttttgaatgagtatctcaatattttaatatcattgaataatcagttttatctttattaagaaggccattatggcccattcccatttttaaacacatagttttatatactcacttaaaaaaactgcggtttccacatctgtggattcaaacaactgagaatcgtaagtatccaaaaaagtaagtattaaaaaaaaaaaaactgtgtctctattcaacatatacagaacttttttctcttgattattccttaatatagtataacaatgatttatttctcatttaagttgtaatttatattataagtaatctagagatgatttaaagcagaggtccccaacctttttggcaccagggaccagtttcatggaagacaatttttccacgggacagtgtgtggcgggggggtggggaatggttttaggatgaaattgttccacctcagatcagcaggcattaggttctcctaaggagtgcgcaacgaagatccctcacatgtacagttcacagtagggtttgcactcctatgaaaatctaatgccacccctgatctgataggaggcagagcagagctcagacggtaatgcctgccactcacctcttgctatgtggcccagttcctaacaggccatgaaccaatacccgtccgcgacctagggattgagggtccgtgatttaaagtattcaggaagatgtgtgtaggctatgtgcaaatactgcaccattttatatcagggacttaagcattctcagattttgatagggaggtcttggaaccaatttcccaggaatgtgtgagggaggactgtgtaacaaattgaccattgtaaccattttaaagtgtacagttgagtaatattaagtacattcatggtgttgtgcaaccaatctccccgactcttttcatcttacagagtggagactctctacccattaaacaataactccccattccctcctcccactagctcctggcaaccactgttctactttctgtctctgaatttggctactctaggtacctcatctaagtagaatcatacgccgtatttgtctttgtaactggcttatttttacttagaatcctcaagattcttccattttgtagcatgcatcagaatttccttcctttttaaggcaaagtaatattctgttgtatgtacaggttgagtatccctaattccaaaatcaaaatgctcttaaatatgaaacttttggagcactgacacgacactcaaaagaaatgctcattgaagcatcttggatttgggatttgcaaatctctgtgggatcctgctttccattggtttgggtatatacctggaagtgatactgctagatcatacggtaattctatttttaattttttgagaaaccacagtaccatttttcatagtgagtacaccctttaaaattactccttttttttttttatttttattttttgagacagtatctcactctgttgcccaggctgaagtgcagtggtataatctcggctcactgcctcctgggctcaagcagtcctcccagcacagcccccgaagtagctgggatttcaggctcaagccaccacgcccatctaatttttgtattttttgtagagatggggttttaccatcttgcccaggctagtctcaaactcctgaggtcaagtgatctacccacctcagcctcccaaagtgctaggattacaggtgtaagccacgacacctggccccaaattactcattttttgaaaatttagtatctgtgtgagttctaatgtgtctcatggtttaatttgttgaaatatatgcttcttaagcagagctgagaaagactaattttatttaggaattaggaactttttaacacttctaggaagtctattaaactaaaagtatatcaacagaaatgactgtgagcttgagaaattgatatatcaaatacttttgtatttcaaagctaattttaaagaattaaaatcttttttataggtacatgatagttgtattatacatacttacagagtacatgtgatattttgatatcacacaaacgtatattataatgatcaaatcagggtaattagaggatcaccaagaatttttttaagatagtttttatgtgtagaaaaacataaaaataaaatcaaacatgctgttgcaaactgtcccaaaatattagtcaagggtgcttggaaaatattcaaggctcttctgtttcttaacttatcctgttttggtatataccttttaatttttgttgtggccataatttattgtattaaacaatatagtgtaacaatgatttactcctcatttaaattgtaatttgtcttataagtaatctagaaatgatttaaaatatttgggaagatatgtgtaggttatatgcaaatgctatgccactttatatcagggaattgagtatccttgggttttggtatctgtgggaggttctggaaccaatttctcacaaatatggagggaggagtgcataacaaatttactattgtaaccattttaaagtgtaccattcagtagtgttaagtacattcacagtgttgtgcagctaatccccagaactcttttcatcttggaaagctgaaactctgtacctgttaaacaacaccccattccctccttggtaaatgctttctaagtgtgctatttatttagaatcatattggccgcttgaactctgtaagccaccactaactctaagttggttaattctctgctaataactacagcatcaatgtggaggtttggggctccatcctcagagccagtctgcttagcttcacatttagctccagcacttcacggttgtgtaactttgggcaagttattaaactttcatgtgcctcagtttcctcatctccaaaaatgaggataataattcccattcaggccaggtgtggtggctcacacctgtaatctcagcactttgggaagccaaggtgggagaatcacttgagcccagagttcgagaacaactgggcaatgtggcaagaccccgtccctatggatacattttcctcttaaaaattaaatcctaactaatctaaagctgtctagttaacaaatgcccaaacaaaatttaaaaattagatgggcatgatggtccgtcctgtgatcccagctatttgggaggctgaggcaggaagattgctcgagcccaggcagtcaaggctgcggtgagccatatttatgccactacactgcagcctgggcaacagagagacctcatttctaaaaataaataaataaataaataaataaataaataaataaataaataaaaatttcctctttaggattataatagtgtggataaatattaataaatggtagcagttggaggggcaagcagttctgttttgatttaaaagaatattgaagaaagcatttacagttcacataaatttatatttaatcaactttttaaaactttatgcatttgttaactatcagctttagattagttaggattttattttttaaggggaaaatgtatcttttgttttctttttatttgggtcttcattctacagtggactaaagtgagtaaaaatcagtctttttactgcttgtaaatactaaaggaaaaacaagtagtgataatgagatttgggatcatctgtctattaagtatccccatttactataggaattaacttatcttaaaccaatgtaacttatctaaaaccaaagcatggtgtggtgtggtttcccttcctaggaacaacagagaagttaaatacagtattttaaaatcttgctggaattagattctaattatgttttctatttttattttttgttactcaaaagacttaattactatcccattaaaaaataagaagtgcatgttcctgtattcttagaagggggtgatgtaatagatggtgctgagaagaaaatcttcactttgaagagatacatgactcataaattgtttatgaacagttcttttaaaaggtgtctggttctaattctgtgttctccaccagctacttagaatgtgttgattataacactctgcttttaaaggatgaattagatgaatcttaacagcctaaaggaatagattgatcccgaaaatgaacacttcaatgggagtccttttggttatttttttttttgacagcctaggaatatgtctctatcttcatgaagttctaatcatatgtttttagaatttgctataagtaacttcctgtgtgtatgtgtagtcccagctgctcaggaggctgaagtaggaggattgcttgagcccaggaatttgaggccagtctggacaacatagtgaaaccttgtccctttaaaaaaaaaaaataacgtcctaaaaattgatgtggagtgtaaagatgaacccagaaaccatatgcattatttttctaaataaaaaataacggatgaggaatgaatcaatctcaaagttatagactaaacactataccataaataaaataatcataaaaagtaattggatatgtgaataaaataaagttttctataagaaagtctgttataactgacgaaagtcagcttaatatctgaacttcaccttttttttttttttttttttgagagggagtgtcgctctgtcacccaggctggagtgcagtggtgcaatctcggctcactgcagtcttagcctcccagattcaagcaattctcctgcctcagcctcctgagtagctgggactataggcacgtgccaccatacctggctgatttttgtttttgtttttgttttttttagtagagactgagtttcaccacgttggtcaggctggtctcaaactcctgacctcaagtgatccacctgccttggcctcccaaagtgctgagattacatgcgtgaaccaccatgcccagtctgaattttatcttatatttaataagttttcatatagggaataaagataaccctttcaggctgtgaaatgcctgaagaagcatttctttataatataaagaacagttatggtcaacacaggataattaaagtttggggatctatctggcaaaagttcaagtgttctttgtttttgtttttgtttttgttttgagacggagtcttgctctgtcacccacgctggagtgcagtggggcaatcttggctcactgcaacctcttcctcccaggttcaagcaatcgtcctgcctcagcctcccaagtagctgggactacaggcgtgtgccactatgcccagctaattttttagtagagatggggtttcaccatgttggccaggctggtcacgaactcctgacctcaggtgatctgcccacctcggcctcccaaagtgctgggattacaggcgtgactgctgaatgtgcatgtataagcagtatttatttatgtaagatataaccttgcatgtggctaatcagaatttttaatgcctagtcatttgttctagtatcacacattatatatttcctcatgtagaatcattagtctaccaaaagatggcagttttgttcctcacaagtttctgttgtaatctaaaaataaatgattatggtagcttttttattactgtacctaacactttttaccctctactagaatacaaagtttttatatacaagaaaaaaaaagagtgttgaagttttatgaaactgaccatcttttttgttatttttttaggaatttgccatttgtaaaaaacagtctttctgtttttggcttcttcgatttaatgtgagctattcttattttgtgttcttcaaatggccgtgaaatgtgaaccagaaaaagctacccccttcactttttttttttttaaagaaatctcagcttgttgaaagagatcctttctttccataggcaaatttggccaaatttagctcttctcctgaaacatggacctttttgctccaaagtgaagggttctttcataaggaaatcaaagcacttggtattttgaataatggtttattcaaaaagaacttgattgactcagcaaagtacctcaaattcttgtttgtctgcttttaccatgttaaacctgaacataaaatgcaaattatttggtctagttatttaaaattttgaaacattaagttaaaagctatttggaaacaagttattattttttcttttctgtcatgattgggtgaatataactggcttgtagagtctgatgttaataaaacaaattctttggggaaagaggtgagcctctccgctgtaaatcagtaattgtaaaagaactagtgtttaggtaaatgactgctacctgacctctattattctagaagactgaagagggtatttttattcagtagtgaaacacttaaaagcttctaaaatatttgaaattgtgctttaaaaaaatgcacagtttaatacatatcagtttataggaaggaaagctattcccagaaattctcaaaacagaaattatgcaggattagcagtatagcattattggctcccaaggctcttggttacagaattaccattgaaaattttatcaaaagcagccttgtccctgatagctgccgaatcatttttaaaaaggggggtggatgggaagatgggagagaaagtagaaaaggatatgtgtttattaaaccttaacatgggatccatttaaacttttgatgttatttatatctgaatatacagaattaacactataaagagcctgctaagactagacttccaggctgagcacggtgactcatgcctgtagtcccagcattttgggaggctgaggcaggtggatagcctgagctcaggagtttgagaccagcctgggcaacatagtgaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccaccccccaaaaaagaaaagatttccaaatattaggtacatatactaatattatgagattctcaacataagaagactgtttttctgaaacaataatgtatttttgaaaagtcacttagaggaccagaaacattttttaaaagccctaccaagatttaatacatggtataaagttattgatttttgggcattcaaaaaagtattgagattaattattaaagtagacagtatagtactgtagaaagaatagggaggatccaagttcagtagttttgtttgttttttgagtcagggtcttgctatggtgtgaaggctggccttgaacttctgggctcatgcagtcttcccaagttgctggaactacaggcgtgcgccactatgccatgctcagtattttttagctgtatttctgacttttatcaaatcattcaatctgcttttctatcaataatagtatataacactaaatacttaaggtttattaatggtgtggtagggattctcatcccaattgcttattagagatttttatcccagtttgatagatgaggaaaccagagaggttaagcagtttgcgctgacaccacagctagtaagtggcattgctggaattcaggtctgggtctatatgactctagagcttgtgagtctatcctgcccctaatacatgtatttgtgtagcttaccttcaaagggacgatgtgaagataaatgagataacggatgggaatgtactttaaatttcacatagtttgtatttttcaaagtatttaaaatgatgtggtatactaatgagaaattttaattttcaaagcttcacttaaaggacaagaagcgatttgaaaaagctaaccaggattcaggtcccggtttgagtcttgaagaatttattgcttttgagcatcctgaagaagttgattatatgacggtaagaaagaaacatttttaagagaattattgagtgaccaaaactttaaaaaaatatatttaaaatttttgtgggtacatagtaggtatatatgtttatgggatacatgagacttttttttttttttttttttttttttgagacggagtatcgctctgtcgcccaggctggagtgcagtggggcgatctcggcttactgcaagctccgcctcccgtgttcacgccattctcctgcctcagcctctctgagtagctggaactacaggcgcccgccactacacctggctaattttttgtattttcagtagagacggggtttcaccgtggtctcaatctcctgacctcgtgatccgcccgcctcggcttgccaaagtgctgggattataagcgtgagccaccgcgcccggccgagatgttttgatacaggcatgcaatgtgaaataatcagatcatagacaatgaggtatccatcccctcgaacttttatcctttgtgttactaacaatcccgtgaacactcttttagttattttaaaatgtataattagttactactgactatagtcaaccctgttatgctgtcaaataatagatcttattcattcttactgttttttttgtactcattaactgttctcagcgccccctcccccaacacttcccagtctctggtaaccatcttctaccgtctatgtccatgagttcaattgttttgatttttagatcccacaaatgagtgagaacatgggatgtttgtctttctgtgcctgacttatttcacttaatatgatctccagttcatccatgctgttgtgtggatcaacatgttgttgcaggatctctttcttttttatgactgaatagtactccattgtgtatatgtacattttctttatccattcatctgttgatgtacgcttgggttgcttccaaatcttggcttttgtgaacagtgctacaacaaacatgggagtgcagatatttctttgacatagtggtttcctttcttttgggtatatacccagcagtgggattgctggatcatatggtagctctatttttagttttttgaggaacctccaaactgttctccatagtggttgtatgaatttacatttccaagtaaccaaaactttaaaacctgttcattaagttgttaaaatgaattgtataaccagaattttaagagatacacagatttaaaatgatgctcattctccccacttaaaattaggcttggtaaggaggctttcttgtggtgacgaagttgcttattgggagggagaaggtgaaagactgaatttttaaatctctgtactatgtatgaacagcaggcttcctcaggctattttctctcataactgtgttaccttcagtgccttccttatccttttgtagctttcagattttttttggtttttcaatgttagtaatattaggatttctgtttaatttacaacatcacttatgaaagcttttggtctggaaaaacatcatgtttggattcttcatagggttggtaggggtgcagctgctagttaactagtaatgtttttgcaattttaagtataatgagtcctctcatccctttaatatttaaaataagtaccagtttttcaaaacttttgttgaattgtaagtttaactcaacaaacataaattgagtccctattatgacttggccaagcttgaaagcataaaccatcacactgggaaataaagactaatgtaacaaatagctttttaaaaaagagactaaacatttatattgaagtctgttgcatgacatcagcctccagctacgtggcttggttccctggatatttcaaagaaggaagatatatctttttgtttaatgtgtcatggtagaccctgctgccttgcataacaaggctgcagatacatttttctccatagctcagtggtaagacactgtcattaataccacttctcttgccattgtgaagcttctaatttctcattggcacagaatacatgacccagtttaagaacagtgctgggtgtaatttaagtaccaaaattaagttgggaaaagctaattgagcccaagaatgacaggcaaaggatgctagatcttgattctctggagaataaggaacaattgaagactaaagaggggaattaccagtaaaagcaatgaaataatttaggcataatgtgatacggcccagagttctatctggcaattgaatgaaatagatttgagcaacattttgaagaaagcatatgcaggaatgttgacttactaaataagtgttaagggaaggcaagagtcagagatgggccaggcatggtggctcacacctgtaatcccagcactttgggaggccaaggcaggaggacagcttgaggctaggagttcaagaccagcctggacaacatagcagaccttgtctctacaaaaaagttagccaggtgtggtggcatgcacctgtggtcctagctacttgggagactgaggtgagaggatcacttgagtccagtagttggagcctatgatgccactattattgtgccactgctctctagcctgggtgacagaatgagatcctatgttaaaaaaaaaaagaagggggagggctaggcggagtggcttacgcctgtaatcccagcactttgggaggctgaggctggcagatcatccgaggttaggagtttgagatcagccttgccaacatggcaaaacactgtctctactaaaaatataaaagttagctgggtgtggtggcatacgcctgtagtcccagctgctttggaggctgaggcaggagatttgcttgaacccgggaagcagaggttgtagtgtgctgagatcataccattgtactctagcctgggctacagagcaagaccccatctgaaaaaaaaaaggagataggaagatattgaggaaagtactgaaacagctggccattgaacaggtcatctttagggaaaaggattggttgtttgataagaagctttgataagagggaggaacagatttgggggcagtttgggatggatagggctaggtttgctgaaggggaagcaaggagattgaggtataatggcgggctggtacattttagatctggaggcagaacagcagttctaaggtaagggctcttttagggttgttcatggattggagggcaaatgaagttaaagacaaaggtagtataagatgcttttcttgagagggagagatgtgcggaaaatagcatgagagtaacgctgaggttgtttatgagagtgaaagtggagttcttcacaatatcagaagcttaaggatgttgaatttaaagctacatagtacttcaggttttattcttgcttctaaattccagtgtttagaaggattgtcttgaagatatggacaaccaaagtgatttttcctgtataagtaccttactagctgattgcaccactagagctccaaaaattatcatttatttctaaagaagttctgtagtagaattgaatcggatggcagtgggactgaacattttgtaacttttttttttcttttttaatgaacgtggaataggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaacaaaatcctgtgctgttgcaggtggatcttaaaagagatagaaacataaaacactacaaatactggtgtaaacacagtatcagaagcttagtagaaggtgaataagtgtttgaaattaagagtttgcttttatataagcagctgttttttcagaattgttgcttaaagacaccaaacaatgccatttttaaattggtcaccagttttacttattctgattgtcactttaaaattacacatggcattactttgtgaaaacatgtaagaaactttgtatagaaacatgatatacagtaaaacattacccacctcacatctgggaaaactagatatcggaacaaatagcagttaacaaaattactagtttgtgaaaacatccaatgattttaaaactgggttgtttagactcgtgtcacttttgaaaatgactatatatttgttcttatgtcaggacttttcagttaagtagttctgttttattgggctttctttagtaaactttaaattcacttcctttattctagggatataccaaacttcttattggatacatgtgatattcttgtgtatgtatatttgtgtttttttatattaagctgcaaatgaagatccagaatggatacttgttgagaaagacagattcgtgaatgattatgacaaagataacgatggcaggcttgatccccaagagctgttaccttgggtagtacctaataatcagggcattgcacaagaggaggtaagtgttacagaacaactgtttctctccaccccctccccccgaatttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatgaagaaaggagataatgggaaaagcagtagacggacctggttacaacgtgtaacatttttagatacttaaacaataatgagtacttgtacacctggatgattttgacaagtcaaatcacattaaattgtgaacatcttgctgaaaatacttattacacttgacacttttttgttttattttgaaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 35887 - DNA, 7868 bp, Homo sapiens
gcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggaggtgagaccgctcgcagggccggcctgggcgcgggacacgggcccggggagagccctgggccccgggcggcgcggtgccgggcgcgctgggtgaccttgggcctccccatgccgagctctgggcctcagtttccccatttctgagaatgggcgtcagaatgatttcttccggcctccctcggagcactggagcgggggagacgggagggagggcacgtgtggaggagaaagctcaaggtcagatcgcagagagggagggctcagcacctctgggccggcccgggcacgagggaggggctccaggagccttctggggctgagcctagatccggagctccgaggtgggtgtcgggggtcttggggtgagcgtcgtggcccagcgggtgctcacgtggcggcccttgcacaacacggagcgcttcctggctccggccccgcccctgcggtcgggctcacactgggggtgctgggaaatggagcgagaggtggtttccagcagtagtgcgggcccagtaggcctcaggccccggccacctggtggaccccagaatgcccctcctgcgagtcgggacacactcagagacagtgtgcccggcgcctcaacccctgccactgtccttgggggccacactgagcacctcccctaactctgtttttgggtcttttctaaagcaaagtaagaaacagtcaccagggtagctttagagggaaagccctagtggagccttcaggtcggccacacattgacagcaggggtctgtttgtgttgactggcccgtatcccagggagcccttagtatttcttcttcattctcagtttcttctggaaaatagggacacccttcctgcttccatttggttccagggtgggtcttgcagcttcgagggtagaggctggctgggatggggcttcagccttccctccccacaccctcatgcctctccctgggcctcagtttcccaaccccgaatggaggagctggtctggcttctaccttagacacactctcttgtccctgaatttctgatgctttgggcccagctgtgggagcactgccagctgtgtccacagaagtaggccaagatagcattgtcatctcttctgacagattaggaaaccaaggccacctcctccagccttgggttcaggaaacggctcccagaaatgatagagctgcctcccatgggggttggcaataatgggaatggaatgtccacgtgcttcttccttagcctccttggccactgtgggggtgggtgggtgctgagagacacccaccttcacctgcctctccaatgaccatcctcttttgtccttcttctcccccaacagctgaaggcagatgtcgtcccaaagacagctggtaagacagggcctggggccttctgagatgggtctagagggaagggggccaggcagggcaaggtgggtggcgtgatgagaagagtcggggctcagagacccctgacagatgggagctccatgtgtggctcagccattgggtgctctggggcagccctgccatccctctctgggcctcaacgttggctctgccctcctctctcatagtagctgggagcctcagagccagtggaaggcacatgtaaatttcccggagacttccccactcctggtgcccagtgaggcagggtgatgggcacacagcccttgagtccgtgccctgctggccagcacagccatgagcctgtactcttgtcacagtgctcaggtactgaggacagggaaggggagtgacttgtccagttacatagcgagttgggcagagcagacccaagaggtgggccagagtctttatccccctgttcactgctggggatgtagcagggattttggctggaacgggtatgaccctggaattggggcctggccctgttgacctgtgtttctcttcgaccctcagagaacttcagagccctgtgcactggtgagaagggcttcggctacaaaggctccaccttccacagggtgatcccttccttcatgtgccaggtaatgtagtttcctcttctgtaaggggggatgagagcaggagctgccttgtgggtgtgtgaagatgcctggtatgaggaaggtgctgagcagagcagctgcagttgctctgtcagccaggctgccctccctgcattagccctgtatccaggcttcactgcacatggaagcccagccccaacccgctgccactccaggtcagtggcaggccctgcccgggggactgggaggtggagtctatcaagagagagctgggttgggagatggatgtgctgggggtggccttgaagactttgaagagccagcatattccagtggtctctgaccttgtcccctgtgtgcccctgagcactggtgtgggagataagagagggagagagagaagtggaggaggcggaggaggaagacaggtccagggcaggaacacacacgccaggacttggggcttcccttcccagagaaaggcattattctcggtgaaatgaatgtttttcggtcatgtgtcatgctcagttttcacaagcattggtattgctgtgtcagaggtttgggggtaggtgttgtagcaggagcttcctgtgggtcaggacccaggtggtgttggggctggtcttctattagcacagaccttcaagatcagggattgggtgtcctgggcaggcagagcctggaggcaggggcatggctgtcatgacctctttgaagaccttcctgcctggaattctctccccattccctccaccctgacccagtggccgtcatcgtaccgtggtaagtggcagcgggttgggactggacgtctatgtgcggcgaagcctggatacggggtgaacacagggacggcaggcctggcccagccctaaggctgatggtaaagtaggagctgaggtggaagtcctgagccagggtgggaactccagcgcgggagggctccctggcacaaggcggtggcaccgggagtccagaccagagtcctgagtcatccgttgggagggatatcaattagggagcacctaattgacacctgtggatgcttcagctgggctggtcagttcccctctcttacccacggatcccatctcaggaaaacagcagccagccatggcctgggctgggcagcgctaggcataggggctgctaccaggctcttctggccatgggtgccccatgcaggtttggccacggctgcctgggccttagctgaggcctgaggaaagatgtcagccttgggcagactctgtcctgggtctgcaagggttgggaaagctgctgggctgggtaaggggcagtgcgcggacagtgaggggactcggcctggggagctggtctggaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttacggtgacaaaagatatttaagttttgtcttttttttttttgcttattattcttattattagctcttattttattggatgtttattgacccctttacctgaggggcgccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtatctgatgagtctccttcctccctgcgacactgtaggctgtctcagcatttctggcttgttgagtttccctagagttttctcatctctcagtttaaaaagcagggtttcctttgggaactttgtggaagaacctttaagcagaatggaggccctggccacctccctgtttgtcctctgagtttcgggttggaaattctaggacacttagaattgttgcagaatggtccttaggtcctttgaggattatttaaaatcttgcttagataaaaagcaaatggtttggaagccagagtggttattgtggcagcatcgtgtcacctataagacccaaggtagaatgtggagatgtctggaggtcaggtcctggggtcctgccccaggtcccgccccagctctaccactgagagcttccacaaggccctgtcctctcaggccaccccactgagaactagcaggcagcaaaggcaggcataccctggggggctggtatcgggccctggttctcctcttctgggtcccaggatctgcagactcgaatgtccctggtgtggtttgcaccgtctgccctttcaaatgccctcccaggcaggtgcctccaggggcagcgtggctcagccctgctggtttttgcaggtgtcctgtccatggctaatgctggtcctaacaccaacggctcccagttcttcatctgcaccataaagacagactggtgagttccctgccccaggccctctgggaatgcgggcagccttgcagctggaggaggattcgtgcacttttaggggcaggcagtttacagccaggccttctgctctgggacagtggccctctcccaggctgtgtgtttgtatgagaaagagaaagttagtggaaggatcaagggagaattggggttgttcctgcaactctgtcatggttcgggttcccattgttgctgtcacctggaattttctgagtgtgttctgctcacacgcacacacgaaagggtttctctaccagatacatttgggaaatgttgcaaaacatattatgaggcctcaggagggactgagtagaagcccacttgtgtggttttaacctggagtttcccaggcttgtcttgaccatgggctgagccttggcaatgctgcagcagacatttggatatcagcaaatttccaaatgaagcctctgtattatcataaacctgcagatagccacaggcctgtaagggccctgttttcaatgcccatggattttagggatgtctctttcctggtacattttcctctaagggataaatttctctggccagagtcccaaatgtcctagccctggggcacctggggatgaactggctgggagctgacttggtaaagcccatttccgaggattttagggagacctaggtggggcagacactagaagtgtccagcctccaagcccaagagatgtggccggcagggctgggcaggtccttgctggctcagcctgctctttgctccttcatgggaccccagtggatcctgcagttctgctcttggctggaaccacgccagcttcgctggagctggactgagccgccttttacattattggactctctcgggttgagagctgcccaggactcctgcagtttcaccacccttgttcctttgactcttgactcatcattcatgaccgttaacgtggttccatttgtatggacttcttctttcttcagagcatttcagtatcctgttacctccccatgcagaacaaagaatactccacttttgatagatggggttaccaggattcaggctacatggcctgaggcaaggtcacaacatgagtgacagaatgtgtcctggaagccaggcatcctctggggtgtatttggggcgctcaacaaggcttgatcgagctttgggggtagatctagctattccatggggattcttttcagaattgctgttttcggtaactaattccatgaccaggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataat

SEQ ID NO: 35888 - DNA, 7868 bp, Homo sapiens; identical to SEQ ID NO: 35887

SEQ ID NO: 35889 - DNA, 153875 bp, Homo sapiens
gcctgggaggtgcgtcagatccgagctcgccatccagtttcctctccactagtccccccagttggagatctgtaagtagtagttgtcattctgggggcagattgcagggcaggggggtgttaaaagtcctatagggtattctataggggctggggtgcacttaggggtccctgttgtcaacctcgtaagggccatggtgggggcagagttgtgatttggatctctctctgccttatcgtcttagattatcctagactttccccaaacagcatttcttaagattgccagtgagaagtaccattttgggggtgcttattaacgatatcaatgcctggacccaactccatttcccaactctagaatccccagaaaaactgccttaaaaaaaaaaaaattagtcccgagtgattcttgttaagaggctaatccaggagatatgctcccttggaaatctcagaggtccggtgcagacaatcaaggcatctcacttttattctaggcaccaaaaaatttacagctgaacttcactgaaaagtcacttgctatcacacagaagggcaaagtgaggctccttgtggatttgaccgtattgcacagttgtgttgataatgcattaaatcagttaaaaacacatgggcataggcttagcagaaaggagtgttgttgttttttttttttaatcagtttaggggaggttcttctatgttgagaacccctgggagataaggctggttgtgatctagtttgttacagcccactttttcctcttctccaaattaaaaaaaaaaaaaacaactcacccaggttgaccccaaagggcccccagatacccaggtgggctccaaagtctccatttgcttccacgatctgcaggtgcgttaggtaagattacactagaatttcccgcagagccacctgtgtcaatgccactctcgtgcccaaccaaatgggtaaaacgagagaaagtgtggctactgcctgttgtaagttttcttccagcacagggtctggtagggattttgccacttgagaaaaggtaccatccaaagccatgcttgtcaagaagtaaaagaaaatatttagaaacccaaggtgggagtgtttagttgcagtatgaagaactgagagattaaatggtgaactgtccgtccggggtttggcaaaaagaatgcaggctattaataaactgctttgcatagttttttgtttctttgatttactcaacgatactattttagaattgttcagagacggaacttgacgctgaactgaaagtcattaggtggcagggtgtgaaataagatagagaattttgtttgaaggaaattgatgttttccctttgagatagctaccgttgatggaacacttcagtgccacatgctgttgcaacatttaacttaatttatctcatttaatctttgcaacaacttcataagaaaggctttatgatgcctgtttagtatacaaggcagctgaggctcagagaggtaaagtgtcacacagccagcaagtggtagaacccattcccgggtcagtttgagtccaagttcatacccttgaccccactatctttcttctttaccatggacacaaacttgttggggtcaggtttctggtgggactaaatgcttccaacaaagtaaatgtttatcaccgtgtcctttgaagaaaacataaactgactttttgcacatttaaaataaaaggcactgtttgtcccctgattgagggggtgacctagctgaaaccagtgaccctaggtgggctgccatgccgagagtccagaacgtgaactagctgggtcttttccgagaagccgccaggcttgccttgtaaacaccatgtttttttattatcatgtccgaaatagatgtgttattccgtacaaggtatctgttatggatttgttatcattacttttccgtgggagggcagagattgaggcaaacatgcccatttatggaagcgttttccatgaggccatccccggccccctcgtcagttacccagccttgcaccgcagcccggttggtcctggccctggggatttgtctaccatgtccctcacccattgaagaactagtggagaaaccctaaggagaagagatttgggaggaaagtgggattcttttttcctaccccctcttattcagaggtttgatttttttgggtggggggtgggagggaattgtctcctttccacaggtcttgaatccaaacaggtgggtcttccacgttaggcacaagcgtgtaattccaagagcagatatatagtagatttttcttgaaaaccaagttcaatattcaatccagtagaatcatagaaggccataagcaaatttaaaaatcatctcccgcacctccccaaacctcactttctcatccgggaaatggggctaatgagaataactcatgttttttgggcacttttgcctggcgagatgctaaacgctttgtggacattatcttacgtcttcataacaaccctttagagtagatactgttattctaactggctttattttacacatatggagtctgaataacttgcttaagatagctcagctaaccagtaaggaaaagaagattctacaaatctaggtctttctaactccagagtttcacagattaccctcatgggaggatttgatgagctaatgtgtatgaagggtttagcacagtgcctggcccctggtaagcttcagtgatggttatttatagcaaacacaaccagagagttcaagatgtttgctcagtatggcatggctcatctttggcagaaccgggaagcctaaactatgtggccgttaaaggagaagcttctcttaattttcttccctttgatctcataaacctcgtttctatttgggctgaaagtggtgattagaatctttaatatattaagctaccattccttacctggattgggaatgttacaaattccaattacatttgtttagggttttgtttgtttgtttttgagacagagtcttgctctgtcgcccaggctggagtgcagtggtgcgatcttggctcactgcaacctccgcctcctaggttcaggcacttctccagcctcagcctcctgagtagagagtagctgggtttataggcgcccaccaccatgcctggctaattttttgtatttttagtagagatggggtttcaccatattggccaggctggtctcgaaccgctgacctcaagtgattcgcctggcttggtctcccaaagtgctcagattacaggcgtgagccaccgcgcctggcttatttagggtcttgatggcatactttaagggatggcctttttgctctctaggtcttctccttccactcctgacctttcaacttttaaccctggccacacaatggaggaaagactgaatttagagaaaggcaggcaagaatttgaaagaaaccttgtatgtgatccaaggacagaggaagaagctgctcacagtggctgaaaggggaggtcggacatctgtgacttgtatcagggtttcaggggctaaggaggaacaacctcatcaaagttgctaggaaagggccatagaggccaggtatggcaggtcatacctgtaatcccagcaatttgggaggctgaggtggggggatggcttgaagtcaggagtttgagaccagagtgggcaacatagcgaggcaccatctctacaaaaaaatttttaaaatgagctgggcatggtggcatgcatctgtagtcctagttattcaggaggttgagtgaggcaggaggattgcttgagcccaggagttcaaggctgccgtgggccctgattgcatcactgttctctagcctgggcaacagagtgagactctgtctcaaaaaaaaggtgaggggcatagaactttactgtaccaggctgaaaaatacaaggcccagagagggcaagtgacttgcctagcatcacccagcgagttttgggcagagctgagacttgtaactcgaagacctaaggatcttccacaggctaatgaatagcttgtttgtgctcaagggatgaagcagtgagttgttaggacaggactgtgaatagggctgacatattcagatgtgtcaaacatcgctaatgccatctctgagtaaattaggcttcaaacagatcgggattctaatcctggttccccaacttttgcaagggagggccttgcatttacctttcaagaccccgataggcttagcaggaaaatgggaataatagataatgccactctttcatccttggactttttgtctaattatatgaatttatctgtaggataaattcccagaaatgcgcttgctgagttaaagggcatgcgtatctaaaattaatagatattgcaaatgactggctaaagacattgcagaccaggtgcagtggctcacgcctgtaatcccagcactttgggaggccgcagcaggtgggtcacctgaggtcaggagttcaagaccagcctggccaacatggtctctgctaaaccctatctctactaaaaatacaaaaattatctgggcatggtcgtgggcacctgtaatcccagctactcgggaggctgaggcacgagaatcgcttgagcctcagaggcagaggttgcattgagccgagatcacaccactgcactccagcctgggcaaagagtgagactcggtctcaaaaaaaaaaaaaaaaaggcattgcaaattgcaacttgttgcagtcacatatgacagcagtccccatcctcttggcaccagagactggtttcgtggaagacaatattttccagggtggagtggggaggatggttttgggatgaaactgtcccacctcatcatcaggcattggttagattctcataaggaacgtacaacctagatcccttgcaggtggagttggcaatagggtttgtgcttctgtgaaaatctaatgctgcttatctgacaggaggcggagcttaggcagtgatggtcactcacccaccgtcccctcctgctatgtggcctggttcctaacaggccattgactgatactgcagcacaagggttggggacccctgacataggagactatacatttattttaagctgtggtatgccagaattgtaaaatataaaacacagtggggcttttagggccagaaataatcagttcttgctcgcttccagaagcatccttcacaggggctaccgtaactcttgccaaccaagttctcttggttgggaggaaaaaatagtgttatgcattaagagaacttctttctggagttacttgaaaccattggtattcagatgattaggcagatgtcacaaggcaataagaatgtgacaggttcaccattcactttttttcctgtaaaagtgaagtagggctttcttgggaacaagcccttgggaggtggggggatgtgaatggtgaggggagggtagaaatggtggagtagggtcaggggcaagaaagggactttctgctaagaattaatcgggtgtccatttactcttagcagaaaactaggattagattctggattgtactcctgactccaaattttacaagtgggggtcttgcatttaccttccaggacctcggtcatcttagcaggaaaatagcaatagcaggtgatgccaccttacagagcgcttaggagacagtgagatggtctatataggaagctgtctggcctgatacctgatgaatacaaggggcccaataaatacagtggctgttatgaataatagatctaaactgcctttttggtactactggggacctgccaagcaggtgcatttagagtgcccagtgcctctccctgcgacacatttgatgcctccctacacctggaccaggccttgagcgaggatttccactgcagaggtccttccagctggcgaattgtgttgcagatcaggttcagagaacttctgttttgcctgtgtggcattcattcattcgtttatttgaaatagagatgggatctcactgtgctgcccaggctagtctagagctcctaattcaagcaatcctcttggcttggcctcccatagttcttggattacaggtgtgaaccactgtatccagccctttatgacatttagaatatgagcaatttttcttttttcttttttttctttttgagatggagtctcactctgtcacccaggctagagtgcagtggcatgatcttggctcactgcaacctctacctcccaggctcaagcgatcttcccacctcagcctcccgagtagctgggactaccggcatgtgctgccatgcctggctaatttttgtattttctgtagagatggggtttcaccatgttgcgcaggctggtgtcaaactcctaagctcaagcgaactgcctgccttggcctcccagtgttgggattacagacgtgagccacagtgctgaaccctgcatggtatttagaatataagcaatactctaacatctggtctgggtcactctgtattacttacctgatctccaaaaacatttgggtttttgtctctggtccaaaatctttagccaatggcttggcagtaaaatcctgagggaagctgttgaccaggtgaggtgatgtgcaaatcctatactctctgggctctgggatatttaatttactatttatttatttattttcaagacagagttttgctcttgtcgcccaggctggagtgcagtgatgggatctcagctcactgcaccctccacctcctgggttcaagcgattctccttcctcagcctcctgagtagctggtattacaggcgcccaccaccacacctggctattttttgtatttttagtagagacggggtttcaccatgttggccaggctggtcttgaactactgacctcaggttatccgcctgcctcggcctcccgaagtactgggattacaggcatcagccaccatgcccggcctaatttactttttattaatgctgaagcagagagggcaagatcttttgcccctgagttcttctgggaaaaatgaaactgatggtaaaacaaactaaagcaacctgacattctcagttggtccagtttcagccctttgactgggagtcacagacgggtcccataaaatggtagagctgggccagcctaccattgatttattttccctaaatgaaaaatacaaggcccagagagggcaagtgacttgtccagagtcacccagcaggtttggggcaaagctgagactcgttacttgacatcctaaggtcttccagaggctaatgattagcttgtttgtgctcaaaaaatgaagcagcctgggcgcggtggctcatgcttgtaatcctagcactttgggaggctgaggcaggcagatcgcttgagctcaggagtttgagaccagcctgggccacaaagtgagacccctgtctctacaaaaaaatgcaagaattaaaaaattagctgggtgttctggtgcgtgcctgtgatcccagctacttgggaggctgaggtgggagaatggcttgagcctgggaggcagagtttgcagaaagcagagatcgcgccacttcactctagcctgggcaacagagccagaccctgtctcaaaaaaaaagaatgaagcagttgttggtcaggacaggactgtaaacaaggctgacacactcagatgtgtcaaacatcgctaatgccaaaggtgacagagtcatttgttttcatccaaacattcgagaaagttggacgaggtgactcacgcctgtcatcctagagctttgggaagccaaggcaggaggatcatttgagatcaggagtttgagaccagcctaggcaaaatagcaagacccccatctctacaaaaaataagccgggcatagtggcccacacctgaggtgggaggatcccttgagcccatgagtttgagcctgcagtaagctatgattgcaccactgcactccaccctgggcatatagtgagacccttcccccaaccaaaaacattgagagcagctcttgatgagtgaactgtacttcgtggtcagcagttctgggtagtaatttcagagatgtcctttcagcccttggagctgatgcaggaccttaaacatgagcgatggtggaggagggagggttgggaaggtgcatcaaggtagatgaagagtgtccctggggttgggccaactggcggtccgtctctggtccagtgtgttcaccttgcccccgtctgatcttctgcagttggtattccgagttgagtttgactaagtgagagctgctctcagctttaactgcctttcccaagacagcccttgtttttattctaaagctgtggttctcaactggaagcagttttgccaccccaggggacatctagcagtgtctggagacatttttgattgtcatgagtggaggaaggggtgctactggcatcaggtgggcagagaccagggatgctgcggaacatcccacaatgcacggaagagctcccctcacgacacagaatgacgcagcccaagagtcacagtgcagagtttgtggccagctgcggtggctcacgcctgtaatcccagcactttggggggccaaggtgggaggattgcttgaggcctggagttcaagaccagcctggccaatatggtgaaacctcatctctactaaaaatacaaaaattagccaggcatggtagcgcatgcctgtagtcccagctacttgggaggctgaggcacgagaatcacttgaacccagaaacgtggaggttgcagtgagctgagattgcgtcactgcactccagcctgggtaacagagcgagactctgtgtcaaaaaaaaaaaaaaaaaaaaaagacttagcaactattattactagtattagtattattaatttgtcaggctcactgaattttctcaaaaatttggcaaatttttaggaaaacattctcaaaacatttggcaaatctgtggctaaatgttgttttggggacccaaggctcgtaggagcaaaacagctttcaggtttccggatctgccagagactcaagtgtcctgttgtgtgttttgtgtctcaatgagggaaaggggaatatgtagcaccttccagatggatttgaccttgactgcgccactgtttgaagagcttctcaacctccgcagctccaccccagcccagatatttcagggaattagggttccaaggggcatgctatggaaaacaccattctagcatgagtcgaagcttctcatcccccatcttgctgtcttttgaccaaagcagattttgcacgtcgtaactgtcagagacatcaaagccagagggaatccagcctgctccaagctctccttttttgtacagagactgaatctttgcacttgatcttgtttgtgtttttaagtctgaggttagacagggtcccaggcaatggaggcgtgcgtgtccttttatttttctgttgtagcttttgctattttttctgacttttaaggcaactcatccacatggcaattaggaagagcccacttagggctgggcacagcggctcatgcctgtaatcccagcactttgggagaccgaggcaggcagatcacttgaggtcaggagttcaagacctcagcctggacaacatggtgaaaccccgtctctacaaagaatacaggaaaatagctgggcatggtggcaggtgcctgtggtcccaactatttgggaggctggggtgggaggatcacttgagcctgggaggcggaggttgccgtgagctgaggtcatgccactgcactccagcctgggcgacagagcaagaccctgtctcagaaaaaaaaaaaaaaaaaaaagaagtccactttacttgtcatagtgcttagaacaaatgaaacactctcctagccctcttgggatgtaattggctaccatctgcacaaactcttcattattgcacaagaatatcaatatacttaatgctactgaactgtgtttaagtggccgaggtggtgaatgttagctgtattttaccacaattaaagataagagggaaggaaaatgaagtgtactttacaaccaaaaaagtacgcttgatgtgcaaaaaagtgtgcagcttgatgaattttcaagaggatatattttttatagatgggggtctcactctgtcacccaggctgcagtgcagtggcatgatcatggctcactgcatccccgacctcctgagcttaagtgatcctcccacctcagcctcctgagtagctgggactgcaggtgcacactatcacaaccggttaatttttgtatgtttgctagagacaaggtttcaccatgttgaccaggccggtctcagcctcctgggctcaggttatcctcctacctcagtcttccacacaggtaattaaaaaacattttttcttagagatgggtcttgctgtgttggccaggctggtctcaaactcctgggctcaagtggtcctcccatcttggcttctcaaagtgctgggattacaggcgtgagccatgtcacctggcccaacagtttgatgaattttcagaaagtgaacactcatagggctggcattcagatgaagatctagaggtcaaccctcacaagcccccctcacgttctgtccttgcaatcattgcacaccggagactcattcattccttatctgagttctatcaccgtagattaattctgcctggttttggacctcagttcaatagtcacagaacctgtgctttttgtgaccaccttcttttgctcaaggatgtgttgtgagatgtccttttttgtggtgtggagctgtagtttacttcacctgattcgagtcctattttgggtgtttgtaatgtgtcaggtactgtgccaggtgccttacaggattgattcctttatgggcatctgacaagcccacccaccttatgtgaaaggcagaaccaaatagactccagaatgagacccaggtttgggtcccagctctgacacttctttttttttgagatggaggctgactctgtcgccaaggctggagtgtagtggtatgatgtcggcttacggcaacctccacctcccgggttcaagtgattctcctgactcagcctcccaagtagctggggctacaggcacgtaccaccaatcctggctaatttttaatttttgtatttttagtagagacagggtttcacaatgttggccaagctggtctcaaactcctgacctcaagttatcctcccacctcagcctcccaaagttctgggattataggcatgagccatcacactcggcctacttgtgatcaatcttacttcatcttcacaccctcccatttctcttacgcatcctccagtttctctctctctctctccttctttttctctctctctctctcacacacacacacacgatctgctgcgacaccttaagaaacaagagattatcagggaatgattgaatattttgccgcatttcctattttgctgcctgtttaaactaaccttggttatactattaaaagaagacgcgtcgtatcaagccacttctgtgactatggctgtccagaaataaacataattaaaacatccaacagtagtaaatgctattggttaggaatgagcgaagtggcttagagtcaccggaagtgagaaagggtatagaaacagaaggtacttggtgtagatcaggggtgtcctatcttttggcttccctgggccaccccagaaaaagaagaattgtcttgggccacacgtaaaatacactagcactaatgatagctgatgagctaaaaaaaaaaaaaaaaatcgcgaaaaaatatcatactgttttaagaaagtttatgaatttgtatcgggccacattcaaagccgtcctgggccccatgcagcctgtgggctgcaggttagacaagcttggtgtagagagtttcatctaaacttcatggcagctctgcagggcacccgttaggtccccagtattaatatacagtaaatctgagtctcagatctacgtaagtcacccagaagcacgcattctgcagtggcagagtcacgtttgaattagcatctgattgcaaagtctgggtgtctttacatgactacaggttatcttacctctcaagaggaggcaaccaatcaaatgttgccagcaccaatgaacttgtactttatttaggctcagaaagatcttttaggctaatgaaaatgccctatatttatgaaatgttctcgttctctgtggctttctcttttttgagacagggtctcaccctgacacccaggctggagtgcagtgatgtaatcatagctcactgcagcctcaaactcctgggctcaagcaaccctcctgcctcagcctcctagtagctgggactacaagcacgcatcatcatgcctggctgatattttttttaagggatggggtcttgctataatgcccagtctggtctcgaactcctgggctcaagcaatcctcctgccttggcctcccaaaatatgggattatacatgtgggctactgccagcctcttttctttcaattattttttaatctatgggttcccctcctttttgtttgtattttatttgttaaagaaagagagtactggccgagcgtggtggctcacacctgtaatgtcagcactttgagaggccaaggccggtagatcacctgaggtcaggagtttgagaccagcctggacaatatggtgaaaccccgtctctactaaaaatacaaaaatcagccaggcgtggtggcatgcacctgtaatcctagctcctcgggaggctgaggcaggagaatcacttgaacctaggaggtggaggttgcagtgagccaagatcccgccattgcactctagctgggcgacagagcatagtctctcacctttgggagtttactgcattgtttagcatgctctcctgtgccttgcattttccatagacaggcgtcagatctggaggcttcatcaccttcatcccccatctccatccccttttcttttgagcaagaatatgtcattagtggtaacggcacttcctgtagtggcccatctgcaggcatgtaatgtttataatgtctagtcagctctctctttttgtgatgttagggttaattagtagatttaggtgatggcaggcggacccatcccttaaaaattccacaagagctcttcatctgatatagtcagtcttgtggtggggaccctagaccagcatcatcatcatcacccggaagctggttaggaatgcatattcttgggccccatcccagtcctactgactcagaagctaatgcaccaggaaatgtgagccccattggcctaatggttttagcaattactggtagaacttgccaacttgccaagaccctttctttcttcctttctttctttttttttttttgagacggagtctcactctgtcgtccaggctggagtgcagcggcgcatctccactcacccactcactgcaagctccgcctcccaggttcacaccattctcctgcctcagcctccagagtagctgggactacacgcggccgccaccacgcccggctaatttttttttttttttttagtagagacagggttttgccgtgttagccaggatggtctcgatctcttgacttcgtgatctgcccgcctcagcctcccaaagtgctgggattacaggtgtgagccactgtgcccggcctcttccttcctttcttctttctttccttccttccttccttggcaaagtcttgctctgttgtccaggctggagtacagtggcatgatctcggctcattgcaacctccacctttggagttcaagtaattctcctgcctcagcctcctgagtagctggaattacaggcacatgccactatgcccagctaatttttgtattttttagtagagacagggttttcccatgttgaccaggctggcctcaaactcttgacctcaggtggtccgcccacctgggcctctcaaagtgctgggattacaggtgtgaaccaccgtgcccagcttgagacccactattagctttataaacagttacatcctagttttattgttctgcatgtattcgctggaattcttccatgtagaagggagtcttttttaagatagggtaactggagtcaggggcaggacactgttggtcttactatgagctaagccaaattcaataacaattttaaaatgcagaaaggaggattgttaaacttaggacaatacatgttgtctaccagatctttatttctctttctggatatctgaagtgattattcagatttagatgggatttcctcatttctctgcccttttttttttttttttttttttttttttggatgaagtcttgctctgttgcctgggccagagtgcagtggcaccatctcagctcactgcaacctctgcttcctgggttcaagcaattctcgtgcctcagcctcccgagtagctaggattacaggtgcctgccaccaagcccagctaatatttttgtgtttttagtagagatcaggtttcgccacgttggccagctggtcttgaactccggacctcaagcaatcctcctacctcagccccaacaaagtgctaggattacaggtgtgagccaccgcacctagccgccacttttttttcatcagctacgatatcaggtctcccagcagaaaatctctgagcaaatcaacttccaggtttgtttttcgtttttttgagactgagtttcgctcttactgcccaggctggagtgcggtgagaggcacaatcttggctcactgcaacctccacctcccgggttcaagtgattctcctgcctcagcctcccgagtagctgggattgtaggcgcatgctaccacgcccagcaacttttcgtatttttagtagagatggggtttcacatgttggccaggctggtctcgaactcctgacctcaggtgttccaccggccttggcctcccaaagtgctgggattacaggcatgagccactgcacccagcagcaggttcttaaaattagttttttaattattattttcagccctgaaaggaaaaaaataggtattggaatatctgccactcccattctgtcttgcaaaatctgcatcacccaaaaggttgggtttcaggagttggctgctcagctctagggatccaggagtgggacatgggtctttattctgtcgctgtgggatttggggcccaagcgtggggattatcagtgaattcaaaggagttgtgaattccctgctgaaggagggatgtcaaccacgcatagatcctggtggccatatgtcctcacttagccagcaactcagttctttggagcccagcagcaagaggtagaaggggctgtaagccagtgtttccaggacagcccctgcagctatggtcagagagtcaggaacggggggccggacaggcctatagagtgtgttgtctctgtccctctcctcataaacacatctggataacgacagataacgtgaatctaccatccatgggcttcccatgtagacaggacatttaatgacctaatcttccatcaagagagacttccccttcttaatttagttaccctaaggaacaatttgtatagaaaacgcagaatcaagattttcacatttccaccccactttctgtacccatttaaaaaataatgcatttggggctgggcacagtggctcatgcctgtaatcccttcactttgagagcccgaggctggtggatcacttgaggtcaggagtttgagaccagcctggccaacttggcgaagccccgtctctactaaaaatacaaaaattagctgggtgtgatggtgcacgcctgtaatcctagttactcgggaagctaaggcaggagaatcgcttgaacccagaggcagaggttgcagtgagccaagattgcaccactgccctccagcatagacaacagagcaagactccatctcaaacaacaacaacaaaaatcattttgaacaaatgcatttaaatatatttgtctttccaccctttttggggtgttagggtgatggacatataattatttttcttattgatattcacactgtctcgtatttgaccagatagaaccctagtataatattttggtatgcagttttctagacttttagaaatgtacacacaaacatataaaatgaagacaaatactttatgacaaatattttaatcagctttattgaggtataatctatataaagtaaaactcaccgatttaaaacaaattcaagtttttttaagtgtacagcttgagtgagttttttcaacttaaaaaatttatttcttaattgacaaataatcatacatgttcatggggtccataatgatttttttagttgtttggttggatggttttgagacagggtctcgctctgtggcccaggctggagtgcagtggcatgattacaactcactgcagccttgacctcctgggctctagccatcttcccgtcttagcctcctgagtagctggaaccgtaggcatgcaccaccgtgccaggctaatttttaatttttttacagagacaggggcttcttatgttgcccaggttggtcttgaactcctggcctcaagggatcctcctgtctcagcttcccacagtgctgggattacaggtgtgagccactgagtccagctcttagtaatgttttgatattaatacatataatgtgtggggagataagatcaggataattagcatatccatcatctcaagcatttgccattacttttattttgctacttcctatataatgacatttatcatctctttgtgttgggaacattcaatgtccttcttctagctcttggaaacgatgtaatattttattgttcactttactcatcctatagtggatagaacattcttaatgagttttgacaaatgtatacagtcttgtaagcaccaccatgaccacagggaatacttttatcaccccgaaaggtggtgcctcttacctcttatgtacctcttctgtgcctcttactaatccattcctttccttgccactggcaactcttttttttaatttttttgagacagcgtctcactctgtcactcaggctggagtgcaatggtgcagtctcggctcactgcagcctctgcctcccaggttcaagtgattctcctgcctcagctttttgagtaactgggattacaggtgtgcaccaccatgcccggctaatttttgtatttttagtagagatggggttttaccacattgggcaggctggtttcaaactcctgacctcaagtgatcccccctgccttggcctcccaaagtgctgggattacaggtgtgagccaccgtgcatggcctcctctggcaactcttgattgcctgtcaccatagatatgccttttctattttgccattactttttttttttttcgagacagagtctcgctctgtcgccgaggctggagtgcagtggcgcgatctcagctcactgcaacctccgcctcctgggttcaagcaatcctcttgcctcagcctcctgagtagctgggactacaggtgtgtgccaccacactccattaatatttgtatttttagtagagacaggggtctcaccatgttgcccaggctggtcttgaactcctgacctcaggtgatccactcacctcagcctcccaaggtgctgagattacaggcgtgagccaccgcgcccggccgccattaccttctatctcaataaccacacttacgtttgcaccagcctaatagtttttcgtattgaaggagtaatagagcgtgtggcctttctgatttgtttcactgagcatgatgcttttgagactcatttattttattgcataatttctttccttttactgagtttccagttatataccttgggttgtttgtttgtttttaaggcagagtctcactctgtcacccaggctggagtgcagtggcttgatcttggctcactgcaatcttgacctcccaggctcaggtgattctcccacctcagcctcccaagtagctgagactacaggtgtgcgctaccatgcctggctaattttttgtattttttgtagagacaaggttttgccatgttgcttaggctggtctccaactcctgggctcaaggaatctgggtaattctatgtttaatcgtatgaggactcttattttgcagcgcacagttagacttgaccatcttcccatattagcacgtgtacacttacttccggcttcttcttctttttttttttttttttttgagatggagtctggctctgtcacccaggctggagtgcagtggcactatcttggctcactgcaacctctgcctcctgggtttgagcaattctgcctgagcctcccaagtggctgggattacaggtgcacaccatcacacctggctaatttttgtattttcagtagagacggggtttcaccatgttggccaggctggtcttgaactcctggcctcaagtgatttgcccacctcggcctcccacagtgttgggtttacaggtgtgagccaccttgtccagccctacttcctgcctcctgagcactgggtagtatttcacagtgtggaaatagcatggcttatgtatccagctgtatgttggtggacatttgggttgtctgacttttggtattttaggcgatgacacacatccctttctgaagggcctttgggtggtctctgttctttgaccacatacacaatactgcaggtctttgtacttggtgggatgtctctgcagaccgagttcctagacagggcaaggtgagtggttggtctgtcttccgggcttggttgtggtctgattctgaccctgttaccttattccacaggggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatgtgagtattgcaggcagccaggtacctactcctggcctcataaggaaagtaggcattagaaatgtgttgggagggctgggcacagtggctcatgcctgtactcccagcactttgggaggccgaggtgggcagatcacctgaggtcagaagttcgagaccacgctggccaacatgatgaaatgccgtctctactaaaaatacaaaaagtagccaagggtggtggtgcgcatctgtaatcccagctactggggaggctggggcagaggaattgcttgaatccaggaggtggaggtgcagtgagccaagactgtaccactgcactccagcctgggtgacagaataagactctgtctcaaaaaaaaaaaaaaaggaaatgggaggctgaaggtttgatcgagggagattgcaagatgaggtggaatcattccaaggtgggttcacatctcagcccttgaagaggttatttcctctctcgaagccttggttttcctatccgtaaaatgggaataatcaccctcattacagacaggaggtgtgacaatcccatgtcatcacatgtgccaagtgccaagacgtatgataaactctcaacagatttcattggcatcgttctctgtccttccttcctcttgaaagtaaagaagagctcataaccactttggaaaggctggtttgtcttggcagccaggtgggtaggagacatgaggatgtggctaggttttagggaggccttccttgtcacagaggggaatgttcaggttggtcgtaggactattttaggtagacttgcagaacagagtggactagagatggcacaatatggtagccactggccactcgtggctaactaaatttagatttaaattaattaaaagaaacattagaccaggtttggcgactcatgcctgtaatcccagcacgctgggaggccaaggcgggtagatcacttgaggtcaggagtttgagaccagcctggccaacgtgatgaaaccctgtctctactaaaaatgccaaaattagccaggcatggtagtgcacatctgtaatcccagctacttgagaggctgaggcaggagaattgcttgaacccgggaggcagaggttgcagtgagccgagatggtgccgttgcactccagcctgggcaataagagcgaaactccatctcaaaaaaaaaaaaaaaaaaaaaagaaacattaaaaaatttattagctgggtgcgtgggctcacacctgtaatcccagcactttgggaggccaaggtgggtggatcacctgaggtcaggagttctagacaagcctggccaacatggtaaaaccccgtctctactaaaaatacaaaaattagctgggcatgatggtgtgcgcctgtaatcccagctacttgggaggccgaggcaggagaatcgcttgaacctgggagatggaggttgcagtgagccaaaatcgcgttattgtactccagcttgggcaataagagcaaaacttcatctctaaataaatacataagtaaaagacaataaaaaataacaaatttatttcttttgttgtgttggccctaggtcaagtagtcaatagccacctgtggctagtggctggtgtactgggtagcataagtgcagaatgttcccattatcatagaaagttctgttggactgcttggactagatgattggggcttggagtgtgatgttgtggggcacgggtcgccagactgatgtgcagaggtcacccaacccggcctatgtctatgtcttctctctgaaaggccttgctcaccctcgagcaggttacctcatgcctctgaagctttgtttccttttctgtaaaatggatgcaagaatagtgccagcctcttgggagccgggcatagtggctcatgcctgtaatcccagcactttgagaaactgaggcaggtggctcacttgagcccaggagtttgagaccagcctgggcaacacaacgagaccccatctctgcaaaaataaattagccaggtgcagtggtgcgtactcataatcccagctactcagggaggctgaggcaggaggatcacttgagcccaggagttcaaggctgcagtgagctatgattgtgccactgcactctagcctgggtgacagagcaagaccttgtctgtttcaaaaaaaaaaaaaaaaaaaaatagtaccagcttcatggagtgggttactctaaatagaaagcacttaatacacttcctgctacatgttaagtgcaggcactgaaaatgttaagtgttactagattggtttttgctgtggtcatgatcacttttgattttactagtaagatgttcttcttccatcacttggcatccttgtgtctctttggttctggtctgtacattttgccaaatgaaaattacaaaaagccccttgtcatctctaaaaatgtcctgcacatttttttcctaattaggaaactaagacacgttcactatggaacacttggagagttcagaaagcatagtgaacacaaaacagaaaaattagtccttaaccagagatgcggtgcattctttgtctctttgtgagcatggtatctgtttacatatttaaaagcctattgggcacacagtttagtgacttgctcttttttccatttggaaatgctcagtgttgacttgtgtaatatatctcaggaagccccaaagataccccttgtaaggggtagtatagaatctgtcatggggataggccatttttccactgttcttatagatatttcagaaggagttagagtggctttttaaagagccaaatggtaagagtgagcaacttagcaactcataacttttttttttttttttgagatgggggcttactctgtctttgaggctggagtgcagtggttctatcgtagctcagtacagcttccaagtcctggattcaaacgatcctctcacctcagcctcctgagtagctgtggaccacaggtgtgcaccaccacacctggctaattaaaaaaaaaaaaaaaaacttctgtagagactgggatctcactatattgcccaggctggtctcaaactcctggcctcaagccatctcctgccttgacttttcacggcgctgggattacgggtgtgagccactgtgcctggccgtaactattaaatatgtcctccaatccaagtgctgtacattgacacattgtattttatttaacacagcatcccctgagttaaaaatgtttgccccttttagggaaggaagctgaggtgcagtgttgcaaaatgtatctttactttcttaagtaggggaagtctcttgtctgtggcactgtttgtatggaaaaattattgatctggggctgtttgtatggtggacattttctttttctttctttcttcttttttttttttttgagatggaatttcacttttgttgctcaggctggagtgaagtggagcgatcttggctcattgcaacctccacctcccgggttgaagtgattctcctgcttcagcctcccgagtagctgggattgcagggatgtgccaccatgcctggctgatttttgtatttttagtagagacgggtttcaccatgttggctaggctggtctccaactcctgacctcaggtgatccacttgcctcggcctcccaaagtgctaggatcacaggcctgaaccaccacgcccagccagtatgttggatatttctaaagaggcccgtctgtagggagctagagggaaaattggactctttggggcccaggtctttcatctaagacgtatcatcaccatctagggagtttcaggacaggcctgtgtattcatctcacctgctgtcctcaaatagaaatcagaaaaaaaaagggcatatgaaggtcctgagacccaaaatatcttctgacagcagattaaaaataaatgaatcaaagcttcaaattcctgctatgcttctctggacagattagattaaaatcctttcagccttgtgatgatggtcccgctcttctcttgttcctttctggtcagtttaattgcttaatagaaaccgtcgtccatgacggagaagataaagaaggaaaggggttggggtgggggagcacagtaacttactctcccagcccataatagcagcatgcatgagtcttgttaataggcgggtagtgaggtgataccaggtccgtggtctggcatgcatgactttgccctctgtgatgaagataaactttctcctccgttctgcaaggctcgcctcaaacgatgtgcccttgagaaggttctggcagacctcttgtgctcttggatctagaagagtctatagaagccagaggagctttcctcctaatcttagagatgcaggttctgggctcagcaatgtccagcagtctacctaaactgctgaagaccgtttgtggcatacctggcggggagcatggctttgacgcctggtcctaagggtcccttggtcttctgaatgctgtcttttggctgagttcgtctgcctcgagttagttagttcgttcctcccttccttccttccttccttccttcctccctccctccctccctctctctttcttcctttctttctctgtctttctgtcttcttttttctttcttcttttttctttttctttcttttgagatggggtcttactctgttgcccaggctggagtacagtggcatgatctcagctcactgcaacctctgcctcctggaactcaagggatcctatctcagtctccttagtagctgggactacaggcatgtagcacgatgcccagctaatttttttgtgtttttggtagaggtggggtcacaccgtattgcccaaacagatctcgaactcctgagctcaagcaatcttcaccacttcggcctcccaaagtgttaggattacaggcatgatattgtgccactgcactccagcctgggtgacagagtgagactacatctcaaaaaaaaaaaaaaaaaaaaaaaaaaaaaaaaaaaaagatgaggttgctgaagctcagatgtgcttagtcccaccactggaaggtgggcagagctgggattcagacaaggtctgtgtgagtccagggccagggtgactacctatgattagtagcaaagggctcttggggtaataggcttagagcaggaggtgatggtcgtgggctggagcaggaggggacagtgccagaggccttgttagctttgaggtagacaagctttaagtgcagagcaagaaggaattgaaccttttattatgattccttgagcacctaactaggtgctagactaatgattacaacctgctaacacagaggagtgatttttgtttttaaattgagttaacttaatatatcaaaaaaagaaatctgtttctggcattgctcgaaaaagcagaggacctgacactgcagaatgcagagtgcgagtagcagtccctgtgagatgggctttttgctctgcttttccgcagacctcaccactccctgtcgtctcccaggccatggtaaccattgaccgtggcacctcttttgttcactcacacacgccctgcttcactcatgccttacctgctttgtctctgtagacagtgggaccctccaccctataccaaacctctggggttgggaaaatcatgatccagagccaaggtggatgggcccccctgctcattggaactccaagcccaagtccctgaaccatgaaccccaaaggacatttttccagttctggttctgcttctggaatgcccagggggtcaggagaagccctccttccaaactttagcaggtgacaatttttccgccttagagacctggcccagcaatcttagcctactctggaagcagtgtccacccggggacacaaggaacaagcagattgtgaacagaggcctcctgggtgccagccactgcactggtccctagagggtagaaagacactgtaactggaagctgccctttgtcaagccccaagcattagcccttctgatctttttttttttttaacatggagtctcgctctgtcacgcaggctggagagcagtggtgtgatcctggctcactgcaacctccatttcctgagttcaagcgattcttgtgcctcagcctcccagtagctgggattacaggcacatgccaccacgcccagctaatttttgtatttttagtagagaagtggtttcaccatgttggccaggttggtcttgaactcctgaactcagatgatcctcccacctccgcctcccaacgtgctgggattacaggcatgagccactgcacccagccttctgatctttcaagtcattattgcttcaaagaacctcctccagtaatacaaggataatctatgcaaagacctcaggagaatatttaaaaataagtatgtatcacaaaaagcagccctcttccctggaggcaaacatgattcacaggttcatgtatgtacacacacacacacacacacacacacacacacaccccaaacataagaaaaagtcactccttgtatgttttgcagtatgattttttttccacttaaccctaccttatagttttttctgtctgttcataactatctagtcagacttcaaatatgtttttgaataggtaagacatgcaaatatgaaataaaatagtgtataagggaatatagaacttcccccttcgttcctatttctcgcccttccagttccccttcttagagacactgtggttgctggttacatatgtagccctccagtcatgttatttatttatttatattatttttcgagatggagtctcactctctcacccagactggagtgaagtggcatgatcttggctcactgcaacagccccctcccaggttcaagcaattctcctccctcagcctcccaagtagctgagactacaggcgtgtactaccacacccagctgatttttgtatttttagtagagagggggttttgccatgttggccaggctggtctcgatctcctgacctcaggtgatccacctgcctcggcctgccaaggtgctgggattacaggcttaagccactgtgcccagcctattgctttttttgtgataaagtctcactctgtcacccaggctggagtgcaatggtgcgatctcggctcctgcaacctatgccttctggattcaagcgatcatcccgccccagcctcctgagtagctgggattacaggtgtgcatcaccacacccagataatttttgtattttttgtaaagatgggtttttgccatgttagccaggctggtcttgaactcctgacctcaagtgatccacccacctcagcctcccaaagtgctacaattacaggtgtgagctgctccatccagcctccagtgatgttttatacacatgcagccacatagagagcccctcctgcacccctccaaaatggcagcacaggccccggctgttgtgcgtctcaatctttgcatctaactgtgtattttggccattcatccatggtagtagagagagggccactgcacagtcttctgctatagggatgaaccataatgattaagcctgtctgctattgacaggtatttaggttgtttctagtctttttgctcttaaaagcaaggctgcagcaaaagcacgtgcttggtggaccacgtctgtctctaggttgggtatttagaaagccgtgatattgcactgcagcttcataaagaagccgtgattatccatcactttactgaggaagctcaggggtaggtctgtatgcacaagtcaggcaggtgataaggcaaagccaacactctgcccaggcctgtgtgtctttttttttttgagaccaagtctcgctgtatcacccaggctggagtggagtggcacaatctcagctcactgcaacctctgccacctgagttcaagcagttctcctgcctcagcttcccgagtagctgggattacaggcacgcgccaccacaccttgctaatttttgtatttttagtagagatgaggtttcactgtgttggccgggctggtctcgaactcttgacctcaggtgatccacccaccttggcctcccaaagtgccgggattacaggtgtgagccactgcgcccggccatccctgtgtgtctgaaagccagtgttccttccacttccctcccttccctccctgttcctcatttctgctgcaggccccgggagcaccccctgctcagggctctgtggctgaccatataaagcgtcagagaaaaactggagctgcttcctaatacggtcacaagagggaaatcctgggcctgcagctgggacttgctggtggcacagggcccatgagatgccggctgggacacaggaggctgggatgttgaaacctctgaatttaaccagctggagaggggctcgtggggccagagaggcagaaacacagccaactatggttgggctgggtcgaggtgaaggagaagtggctgaataatgtgggaggaagagcccgatgctgaagccccacgaccctgccgtgagatgtgcggctgcctgcaccagtcttaccttcactccatcgtcataccctggcttgcttagaaagcttttacagaactcagcagagattcagatctacctggaagtatggattaagtgcttgttgtgtgcacggcactgggagagatgtcccaaacaaagaggatggaagtcatattcctctttcagaagctagtgatggagttgaaaaggcagtgtggtccttccttctttttaaaaattcattttattctttttttttttttctttgagacagtctcactttgtcacccaggctggagtgtggtggcatgatctcggctcacataacctctgcctccttggttcaggtgactctcctgcctcagactcctgagtagctgggattacaggcatgcgccaccacacccagctaatttttgtatttttagtaaagacggggttttgccatgttagccaggctgttctcaaactcctgacctcaagtgatctgacctcctcgatttcccaaagtgctggcattaaaggtgtgagccaccatgcccggcctcttccttctttttaaaaattccttttattcttttcttttctctatctctcatctctctttcttcctttctttcttactttccttccttccttccttcttttttttttttttttagagtctcactctgttgcccaggctggagtgcagcaccatgatctcagctcactataacctccacctcctgggttcaagtgattctcctacctcggcctcccgactagctgggattacaggcgcctgccatcatgcctggctaatttttgtatttttagtagagacggggttttgccatgttggccaggctggtctcgaactcctgacctcaagtgatctgacctccttggccacccgaagtgctgggattacagctgactgagtgtctaccctgtccctggcactgtgcggggtgcaggagatacagtagtgtgtgggtcacagtccaggaggtaacatttaggcagagctctaaaagaggagagggaaccagctgtgggaagatgaggggaaaagtgttccaagtggagagaacagcatattgaaggctctaaggtggcaagacttccctctcgtgaaatgaagggagcatagtaagagtcactaaataacattgattgagcacctactacataccagccgccatgctaaatgcttttcgagcattatctcgcagcacatctatgaagggcttgttcgtatgcctccctgttttgtagatgaggataagtgagactcagagaggttaagggacttgcccagggtcacacagcgaagaagtagcaaagtgaaggttcaaattcaagtaccccatacccagttctgagcccttagccactgccctttactgcctccaggtcaagggcttgagtgaggacaggttgggctgtaaatgatacctacattcaaaaggggcgtggcagtggacatggccccagaggagctggagatggagtcgaggcctgaaggagggtggggcttgattgacctttgttcaggtgaccacagactgggctcttctctttgggaggcttgtcctggggacaggggacactgattgaacaggaaatagcccctggcctggctcagtgtagtccactgagtacctactgccgccgtgcaaggcccccaggtcacggaggtgaagtcaggctgtccctgctcccaggaagctgtatcattaatttattcccctggcatgcatttagcaagcatttagttagcacctattctataccaaggcctgtgctgggactgaagaggagaaagggggttccccggactcaaggcacttgcagctggtgtttgcaggatgggtgggagggtcctgggtgatggaatggggaagaggggtgtccaggcaggcagccccccactcccagccccaccaggctggatgttgctcctgggccccgcttacctctaacccttgctttgcttctccatttcggtccgatggagccgcttataccaagctgcttatagttcacccccacggaccccgtgtcctgtttttctgcccatgtccctgctttgtcttgagctggttaacaccttgttgtcctttaagactcagtgcagggaatacctccccacctggaggtttccctgaccacccccaatgtgggttagggccttcccttccttgttcctatcattctctgttcttacgacgtgttttaatgtacttgtctccccctctgatttaagttctttaagggcaggagctatcattgatttctttatctccagcctctgacacagatgtggtatatagtaggtgctcagtaaatggttgatggctatttagacaggcatatgttgactcattcattctccttttaggggatggtgagaacctccgtctccatcaatcctgtttccttttttttttttttttttttttttttgagatgggttctccctctgtcacccaggctggagtgcaatggcaccaccttggctcactacaacctccctccacctcccaggttcaagtgattctcctgcctcagcctgccgagtagctgggactacaggcatgtgccaccatgccctgctaattttttgtatttttggtagaaacagggtctcactgtgttgcctaggttggtcttgaactcctgagtgtgagcaatctgccctccttggtctcccaaagtactgggatcataggtgtgaaccactgcgcccaacaatcctgtaccttcaaagaatattcctctgcagcacccccagacattacataccattgtccctgagtggactgagccctggaaggaccttcccactctctctttttctttctttttcttttttgagacaaggtctcaccgtgtcacacaggctggagtgcatggcacaatcacggcttactgcaacctcaacctcccaggcttaagcaaacctcccacctcagcctcccaagtggctgggactacaggtgaatgccaccatgcccagctaatttttaaatttcttatagagatgggggtctcactgtgctgcccaagctggtctcagacttctgggctcaagcaatcttcctgccttgacctcccaaagtgctgggattacagttgtgagccaccacacccagccagactttcccactctctaattggctccagcccttgactaaaaggcccttgagggctgggatcctgtgtttttttaatgttctaatgtagtcccagcaccttttgcatggcatctgggacgtacagaatgaatgaatgaatgaatgaatgaatgaatgaatgaacgaacgatcagtagtttctgtttctgttggatgggcctaggctggatagcataatggaccatgctcatacctgggggcgggccaggctgggcttggtgctgccaggatcttctttggtgacctcggtcaagtcacttaaccctctgttgcttggttcaccctagctgtaactgagagatggatctgtggttctccctaagtcacttgcagggaagaggatacgctttatggccatcagagtcttgggcagtactgatgtttatcgtttggggaaagcagttcctgtgagacgggttggagcctgtctcctgaactgtgacctcaaccatgggaaaatctagtatccagtaaggaaaaatcatgacaatagtgccttaccacgtacagcatggcgggactcgccttgtgccttgactcctccgtccctgatctgattattttcagatgctcctattcacccagtaggagaggactgctattttttaaatggtaaagtgcatatgacataaaatttaccattttaaacattttaaagaaaacagtgccattaagtgcattcacaatgttgtacagctatcaatttcaagacagggtcttgctctgtcacccaggggctagagtgcaatggtacaatcatagctcactattaccttgagctcctgggatcaagcaatcctcctgactcagcctcccaagtagctgggactacaggtgatcaccaccatggccagctattttttttttttttttttttttgtagagagggggtccggctgttgttgcctgagctggtctcaaacacttagcctgaagcaatcctcccaccttggcctcccaaagtgctgggattacaggcatgagccactacacttggccccagagcatttttatagcctcaaaaggaaaccttatacccatgagcagttcctcctcatttcccacctctttccagcctctgggaaccacaagtctgttttctgtctccatggctttgcctactctagacacttcacataaatgagatgatagagtacgtgacttttcgtgcctggcttctttcactaggcatattttcaagcttcatccacattggagagctcatgtcagtgttggtctctgttttgcagatggggaaggtattaatgatcaggagcaggcgctgtggggtaaacaggagttctagttcccaacttccctccagctgtgtaacctggtgacaacctcaccatgcctcactttgccctcctgtcaaacaggcggtggggaaatcactgttactgagtagttgtgaagatgccacgaggagatgcctctgccatcttctagagactgagtcactggggtttcttcttagatatggacattgggaggtcccagaaagagatcagagggtggtgggaggagagagagcttggaggattattaccttttcctccctccctcctggaccacagttttggcagctgtgtttctgtatgactgcggatccctctggacagcccctttttaggggtgtgtggctttctatgcctccaatgttcagttaacgacattccctctctggctgagtgcggtggttcccacctgtaatcccagcactttgggaggctgagactggcgcatcacctcagctcaggagttcgagaccagcctgggcaatatggtgaaaccctgtctctacaaaaaacaaaataaaaattacctgggcatggttgtgcacacctgtggtaccacctacttgggaggctgaggcgagaggatcacttaagcccagaaactcaaggttgtagtgagccaagatcaccccactacactgcagcctgggcgacagagcaagaccctgtctcaaaaaaaaaaaaaagtaaacaacattctcttctgttcttgctcttcagacttaactgctcccgtcactggttgggtttctttaattctgcacacatatctgtaaacactttctttattaaatgttcctgagttaatatcttaagcacactgttcattttctgtgccacctgttaaatgatgagcatttaatatgattgtcagcatccaaaaaagatcctgcgtagtgcttagttcggtgcccaacacatagtaagtgctcaatgaacggtggctgttatttaagccagtgaggtccggggaggtaaagtggcaggtcggaggagtggagctgagatttgaacccagagctcttcaaaactccacagtttggccaggtgcaatggctcacaactataatcccagtgctttgggaggctgaaatgagagaattgcttgagcccaggaatttgagaccagcctgagcaacacagtgaaacccatgtctctacagaaaatataaacatcagccaggcctggtggcgcccgcctgtagtcctggctactcaggaggctgaggtaggaggatcacctgagtccagaaaggtcaaggtttcagtgagtcacgttcacaccaccgcactccagcctaggtgacagagtgagaccccatctcaaaacaaacacaaaaccccccacagttgcaaaataaaacataggcagcttggaaacccactctcgccctttctcctcttcccacgtacctggaatatcagtgaggcccagggtttccactaagactccaagctccagtttccccatctctaacatgagaatattgagtgcttctgtgcaatctgtctaccctggaggaggtctggaagtaagctgggttctctgtctgcagacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaaggtgagtgaactcagggctgcacggggccagctccagggagcccctcctgtcctgcttgtctgcagttcttgccaggaatgtggagtttggcaggcactgcgagggaccaggagttactgtggctgaaaaagggaaaaagcaaaaggaacatctgtgtttgcagcctgggagggtgagggagagccaagagcttgggcaaatacgggcatgggcccgctccagctccagctccggggctcgctgcccaaggtccccgtcgggccagctgtctgcaaaggatggaaagagggtggggaacagccctggggctgagccattgtggtctgtgttgacacctacctgtccctcaacccctgtgggactgtgggtaaatatcttttcctcttcagcctcagtttcctcatttgtcaaaaggggtgatagtctctatcttgtagcttcttgtgaagattgttaatgctggtttttccaaacttaagacttgtgcctattactttcatgtttatacgttattatttttactattgttttattatttttgagacagggtctcactttctcgcccaggctgaagtgcagtggtgccatctcggctccctgcaacctccgcctcctgggctcaagcaattctcctgcctcagcctcccaagtagctgggactataggtgtggactgtcatgtcaagctaattttaaaaaggtgggtttttttgttttgtttttgttttgttttgttttgtttttggaagtgacaggatcttgctatactggttggtctcaaactcttggcctcaggcgatcctcccactttggcctcccaaagttctgggattataggcatgagccactgcacccaggccttctcaccttctatttagaacactttggagcccctgaaatagccacccccaagtcaaacagagggactaggcagttaatgcaaacaagtgtaccaggtcaggcgaagagtacaagaaactcgaaaactcacaccccctctgaaagggcaccaacaggtgggaacccagggatctgagttgggagttgagaggagcccaattctggaagttcttgaggccggaatccaggtgtgcctgagagatgccacgaccccgcccccaagatagagggactcaggtataagtgccccaactttctgacagtgagccagactccacaggtaggaccagaatcttggcccttctaggcagggcctgccattacctccaaagaccagcaggtggagccttgcaaaggcaatcttggagctgtaatctcaggttgtaaagtgatggctcctggagtcaggtatctgtcttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcataagccaccatacccagcaattcctggttcttttctggagctgaggtcccactaagcacattttaatctaaataccaaaaagaaagaaaattctgttagcaaaggagaaggagggggagcgacagatgggtaagcatttctacagtgctctgaaaaaatttatttgtaacttgaaaaagtctttaatattgtatattcattctagaaaaacttaaacatatatttaagtaaaagagaacttgctggcacctatgattctatcatccaaaactcatcaccattaacattttgttacgtgacctttcattacactaactgaactaaatggcatgaaatgaaggaaatttttactatctgaagataattcgttccagaaaaagatcacttaaaacagagaccaaagtttcactgtagatagtatgtgtgtggaggagggaaagagagtgggcaaaatatttgactgagcttgaaaaatgacattgcaggccaggcacagtggctcacgcctgtaatcctggcactttgggaagcccagatgggtggattgctcgaggtcatgagttcgagaccagcctgggcaatatggcgaaaccctgtctctacaaaaaatacaaaaattactttggtgtggtagcacatacctgtagtcccacttcttgggaggctgaggtgggaggatcgcttgagaccaggaagtggaggttgcagtgagccgagatcacgccactgcattccagcctgggtgagagagccagaccttgtctcaaaagaaaagaaaagaaaaccaacattgcaaattataaaaataggttaatttcagcttacatgtaataagaattttattttaattacaagtaggtgctaatttgtagattcagtataaaatgaattaagagtgggtgtggggtttttttctgtaactttttctgggctgagggatgaaatcatgtgagcataaaacgacatcttcatgtcatgcttgacttctgcagcccgagctaaaaaggatcattcttacagatttatttgatgggtcaccagttttcctaagggcttcttttacttctttagtgtttaagtctctcaaagcccctgtggtcttagcgttcattcagctgtgaattgccctgaatctttttctttcttttgtctttctttctttctttttttttttttttttccggatggagtttccctcttggtgcccaggttggagtgcaatggtgtgatctcagctcactgcaacctccacctcctgggttcaagcgattctactgcctcagcctcccaagtaactgggattataggcatgtgccaccacacccggctaattttgtatttttagtagagatggggtttcaccatgttacccaggatggtctcgatctcctgacattgtgatctgcccgcctcagcctcccatagtgctgggattacaggcatgcaccatcacaccaggctaattttgtatttttagtagagatggggctttaccatgttggtcagactggtcttgaactcctggcctcaggtgatcctcccacctcggcctcccaaagtggtgggattacaggtgtgcaccaccacacttggcccctgaatcttttttttggcctttccaaggccactgactttgccagtcactgcaccttgttttccagaactgccactttgttttgtgttcatatcatgatggtggctattgatacccaataattggcaaggtgaagccactgaatcgtcggagaaggaggtttcggtggagtttgatcgctcttgtagtcattgaagaatacttttgtgttgtggggacttttgctttcctagaccagcagtccccaacctttttgacaccagggaccagtttcatagaagtcagtttttccatggaccgcaggggagagatggttcgggatgattcgagcgcattacatttattgtgcactttatttctatgattacattgtcatatataatgaaatcattatacaactcaccatcatgtagaatcagtgggagccctgagcttgttttcctgcaactagacggtcccatctgggggtgatgggagacagtgacagatcatcaggcattagattctcataaggagcacacagcctggatccctcttatgtgcagttcacagtagggttggtggttctataagagtctaatgccgcctctgatctgagaggaagcagagctcaggcagtaattggagtgatagggagtggctgtaaatacagatgaagcccactactcacctcctgctgtgcagtaccagtcggtggtttgagatgcctgcgctagaccacctcttaactgtgaggcaatgttgtaattgacaaggacaccctgtgttcatatatttgattcctcatggtctctaggttttaacacaaaattgcatagtcagctctcttgaaactacttagaaatgctcacttgacacatagtaagctccaataggaaatgactatcatgattgagcacagcagcatgtcttcagtcctagcactttgggaggccaaggcaggaggatcacttgaggccaggagttagagaccagcctggccaacatagtgagctcttgtctctacaaaaaaataattagctggccacagtgcgtgagtctgtagtcctagctactctggaggctgaggcaggaggatggcttgagcccaggacttcaagaatgcagtgtgctatgatcgtgctatggtactccagccttggcaacagagtaagaccctgtcacgaaagaaagaaagaaaatgaaaaccgtgaatatgcacatccataaaagataaactctttacttaatttaaatgttaaccaacacctgctatgccctcgtctattttggcatgacctggtgctttctggcaaatcattgatggcggactccaaaaataaaaagaatcgggcacggtggctaacgcctgtaatcccagcactttgggaggccaaggtggggggatcatgagatcaggagatcgagaccatcctggctaacgtggtgaatctccgtctctactaaaaatacaaaaaaaactagccaggcacagtggcaggcgcctgtagtcccagctactcagggggtgctgaggcaggagaatggtgtgaacccaagaggcggagcttgcagtgagccgagatcacgccactgcactctagcctgggcaacaaagcgagactccatctcaaaataaataaataaataaaaaataaaaagaatgtcaaaaataatggagaaaaatttaagcttgggaagaattccgttcacctgcttaattttttctccattcccaagtaggaaattggtttttgtgaagaaacacgtaggcccagtgtgttgactccattgataaatggcacgatctcattctgttaagtcactgggctgcgatccacactaagcttaccatgaaggtggagagagaaagctagcacatgtggcttcttccttgagttcttcatggaaaagatggggtgtgaaaaggcgggattgaggagggatgggtaacacacatgcactgaatataagatgaagcattgcagttgtgtcacatagacagtaagttcctgaggacctataaactccatccttcttgcatgtgcatcattgtatctccagcacattttctggtgcctggcacatagtagctgctcagtatttgttgaatcaatgaattattagagttatttatagaaaagaacctaccagggtcaggatggatggggtgggttatttgagagaggtggggctttataagcctcgaagaatggtttgctaaggtgagagaagggggcagggatggctttctagccaagaataataaaagcataaatgtaggggtgagaatgggtatgatgagtgtggcaggagctggtttagaggggttgactagtatactgtggcagggagctcagagccagagctcagccctttgctgcctcacaggagttgggaaaatgggagggactttctaagagatacttcacaacatggcaccctcccaagtggaagccaagccccttgagggtatgggaagagaagctgatatttaaaatatgtatcttatatctgcatatgcataaattatgtcatgtttattttttaaattctccccccctttttttttgaggcagagtctcgccctgccacccaggctggagtgcagcagcacgatctcagctcagtggtatgatttctgctcactgcaacctctgtctcctgggttcaagcaattcttgtgcctcagcctcctgagtagctgggactacaggcacacaccaccatgcctggctaatttttgtatttttagtagagatggggttttgccatgttggccaggctggtttcaaactcctgacctcaggtgatctgcccgcctcaacctcccaaagtgctgagattacaggcatgagccactgcgcccggccgtggtttgtttttggaaagatgttacatacaaattcaaaaggtgaacttctcccttcaacccttgtgcattagacccttagcttccctcccaagagacaattatggtttctagtgtatgaggttttctcctagagatatttttgcaagtataagcaaataggtatctattttcttccctaagatttccctacaaatactagcattccatatatatacagtcctatattttgccagaggatgttacatatcagtgcatgtaggaattccttgttcccttttttaaaaaattggtttttatttttgttaaaagtattcatgcagacggcttagagtcaagtaatttttgaaggcttattaagaaaaatagccatcctctgctacttctcaactcctttaattgattttttttttttttggtatttaccaccatatctctgaaaacaacacttgatcattgtgctgctatcttaattttgttttcaattttaggtatcatctattgactttcctccatgaaagatgaaatttagctcattcaccctctggatttgcccctatttcctcgttccaacacacatgcctcatatcagagtcccagtataattttatcttagttttgacaaactcagtgttcagagtttccattattatgactatgtaatgctatctagagtttacattattatgattatgtagatgttattcaaagctgagctttgcactgctttgtgactatttttcttctttctgtatgacttttctttttcctggagttagcaattgccttttttttccccaatcttgttttccatgtatttaaccaccaattctgccccaaaatctctttctaaatgtgttaatctccttttaatatgtccagacatgtattggatatcatattgatatcatctccttgaatgtgatctctactatagccttctgatctgccctggctttctctatagctagtaactgtcatataggatctttttcaccatccttgaaattccccttagtgctttcatagtggattccttgtttcccagttttcatgtcttcctctttcttgctttactctcctgcttaaatcaagcactttgtccagtagcttcccaagaaagaatgtacgtgatcttgaggcattgagaacttccatatctgagaggcttgatgcttctctaacacttaaaggatagtttagttgggtttaaaatttcaggcaagaaagttgttttcagaaagttataaataactttttttgcctgagctttttaaggcatttgtgttgttgccttctagtttcagttttgagaagatgaaacccaatctgattcgtatgtgtgtatgtttgtgagtgtgtgtgtgtgtgattatattcaccttcctggctgggaatattcttgatcctttgtacatgaccagtttttgtttttcctccttctctagaagcttttagactgtctttgtacccctattcaggatgatgggacttgctatgagtccatttttatttgttatcctggacacttagtggcccaattaatctataaacgtgtgtccacaaattctgggaaatgttgcaaattatttcattgatgctgtctttctccctgtgttctctgtttctttttcttagaagtctttttatttccataatggaattcctagaccaatcctataatttaaatctctttcttttgtcattttcatcactttaatgtttttaatggtattttctgggcacttacctcaacttttttccctaacccttccattgcgttttaaatttctggtatatattttattaaattccaaaaattctattttatttttaaatgtttctttcatatgacattctttttctgtggttgcaatatcctgtttctcagaggatatttaatgcagagtctatttcctccaagatacatattttcctaattgttttaacttctgtctgtcatattagtggatttcttcagatgtcttgggattcttggctatccattcatcttggatgctttagtacacaggataccaaattgttgatggaagctcagtgcttataggatgggcttgctgatgtgcttggctataatatgaaagcactgggctaccccattaggacacttctgtttcgtctttcagtcttttgttcatgggctaatctgattcttcagagaaggtttgtagaaaaatcttctgcctggaggttaaagatttgtctagcatcattttgagggtctagttgaaaagaagctgagggtttcaaaatgtgcagtgaaatttgtacattataccttccttctttcagtatggttcctggtgtccccccaggacggagaccctctgtttaaccctcaccagagactaaacccaccaccttctgtggggtgtgagaagggcagtcacttggcttcagggagtgtagaagatatgggaggggtctaacagtgccttatatttgacccagtccttatgtttttgtctcctccttgatcttttcttccagaggcccctggcattgccagtttctgaggtttggggcagaaatggggaattcggtgttgaaattaggtcgtttcccacctttcctcactgctcacctagacttttttcttggtacctttttttttttttttttttttttttttttttgagatggagtttcactctcgttgtccaggctggagtgcaatggcatgatcttggctcactgcaacctccacctcccgggttcaagtgattctcctgcctcagcctcccaagtagctgggattacaggcatccgccaccacacccggctaatttttgtattttaaatagagatggggttcaaccatgttggtcaggctggtcttgaactcccgaccttaggtgatccacccaactcggcctcccaaagtgctgggattacaggcgtgagccacggtgtctggactttttcttggtacttttcaacgcttatcccattttctgtcttccaagatggctttgctgttctcccctctctagttctttttaaactgcctcatgtatttttacactttttggtttgtttgtttttttttgggggatggagtttccctcttgtcgcgcaagctggagtgcacgatctctgctcactgcagcctccacctcccaggatcaagcgattctgcagcctcagcctcctgagtagctgggattacaggtgcatgccaccatgcccagctaatttctgtatttttagtagagacgggttggccaggctcgtctcgagctcctgacctcaggtgatccactcacctcagcctcccaaagtgctgggattacaggcgtgaaccaccacgcccggcctttttacacttttttttttttgccttttcccccctcttttgtgtggagaatggggtcttgttatattttccaggcaggtcttgaactcctgggctccagctttcctcatgcctgtgccttcctaagagctgggattccaggcatgagccaccatgcccggctaaactggttcatgtatttttggaaagtcttttacagttattttagtaaggtttaggaaggaagagagctaaatgcatgcactcagcctaccatcttctcatgggaattctctcatgccttcttttacaaagaagtgataataataatcatggatttttattatatgcttcctataaagctcagggctttacagaaatattctcagttaatctttaccacaaacctacaaggtggacaggaccagattaggaattttaaaattaagccctgaaactattaaggtgcaggcatatgtcataaaaaaaaattaaattataaagtaaagaaggctgacaaaattgtttttgtttttgctttttttagagacagggtcttgctctgttgcccaggctggagtgtaatggtgcgattgtaactcactgcagcctcaaactcctgggttcagcaatcctgcctcagcttcccaagtagctgagactacagagatgtaccaccatgctcagctaattaaaaaaaaacaactgttttttgtttgtttgttttgagacagagtttcacccctgtcacccaggctggagtgcaatggcacgatctcagctcactgcaacctccacctcctgggttcaagtgattctcctgcctcagcctcctgagtagctgggattacaggcacatgccaccatgcccagctaatttttgtacttttagtagagatggtgtttcaccgtgttgaccagactggtcttgaactcctgacctcaggtgatccacccaccttggccttccaaagtgctgggattacaggcatgagccaccgtgcccagtcttttttatttttgagacaggttctcactttgtcacccaggctagagtgcagtggcacaaacacggctcactgcaggcttgacctcctaggctccagtgatcttctcacctcagctccccaagtagctgggactgcagccatgcaccaccacacccggctaatttttgtattttttgtggagacgggatttcaccatgttgcccaggctggtcttgaactcctgagctcaagtgatccacctgcctaggcttctcaaagtgctgggattacaggtgtgagcccactgtgcctagtgaaaaaactttttttttttttttttttttttttttttttagagataagatcttactgtgttgcccaggctggtctctcattcctggcctcaagtgatcctcctgccttgacctcccaaagtgctgggattatgggtatgagccaccgtgcccagcctaaagttgctatttttcccatgatgtttatcttcgtggtgcttatgaaatggcaactatggcattcttccttctcgtgcatgcctgtgtgggtgtgccctcagcatatgcttacaaggtttattgggtgatccaacgctagccgcaagagctattattagctcccttttacagctgggaaaacagactcagaggagtggagaacttgctgcagatttgttaagtgtcagagccaaatatacacttggattatcctgactccaaagccggagccctgctggtcagtcggtgacaccgggcaaccacagggatccccctcaatcccacggaaggctgtctactgtcttcatctcagagtgttgacagctcaaagcttaggaggctggagctaagttcaataaatgaacgtgatgaataggagaaaagcgccattaaagccctccagacaagaaccactttggagcccctccatgggtccctggggtgtaggaggggcaggaaagcagataagattccattctgagcctctgcacttgccctatgcaagatagccacaagtaatgttttgtcctcacctcattagcaacaaatggccacactcaggggattaaaaaaagaaataacagccagcctttatcagcttggggctcttggctaattcctctttaagcttaagacaactctgcgggtggagtgatccaaacgactttctccactttgcaagttcccacactcggctgtatccttctgcttgagattggcagccccctggggatggttcctgctcacccaactcccctgaggctgctccccagtagaggcagagagaggaagggcactgatgtcctcagggcccctgcaataggtcaggacctgggttcactgctccatcaatcccacattgctcggccctcactagcaccacacagggtgggtggcagcctccccatttgatcaatggggaaaactcagcacacctacttggccccagaactgagagtcaaacctggggacccagcttcgctgccctcagaatgttactcttccctcctgggtagcgtggtatagatagtgtagtattcttgtccccatataacggaagaggaaactgaggcccccagaaggctaagggactagcataggccttgtgtcttagcctgttaaggctgctatatcaaaataccatagactgggtggcttttaaacagatatttgtttctcgtggttctggaggctgggaagtccaagatcaagcttggtatctggtgagggcctagtgctgccttctcgctgtgtctcacatggtggaagggacctgctagctctctgggtctctcccccaatgaggattgaacccccatgatctcatcacctcccaaaggccccacctcctaatatcatcactttaggggtaaggattccagcatatgaatttgagggagacatgagcattcagaccatgacaccttgtaatcagaaaggggttaaatatctttggttgaatatcctgtcctgccgattcagaatcactgctgtctataacctcttccctagatcactgttttagatgatgatgataaagatgatattaacggcaattaccaagctcttaaatgtgctgtgggtaaaacaattttaagctctttctgaatccagtctctttcaatcatcttcatgcccttgaaaggtctggatttttgtcgatttccctggtgaggaaacgggccctgggggcagaggtgatagggtggagccaagaagtaattcccagctgtttctctgcagaggcagtgctgctacaaacacatctccaggaaggggtacagccaaatgcttctctgtctcttgtgggttttgcagtggctgtcagctatgtgtctggcccggttgggaatgatgggggactgtgtgtgggaatgaatggctctgtctggctggctcagtctttacagaggtgctaggagtgtctgtttggtgctctgactaatcatgaaaagttcacgtttttatctttattttatttttatttttggtacccatggtgcattacagggaagggagacagcaaaggagaattatttgttataaaatagtaaatattggccaggcacagtggttcacacctgtaatctcagcactttgggaggcagaggcaggcagatcatctgaggtcaggagttcgagaccagcctggccaatgtagtgaaaccccatctctactaaaaatacaaaaaattagccaggcatggtggtgggcgactataatcccagctactcgggaggctgaggcaggagaatcgcttgaacctgggaggtagaggttgcagtgagccgagattgccccactgcactccagcctgggcaacaagagcaaaactccgtctcaaaaaaaaacaaaaacaaaaacaaaaaccgtaaatattaaattgaaaaagggacatacttaagggagtgaacctgaaaagccccagctgacacttggcaacaccttccttgtttgttttgggcttttttgagacagagtctcactctgttgcccaggctggagtgtagtggtgtgatctcggctcacctgagcctcagcctctccaggctcaggtgatcctcccacctcagcctccagagtagctgcatacaggcatgcaccagtacaactggctaatttttgtattttttgtagagatgaggttttgctatgttgttcaggctggccttgaactcctgagcccaagcaatccacctacctcggcctcccaaagtgctgggattataggcgtgacccacagtgcctggccagcaccttccttgttaaattgcatgtgtcagccacctccctcggtgtcctcccagcctctgggcagtctggctccccattcctttctttatccaacagcatttttttgtgagacaaggccttgccctgttgcccaggctggagtggagtggcacactcatagctcactccagcctccaactcctgggctcaagtgatcctcccctctcagcctcccaagtagctgggaccacaggcacagatcatcacgcctggctaattttttgattttttgtagagatgaggtctcattatgttgcccaggctggtctcgaactcctggcctcaagcaatcctcccgcctcggtctcccaaagtgctggaattacagatgtgatccaccacgcccggtcattctaacaatattgattattagatgttgccctagacacagcctactgtgcgtatgtgtaaatacgaattgaatcatcccacaagtagctgctaagtagaggaggtccagagagtggggaagtgtagccctggggaccttgggaggacaggggaggcttccttggaaggtgaagtgtaggcttggctagggaacttgatataggttctatgaggctgctggggctggagcagagagaagggggagaatgtaggaggtaggagtggaggcccaagagggagagcgttggttttcctgtctcctacaccccttcactggccagttctgctttcatgtttttatttattatatattttttgagacagagtttcactctttcacccaagctagagcgcagtggcacaataatagctccctgtaacctcgaactcctaggctcaagcaattttcctgcctcagccttccaaatagctggggctacaggcacacacctctgtccacagctaattaaaaaaaatttttttttcatagagataggggtctcgctttgagtctcaaactcctcgcctcaagcaatccttctgcctcagcctcccaaagcactgggattacaggcatgagctcctatgcccagcccagttctgcttttacaataccagggcttcctgtaggtttggaaaacacctgttgggttgcagcaaaggctctcaaagtatctcttcttactcagcatgtcatcctaaccaactctgccgggagagtagagtggggagatgaaggctggagaaagagaagggccctcacttacagaatggcttaggtcatgggctctggagctgggttcacctcccagctctgccccggctattactttgtgcctcagtttcctcacttgtcccgtgaggatgatgactgtgcttactccagttgttacaagggtgattcggtcagtgtgtagggacacggtgcatggacaggacaagttcaacaggcattagcagtcagctgccgaggacccaccgtcaagggccatgcagtggccaccttcacagtcacaccacagaagatccagaacctctggcatctgcctccgtgcggggcattaggtagagagccacttttctgcaggcaatggaggctgagacctttcttctttactagcccaggggtattgatggccctgcagagacgggttttgattacctctcactggatcccccagcagcctgttaccagaaagaagggcagacgcagggagcctgggtctgtgctcagtccccgctgggttttctccttttatggtcagcctacagtgctctggcttcccagacagaatccaccagcttgtgtttgggcttgggccgaaatagctggtctgtggggagctgggtacctcctgggagtcctcaggcccacagcgggggaggaaccgctgaagccctttatcttctcaggaaacgtgcctggggccttacacatccgaggctgggtggggagtctggggaggaggaagggagagaggcatgtttaaggatggggtgtgaggtgacatgagccccagggatctgggctgggaagctcagccccaggcgggtcctgatgatggccggccgcccccagctccagccttcccagactccacggaggctcggtactgtgtccccgcccactttggagcttctgtcccaggccctctgcttgggatgctctgcctcgacctctccccaggagattctttcacatttttcttaatgctgttcagtggtcacctctgccgtgaaggcttcctgtcttgctcaggtcagtgtgaaaaaacaaacaaacaaaaaacctgacgtctatagcacttgggttcacatccatcgtagcactgctcatctcttacggtcatttctttgcccatctgactcccaccctgggtcatgaacttctcaaaagcaaggataagcaagtcatgaagctcggtgcattggcttgagcctgtgatttcagttacttgggaggccaaggcgggaggatcacttgaggccaggagtttgggaccagcctgggtaatattactaagttaccttactaggccctgtctctacaaaaaaaatgaaaacaaaaaacaaaaaaaccattagccaggcgtagtggcatgcacctgtagtcccagctgctcaggaggctgagatggaaggatctgttagcccaggagttccagactgcagttagctatgatcgtgctactgcacttcagcctgggcatcagagtgacacctcatctcttaaaaaagaaaagaaaaaaaaaagcagatcttattgacttttgtgctttcggtacctggctcaggactcgtttgttgaatgaatatgtgaacacgtgaatatgcattttccattgcttctaccttggttgcctctctgagccagagagcaattcaaaataacaagcatttcctgagcacctactgtgtgtcaggcattgttccttgtaccttcaggagctcattggttcaggggaaaagcattgaaaatgaacaattttgtaattgttggaaacctaatagagctgcatgaagtggaagaagtcagatttataatcattcagaggtggtataaaatgaacatcatttttaaaaaaggtttatgcggtataatttaaataaattcattttaaggatacagttcacacctaaaattgcagctatgtctgcataactgtctaaattcactcataatttacatggttatgcagccattgctgcaatataattttatatttctatcatcccccaaagaaatcttgtgcacatttttttgtcactccatattcctacccgcagctcctggcagccacgaattcacaaatctactttctgtctctatggatttgcctattctggacatttcatataaatggaatcatatgtgaccttttgtggctggcttcttttttttttttttttttttttttttttttttttttgagacagagtgtctcactgcactcgcccgggctggagtgcagtgatgtggtctcggctcaccacaaactctgcctcctgggttcaagtgattctcctgcctcagcctcccgagtagctgggactataggcacgtgccaccacacctggctaatttttgtatttttagtagagacggggtttcactgtattggccaggctggtcttgaactcctgacctcgtgatctgcccacctcagcctcccaaagtgctgggattacaggtgtgagccaccgtgcccagccggctagcttctttcacttagtataatgttgtcaaggttcatccacgttgtatcatggattcatactatttatatattttttaagacagggtctgtctctgtcaccccagctggagtaccgtggtgcagtcgtggcttactacaacctccacctcctgggctcaagccattgtcccacctcagcctcttgagtagctgagaccacagggattgtgccactatgcccagctaatgtttgcatttttttttgtagagatagggtttcaccatgttgcccaggctggtttcggactcccgggctcaagcaatccacctgcctcagcttcccaaagtgctggaatttcaggcatgagccatggccgccggccataacatcctttcttttcatggctgaatactatcccactgtctgggtagaccacattttgtttatccatctacccattgatgaacatttggttgtttctattttttggatattatgaataaagtccataatttttaccaatatggaaaagaaaaacaagaaaaactctgaatgccatatcatggatagatggcctattatcattccatatcatctgtacctttttccgccagaatgttttgagacatttattaagtaaggatcacaatgatgataattactaaaatggagagaacctgtggaccatgggaaccactaggccatgtgacactcatgtttatattagagaaaggcaccgttttctcaaagcacttttcctccatctgctgaaagattattacaataaatacacaatgcaatacaataaatgaccaatgcaaatagtttctccatagagttatgcagtgtacaacatgcaccacggtccatggccatcctgcaggtaggaggtcaagtggaaaggtctccaactcagctctagaaaagtgcagagttagagaaggtatcatagaagagttgactcccaagacgatgtttcagatacagattagggtatgtacccgaagaattgaaaaggtactcaaactaaaacttgtacaggaatgttcatagcagcactatgcagaatagccaaaaggtggaaataacccaaatgtccgtcaactgttgaatggataaacaaaatatgatccatccgtacaatgtgatatgactcagccacaaataggcataaagtctgggacctgctacaacatggatgaacttcagccacatgctgagtgaaagaagtcagacatgaaaggccgcacatgttataattccatttatgcaaaaatatctagaataggtaagaccatagagacagaaagcaaattggcggttgcaagggcttatgggggagtggctgcttaacgggtagagggtttcatttgggggtgacagaatattttagaactagataaaggtggtagttacgtaacattgtgaatgtactaaatgctcctgaattatgcactttagttatttttttatctttattactattttttgagatggagtctccctctgtcacccaggctggagtgcagtggcgcgatctcagctcactgcaaactccacctccctggttcacgcgattctcctgcctcagcctcctgagtagctgggattacaggtgtgcaccaccgcgcccagctaatttttgtatttttggtagagacggggttttgccgtgttggtctcaaactcccgactttaggagatccagctgtgtcggcctcccaaagtgctgggattacaggcataagccaccgcacctggcttgaattattcactttaaaatggttctttttatgtagtgtaaattttacctcaatggaaggaaaaaagagagagagagagagaatggattaggccagagaagaagtggtggtgggtgcactgggcagaagaaatcacttgtgcaaagcaaggagggagtgaaactgctttgtacggtggagaacactgcttttgagtccaacacaagctcaggcttggggaaggaatcagataaaaatttccaggatctcagagttccctgtgctccacacgggttggcagacagcacccacatggagtccttctgctcgtaaccagcaccctgcaagcttcccacgcctggaagtggtgtgtttttgatgggaacgtcaggccagaggtctcccagcagcccccagctcggagccgcgctggcagctcccaggccttctcctggagcccgctccctctcctgggggccctgtgagcatctgagcctataaatctctcctgctctgggcctaggattcacaaggctgccaggaaagcctgcctctctccctgaagtagtggatcaacacagcccatctgtctgtccatctcaaaatctttccttaagatagtggaggttgtctgggccggtcccaggaggttctctctgtctgggttctaatcacagggtacctggttcttctatccttcaccctcttttaaaaaatcactttttagtactttgggaggctgaggcgggcggatcacctgaggtcaggagttcgagaccagcctggccaacatggtgaaaccccgtctctacaaaaaatagaaaaattagccaggcgtggtggcacgcacctgtagtcccagctactcggggggccgaggtggaagaattgcttgaaaccaggaggcagaggttgcagtgagccaagatcgagccactgcactccagcctgggtgacagagcgagactccatttcagaaaaaaaaaaaaaattaaactggtttcccattttgctctgtcctcgagtgaatttctccccctgggtggaagctaaaggcacgggtatctgtctgtctccagagtataatggagagattaaagtttgattgcttttttcctgctttttttttctttgagatggggtcttgctctgttgcccaggctggagtgcagtggcaaaatctcaactcactgcaacctccacctcctgggttcaagtgattctcctgccttagcctcccgagtagctgggactacaggtgcctgccgccatgcctggctaattttttgtatttttagtagagatgggtttcaccatgttgcccaggctggtctcgaactcctgacctcaggtgatccacccacgtgctgggattacaggtgtgagccaccacgcccggcctcctttctcttataaatagggacaccattgatttaggtctcactccaagccaggatgacctcatctcaacatccttcccttaattacatctgcaagacccttattctaaataaaatcacaggtgggatacagtggctcacgcctgtaatcccagcactttgggaggctgaggcaggtgggtcacttgagcccaagagtgtgaaaccagcctgggcaacatagcaagacccaatctctacaaaaaatacaaaaattagccgggcatgctggcatgtgcctatagtcccagctacaggggaggccgaagagggaggattgcttgagcctgggaggttgaggttgcagtgagctgagatcacgccactgtacacccacctgggcgacaaagtgagaccccatctcaatcaattggttagtcaataacatcgcagtctgaggttctgagtgaacatagcttttgggagtcacagttcaacccaccctagtgaccttgggcaagttgcctcacttctgaacctcactctccttatttgtaaaatggaggcaatgccagtgcccaccccaggagctgctgagagaattcagtgggtcacttcaacacagaagttcagcatacgcctgcagtgcagtgagtgctcgggagatcggagctgttagtgggatcctaatgcggtggctctttcttttctgtctttttttagctttgtggtcatgatggtttcataaagaacaataccgactctttttctattgaccatttttggtgggatgaggaaaagattgtatgtgttcatagcacaaacataaccaggatagaagtagaatgggtgaaagtaggtcttcctcctgtcccttttctcaatacttcaggctcaggcctgtttgttggttttttttgtttgttttgttttgtttttggagtctcgctctgttgcccaggctggagtgtagtggcatgatctcacctcactgcaacctccacctcctgggttgaagtgattctcctgcctcagcctccggagtaccttggattacaggtgcatgctaccatgcccagctaatttttgtatttttagtagagacagcgtttcaccatgttggccaggctggtcttgaactcctgacctcaagtgatctgcccgcctcagccttccgaagtgctgggattacaagtgtgagccaccgcacccatcccaggtctgtttttagagatagggtctcactccattgcccaggctggagtgcagtggtgtaatcacagctcactgcaaccttgaactccttggctcaagggatcctactgtctcagcctcccaagtagctgggacaaggggtatgtctatcacacatagctaattaaaaaaaaatttttttttgtagagactgggtcttgctatgttgtccaggctggtctggaactcctggcctcaagtgatcctcccatctcagcctcccaaagtgttgagattacaggcatgaaccactgcatcctacctatatatctgtctttttaaaacacaaaaggtataacactatgctacctcatcttttatttttagcttaatatattttggatatttttctgtgtccatccacaaagctctgcctggttcttttcaatggctgcctattttatttatgtatttatatcttatttgtttttgaaacagagtcttgctctgttgcccagcctggcatgcagtggcacgatctcggctcactgcaacgtccgcctcctgagttcaagcaattttcctgcctcagccttctgagtagctgggattacaagcgtgtgccatgacacccaactaatttttgtatttttagtggagatggggtttcaccatgttagccaggctggtctggaactcctgaactcaagtgatccaccctccttggcctcccaaagtggtgagattacaggcatgagccactgcgcccggcctgcctatttttaaatgtgccattatataaacacaccagaattgaaaccccagagctgactagtctttaggccttttgtcttgaggatttcgttcaaccaggccacccaaacatccatctataatccgagggaagagagagagaactgattggagttgggcatagaatctgaggaacgtgcccacatccaatcagttctctcttaagattacagatggaagaaagagtcatctctttcaccttgccttcttcagtcccatccatcctcccattcatattcccatccatccatccatccatccatccatccatccatccatccatccaactcatttaccggcctatacactctgtcctccctcccattcacccacccatccactctctcatccactcactcatccttccctcctccgtccaaccatccgtccaaccagctatatacccacccatctacccatctacacacccttccctcctttcttctttctttcttcctatctatccatccatccttccttctttccatccatctattcgtccacctacccacccacccactcatccatttgtcttcctgtctctctacctgtccatctatccatccttccatccagccatctgtctgcctattcacccagcctcccatccatttatcctcccgtccatttacctatccatccattcttccatccacccatcctttcttccttccttctttcctttcttccttccttccactcacttgcccatccacctcttcttccatcctcccatccatctactcatctatccatccattttcccacccatctgcccatccacccacccacctactcacctactcatctgcttatccaccctcccgtccatctgtctattcatccacccacccacccatccatctacctacccatctacccacccttccattcacccatctacccttccttcctttcttccttccttccgtccactcatcttcccatccatctactcatccatccctcaatccatccatctaacaagcataattcagcacctaccatctatgtgccagtactagagatacaatgtaaaaccaagcctaggagatttttgatgaaatgaagcttgtgagagctgagcactgaactagtaggactgaagccagggagtggatttaagaaatgcttgccactgtggcattgtctaccagcagatatgatgctgggatttctacattgttaggtgaccattgaacgtattggtaactgttctcagatctctctttgggaaggaaatgggtcttcagagcctggctccacctcagaggcctctttaagagtagaaggtgatggataatgtctgcttaatcacatctagttctttgatgacctctgtatcttttgggtttctctggtggtaaacaagagagactgactctgtcatctagtagaggaaagggatttgtaggggagtatggaggagctcacagttgcagtgggaacactaggaatcaggctaggtaaatgacagaaactgggctgcttgggcccaggggcagaaaggaagtctgcctcagggctctgtccacctgctgtgcttccctgtccttgactgagcttggagttttaggccagagagtctgaccaatgcagcctggaacacattcttacctctttgttgaaggtacttatgaggcagtcccactaagactgtacatgacggtaggggtgatgggggaaacctcaaggaccacaggatgcttctggaagaagaggaaatggatgctggatttacaaaaaaacacaaatgtgcacaatactatattacagatgaaggaactgaggcatggagtttaagaatatttgcccaaggccacagagcggagaagtggctaagggggaccccaatctgtatagatccaacatctgcgtttggtccctaacctaatctgggtggggtgggcctcccgggacacctccagagctgatgtggctggatgctaatgactcctggatcagtcaggctccagcatctttctggggctgcctctgggactttggggctgcccttttggctttggtcgtggcccctgtagcctgggcaatgagcccagctgacctgttgtcacttccaatgaggccagcatggagaagctttagaatgggagggccctgggaggagccaagtccagacccttagctcagagctcattttaattcatggctcttttttcttctttctgtttgcagatcgggaggaccagtccattctatgcacgtaagtggaactgctttttcttctgttttttttttgtttttttttttttttaatctgtagtcgagatccaacctatgaaagaaaagatccatgagtgcagagatctttgatttgttcatggttccaagtgcctctctttatacctggcaccatgtagatgctcactaaacatttgtgatatatggtcttctgcggaggcaggcaaacttaaactcttaatgacacctgctatcatttggttccatacctctcctccttctaaaaaactagcatttattgaacatgtactctgtgccaggacttgaactaaagattttatatgcagaatcttatctaattgcataacagccatctgtgttgatagggaagatgttaaactgtcactttagtatttcacatttatcaagccacaaacacatcagtgccatatttggtgattggtatcactgtttctttgaagacctaggtacataggcagaagatagtaactcaattttagaatcattgagagagttttcactattgtatttatatgcaagtaacatatattaatatatattgttgattcattgacattgaactcacagccagcagctctgtggctgatgcctggatgaagtttatctgatgtgtatttattacataatgggtatcacaactttattgtgcttggaaacatgagccaacacttgagcactatgctggggacatttttgtatgtgtgctgccgaagggagcacatctgaggggacattttaaactgcaaaataactaacaaaaagccacaaaaatacaaaaaaaggtggcactaaatacactacagaaaggacacttgtttacagtatgagagttgaaactagaaggtagagcattcccctgttcaacctgagctgggaacgtgtgcattgggggaatcgaattttccttactctgcacatgttcacaaatgactacaaaagtgccatgaatattgattttggggttacaaataactttcagcaggtcggtgaatttgaaaatatagaatatataaataatgaggatagactgtgcatatatatatttacataatatataatatgtattatatttaatatatttatatttatatatatatatatttgaaggtctggaagcaactaaagctataatcaacagaggttatttaaataaaatatagcatttccaggtagccactacaaagagtgaggctgatctatttatgctgagagagaacgctctttatagataataccgttgagtggaaaacacaggggcaaaccagcatatgcataatgtaaccgtgtgtgtctttaaaaagagcaggattgcatggacgtgcatatgtttcctatttgcatgaaattatctggaaggacaattaaaaactagtaattagaatttcagatggtgatggatggtaggatggcaatgaactgtattgagagaagattgaaacaattaataagtttggggttgatatagatagaaaacctggaaacaataaaacaaaggcaattataaactccaggaaaaaacaaaagttgggatggaaggagaagtaatcacattggactaaggagcccagctgtgcaagtttggagtatttatctaaccagaataactccctgtgatggacttggctctgtggggaaagggaagaggattagatgggaactgaattctcatattccatggtaggatgtacacatttgatgtttgacaatgaatagtctggatctagagatataatgctacctagctatgaggatataaatgctaaaacaacctgccgacttggtttcctagttttctggcttctaggggtcacctgcattccttggctcatggtctcttcctccatctttaaatcctgcagcatggtatcttcaaatctctttctctggtccccctacctctctcttataaggcccagtacctttgtggttatattagccccacctagatgatccaagacagtctcctcatctcaagcaaacatattcacagattctgaggataggccatggacattcttgtgggggctgtttttcagctagccacagaggcatttgatcccctaggagccaaacccatgtgtgagccacatgtcatctccccaggaaccaaaatagtgtagctcaactgccctctgttgagtgaatgaattaagtgtggtaacagagaggtgcaggaaagagtaggactttcagatggcttcctagctatgtagctatgcacgggtcacttgacctctctgagctgagcttatggagaggctgtgaagatgaagaagaggccaccctgctctcatttccagcacccatgccatcagcaggtgctgtttcatctaaaacggtgctatccaaaagaactttgtgatgagcacaaagttcacttaaaagttcacttaattgagctcttaaaaagtggcaagtatattgcagaactgaatttttaagattttagttaatttagatagcggttcctgccttggacggtatgatgctgaaatatttctcatctctgtccattcctctgactccaccgcctcttcctagttcagggtcccgtcacctctcaccagggcctctgtagcagtctcttaagctccctgctcccattgcttgcttgcttccttcctttaataaatatacattataagaatattcactcattattcattgaataaatattcattagcatgctgtcataaagtgtggattccagaacctaaccccttgggtttgaattctggccccatcatcgtctagttagttgtatgctccaggaaataagtcagttcacttctctgagcctcagtttccccatctgtaaaatgggaacaataagcaccccattgggttgttggaaggatgaaatgagtcactacatgtgaagaactgagaaacaggccactgccccatggtgagcactttgtaaggatcagctgctattgtagtgaaagtgctcactattttttaaaaatccttcctgcaatccagtatccatcttgcagtttgtttgtttgtttgtttgtttgtttttgagatggagttttgctctcattgcccaggctagagtgcaatggcgtgatcttggctcacagcaacctccacctcccaggttcaagtgattctcctgcctcagcctcccgagtagctgggataacaggcatgtaccaccatgcctggctaattttgtatttttagtagagacagggttttgtcatgttggtcaggctggtctcgaactcctgacctcaggtgacccggggagcctcggcctcccaagtgctgggattacaggcatgagccgctgagcctggcccatcctgcagtttgttgttgttgttgatttttttgttgagacagagtctcactctgttgcccaggctggagtgcagtggtgcgatcttggctcactgcaacccccgcctcctgggttcaagcaattctcctgcctcagcttcccgagtattatgccatcatgcccagctaatttttgtattgttaatagagatgggttttctccatgttggccagcctggtctcaaactcctgatctcaggtgatccacccacctcagtcagcctcccaaagtgctgggattacaggcatgagccacttcgcccagcccatcctgcagttctgattctccccacactggttctaaagtcccgttcccctcgtgaaatggtttcctgcacccatgagaataaaactcagattccttactgtgacttggaagactgagtgtgatctgctcttccctcttcacttcctgctgtcctcctctgttgtggccctccagccatgctgggagccattctgtctcatacctgggcccagcatttccctcccttggacctctgtccatactgtttgccctgcctggcccacccttccctccatccttcccacagggctctcttgtaactttcaaggctcagcaactccctggcttccccatccacagcctcccctctcctcccttcccctcgatcttctcagtcacatcacccagatgtagcaatgatatctccaccacgaactatcttgattatttgtttacttggctattgtgtatctccatctcctggaatgcagcgttagcaaggacttggcacactgcccacacacagccagtgctggagaaggaggccttagccattgttaggaaggaaatcccaaaacgatcagacttttatttgcaaatgcatccagtcagcccagaaccaccaacatcttcagtctctgtattcaattttattttgcttgttgtgaaattcagccaaagtgacttgaaggacctacaagttgacagcagggctgagcttttacgcgtagttggtgcttaagagaagccaggctggagccaactgtttggttatgcagttaagaaactgaaaattggccgcgcactgtggctcaggcctgtaatcccagcactttgggaggccgaggcgggcggatcacgaggtcaggagttcgagaccatcctggctaacacggtgaaaccccatctctactaaaaaaatacaaaaaaattagctgggcatggtggcgggtgcctgtagtcccagctattcaggaggctgaggcaggagaatggtgtgaacctggggggcggggcttgcagttagcagagatcgcaccactgcactccagcctgggtgacagagcgagactctgtctcaaaaaaaaaaaaaaaagaaaagaaaagaaactgaaaattggccacgcaccgtggctcacgcctgtaatcccagcactttgggaggccgaggcgggtggatcacgaggtcaggagttcgagaccatcctggctaacacggtgaaaccccatctctactaaaaaaaatacaaaaaaattagccgggcatggtggcgggtgcctgtagtcccagctattcaggaggctgaggcaggagaatggcgtgaacctggggggcggagcttgcagtgagctgagatcacgccagtgcactccagcctgggtgacagagcgagactctgtctcaaaaaaaaaaaaaaaaaaaaaagaaaagaaaagaaactgaaaattggctgggtgtggtggcttatgcctggaaactcagggccttgagaggccgaggcgggagggtggctggaagccagaagtttgagaccaaactgaggaacacagtaagaccccattactacaaaaaatttaaaaattagctaggtgggatggtgcatgcctgtagtcccagctactcaggaggttggggagggaggatcacttgagcttgggagttagaggctaagtgagctatgatggcaccactgcacctcagcctgggcaacagagcaagacccagagacaggaaggaaggaaaggaagggaaggaagacaagaaaggaaggaaactgaaagctgaataaatgtaatttttaggcctgagttgtattttgtctagcatgtaatccatccagtataatcagtttaattagaggccatgggcctggctggagatagagctgtgtgatcagggggctaaagtaagaggaggagggtggtttcacataaaattagagagaggtaagggggtgcttccaggccctggggaggagtttaaactttcgtctaaaatggatgacaggctgggcatggtggctcatgcctgtaatcctagcacttcgggaggccaaggcaggctgatcgcttgagctcaggagttcaagaccagcctggccaacatggccaaaccccctctctacaaaaacaaaaattagctgagcgtgatggcatgtgcctgtagtcccagctacttaggaggatgaggcaggaggatctcggttcactgagcctgggaggcagaaagttggcactgagccaagactgcaccactgcacttcagcctgggtgacacagtgagaccccatctcaaaaaatatatataacaataaaataaataaatgaaatggatgagaacgtgctaagggactcaagccaaggaaggacaaagtttaaccagtgggtcaaatcaggcccttgtctgtctgttccagataaagttttattgaaacacagccgcacccacttgtttacgtatttgcttttgtgctgcagtggagagctgagcagatgtgacaaagaatgcgtgaccctcaaagtctaaaatatttactgtctgaccttttacaaaaagagtttgctaactcctagcttaaacagtgggaaaatgtgaatattatttatattgtaatgataggatgaatgctgaaaatcattatacaaacaatatataacttctgtggaagcagtggttataaaagtaataataggtgggcacagtggctcacacctgtaatcccaacactttagggggccgaggcaggaggattgcctgaggcctggagttcaagactatcctgggcaacttagcgagaccccacaaaatcaaaaaattagctaggtgtagtggcacatgcctgtcatcccagctactcaggaggctgaggtgggagggtcacttgaacccaggagttcgagattgcagtgagtcaagattgtgccactgcactccggcctgagcaagaagcaaaactctgtctcaaaaaacaaaagtaataataactaacattttggcataccaggcattgttctaagcattttatataaatgttcactcatttaatcctcataagaatcatataaaaggtcaggcatggtggctcatgcctgtagtcccagcactttgggaggctgaggctagagatcacttgagaccaggagttcgagaccagcttgagcaacatagcgagacccctgtctctacagaaaatttaaaaatcagccagctgtggtggtgtgcacctgtagtcccagctacctgggagattggggcaggagtatcacttgagcctaggaattctcagctgcagtgagctatgattgcatcactgcactccagcctgggccacagagtgagatcttgtctcaaaaaaaaaaaaaaaaaaatcatacaaggtaagtgtttttattatacccattttataatggggtaaagaaactgaggtatggagaggctaaatgacttgcctaaggtcacccaggtaactggcagaggagggatttgaacttgagcaacctggtcctggagcccattatgctattctgccaattgatgctataggggagagaggcgttgcttctgcctggggttttgcaggacgtgtaggagttgtacagtacaaaatgccagggtgctttgccagtcacataaagaccagggactgaatagctgtgaggttcatcagagacaatttggctttcctaccagtggcaaaccacaggctgcaatggacttggcaatattcgaccctgggagccaggaccagctgcagaatttgtagaattttgcaaaatgaaaatgctggctgagtgcagtgactcacacctggaatcccagcactttgggaggctgaggcgggcagatcacatgaggtcaggagttcgaggccagcctcgccaacatggtgaaatcccatctctactaaaaatataaaaattacccaggcatagtggcgggcacctgtagttccagctacttgggaggttgaggcaggagaatcacttgaacctgggaggtagaggttgcagtgagccgccatcacacactgcactccagcctgggcaatagagcaagagtcagtctcaaaaaaaaaaaaaaaaaaagaaaagaaaaaaaatgcagagcgtttataaagaattaggaagaatttccagatggcaacattagagtatgaagcacagggtggtccctgtgagacggtacaggtcacactcatgaagccagcctggctgggggattaagtggccattgggtggttcttcccagctgctggggctggactgattaaaaggacttggcactggggtagttacaaggccaggaggccataacgtggtcatgagtctggtccttctccgggaagagggagctcagtaccaaattccccaagaaataagaaaggagtttagggtgctcagaccaggaaggcatcttcacccctagaggtcaggggtcagaaaagccaagctatgaatgtttctagaaccagctctaagcacatcaaccttcagacgcccacgagcctggagcttgggatgttttctttggcagaacctcccagggcaatttatttttctcaacagaacttggaaacagtggagcccagcagcaacatgggaaggggtagatgcccagagtttatgtcccactccccatcccaggcaaagtgggagaccatagccacggatagggcacattgatgtctttgtttttttttttgtctgtctgtttgtttgtttgtttgtttgttttttgagatggagtctcattctattgcccaggctggagtgcagtggcacgagctcagctcactgtaatctccgcctcctgggttcaagggattctcctgcctcagctccccaagtagctgggactacaggcacccaccaccatgcccagctactttttgtatttttagtagagacagggtttcaccatgttggccaggctggtcttgaactcctgacctcaagtgatccacccgcctcagcctcccaaagtaccgggatgacaggcgtgagccaccacacccggtgatgtctttgttgtaaaagggaggaggtgagagaggttcaaggccagggtggaaaggaaggaactattgtgggaaaggagaagtgagcagcagcagtctaggagcactggtttgtcagcatgaagagtgtgatccacacatgttgtttgtgcacactgctgtcctgattcttgtcttggatctgaataggttcatgaccacctacgcaagtggtttcctacatccaaaaatttctctcctttctcttgctttaatcagaatccaaccccttcactttagaatgaagtcaagcaaggttctgacgttagcctgattgaagtaattcatacttaggtgtgaatgactgagtggcttggttcattgattggggcaagtaaagcctcctggaatatatggcagaattccagtggagtggggctgggacttcactctgtcttttctctttgctgatttgttaaaataaaagggtaggaggcagaacatgggccctggtgtcaagtggacctacgttcaaatcctgcttctcctccatttcctatctgtgtgaaagcaggagcaattgtgggctggagcaatttacttcaaacctctctttgcctcagtttccccggatgggtgatggggataattaataactctctcattagattgctgggtagagtaaatgaaaagatctgtgagcccaaagcctagtactgtgcaggccttcaacaaatatcaattccccttcccctgcccttcttctggccttagaaagcaagtccctagagggttgggcctgtgtcatggaacaacttggtgaaatgtagtaaaaggaattctgactgcattagaatcagagacctgactttccattctgactgtatcccttctttgctgtgtgacctagggaaaattgcttacccactctgggcaagactcttccttctataataacatggaagcaggaagaggataaaggaaataattcatgtagagcatttagcaaagggacccttccccctatatccccccaatgacaaacgccaattcttctctgtcttaagagatgggatcttgctatgttgcccaggcttctctcaaactcctggcctcaaggcatcctcccaactcagcctcctgagtagctgctattataaacgtggccagttctctgctgcacctggccagttctcctcttttacacacacacacacacacacacacacacacacacacacacacatatattctggtcttagtttccccttctggggaaatggggtaatgccttcatggtccccatttcataaactgcctctgaggccatgtgaaataatgtggccattgggaaggaaggcctctaggaagggaagggaccacacaaagtcaccgcaagatgtttcatcattcttggccatcagacacttgatttctggacagtgggacctgtaggattaggcacagcaatttggggcactttttttttctttctctttcttttttcttttcttctatttcttttttaagccatgagccaagttattaatgggcctttggcagagaaaattaatttctttatttcctaattaggaagaagagcagagactgtactagctttggtggcactggttcagcacagagaaccttgggctgacctcggggtgaacaaattcttttttcaacttaaaaaaaaaactctcttatattttagagtattaagtgagctcagaaaataaaagagataaggcaaagaaaggaaacacaaaaaacaaaagtaaactgaaaaatagaagaagacgataaacaagtgaagttttggtcaaggcactgtccttatctttcactaggagtggtggaacatagaggcagtatctggatggagcggttccattgtgatgatttctggtggccaaaacaggcagctagtgcacgaaagccatcttggtaaaaaaaaaaaaaaaaaagatctaccttcatattccaggaggacatacttttttgatacgacaaaccatgtcgtgctgatctaaacatatcagtcatttacactttagtgtgaattacttcaactgggtttattcttagatacttggctgagatcatcagccagcttcctgatacatggggtgggattcctcagaggataaaggggcttgcatctgcccagtgaccaatgggataaccggttttttggtaaatttttctttccataagggagcttcttaaactttaggtcctggtactccagaggcacttacatcctttcttgaaggctgccttgtgcctggtctttccatttctagcaatgctaatgatgtctgcaggcggatcacgaggtcaggagatcgagaccatcctggctaacatggtgaaaccccgtctctactaaaaatacaaaaaattagccgagtgtgctggtgggtgcctgtagtcccagctacttgggaggctgaggcaggagaaccagggaggtggagcttgcagtgagctgaaattgtgccactgtactccagcctggggacagagtgagactccatctcaaaaaaaaaaaaaaaaaaaagtagataattccaaataaacctgtttggacctatgtaagaaaactaaggttttcttgttcactctatttttttagagatgaggtcttgctctgtcacccaggctggagtgcagtggtgtgatcatggctcactgtggcctcaaactcctgggctcaagccatcctcccacctcagcctcctgagtagctgggactacaggcatgcaccaccaagcctggttaatttttcttattttttatagagtcagggttgtgctgtgttgctcaggctggtcttgaactcctggactcgagtgatcctcctgcctcaacttcccaaatagctgggactacaggcatgtgccaccatgcctggctaatttttaaatctttttctagaggcagtgtctctctgtgttgctgagctggtctcacactcctgggctcaaatgatcctcccacctcagcctccccaagtgctgggatcacaggcatgagccaccacatccggcccaccttttcactctttgtatctgaattcttttctatgtcctcttggaaggaatagattgggcattggacctaggctggggacccagttccgctcactaccagagatgtggccttgggcaagttacttcccctctgggagcctctgtttcaccctctgggaaatggtggtgatgatcattattgtcctgcctggctcatggaactgcggaaaggtcaccatggaacgtgtgcatagatgatgttcccgtgtctttcagaggcgagtctggagccgggaaaaccgaaaacaccaagaaggtcattcagtacctggccgtggtggcctcctcccacaagggcaagaaagacacaagtatcacggtgagtggcagttcccaatcagaggccatgatttagccaaccggtctccagcttgcagcccaaccgagatacaaacagaacatcattgcaagaactcaggccccatctgactacccctcccctgaagactcaaagagggaccgtctttttggcgagcaggcctgttgagtgtgggtgatttcttggctcagctagaagcatccctccagaagggggcccgttttgtgaaatgagaataagccctttccttccatagcgagatcttcctccacgtcggggcttctcagtggtggcactgatgtcattttggaccagataactcttccttggaggggcttccctgtggctcgtagaatgtttcacaacatccctggcctcgacccgccagatgccgacagcccccttccctccagttgtgacaaccaaaaatatctctagacattgtcagatgttccctggggtgggacagttgcccttgattgagaagcactcctttcatgaatctctgtaacgtcccaggggttaaggtaccttttgggttcccggattcctccacgtgtccccctgtccctgggatggagatgctggtatcactcggcccgtgggcttcagtgcaatgccattcagtaactgtggattgagcacctactgtatgccaggaaccacttggggtggggacctggggataagtctgagagatgctgttattctcttctctgagcttccagacctgtggaagagcatgtagttgtcaaagaatccctcaaataaacagatgatgacacggtatgactaagagcttgggaggaaaagaagagcaggtttctagagtcatcacctctagggcccatccttctcttcctcctcgtgtgtcagccctgccccatctatcccacaggagggggcacgtggtagggccgctaggactggccggtgcctccgtctgcaggtttgtgggtgggaagatggtaggatggagatctgaccacggcatggggtgtctccagtgttcgccattccagatgtcactttgcgtcctcagaggggactctggggcagccaccatggccggcttgtctggaggcccttggagatctaggatgggcgctggtcgtggctttggagaactttccttctccaaacaaatgcaggaaactcaagattcagcatcctagaattgtctctggcaagttggtttccagccatagtgagtgggaacaatggccccagaggctgtgtggcagtttaaacacagtttccactgccttccctttccctaaagagtaaacacaggagataatactttctaacaactcatcgttatcaagggcctactatgtgctgcttgttttggctgcatgcgtaaacacatctcagacattgtctcactggatactgttttaaggagcctaatgtggccccagtaattatgaaaacctttgaaatgtctggatctctaagaaattagaaaaaggagggaatggctgagcatgggggctcatgcctgtaatctgtgttttgggaggccaaggtgggaggatggtctgagcccaggagttcaggaccagcctgggtgacatagtgagaccctgtctgtaccaaaaaaaaaaaaaaaaaaaaatcaagagaattagctgggcctggtgtgcatgcctgtagtcttagctacttgggaggctgaggcaggaggattgcctgagcccagtaggttgagactgcagtgagctgtgatcgtattcctgcagctaaacagagagaaaagaaacagtatcaaggaaaaggagctgaccagtctgtctgggagactccaggctgtttggggggatcaaagtcatatattctccagcccctgatgtccatgtgatggaaataacgctgacatttgttttatactgtgttgttcaaccacagcaaggcccatcttttgcctacgtgagtaactgagagtgttttcctggtgtgtaggggaggcacggagtgaacttagatctgcatgatcctcttgcacccaccgagtcccgtagctggtggtagaaatggggtaggccctagagtttcacaacttaaatcagtaaatgcaccaaaataccatcctgtgggtgtctgatgccagggaagggtgtgggggtgcatttaccacccacgggacgcctattggagtccccagggttgcgctccagcctgaaatggatttctccggttcagaatgaacccctgcacccttcaaagcatccgctcctggtacccttgactggaacaacctagacagagatgtctgtcccatctggctgagtgttttaggactgtcaggccccaaagcttccctggctcgatggacagtcgatggcacagctgtggcatgcctccctcttctctccctgccatcatccctaagtgtcttccctcagccctgtccctggtgcaccagtgtgtccctgtgcatgcgtgtgcagtgcgtgtctgtctcttgcatgctggttgcttgactcaagcctccagaaacagtcttggaggtcgcgatgcactagctttggtggcgcggtaaggccccagctacgcaacgcataacctggtcctgcttggacctgtgcatatgtaaactcatctctaacacagagcttggggggctgatgtgtgggtcccagcctagaagaaacccacaggtgtcttccttggctcccgaaaagatcattcaatccatcttagttagaccctgggtgactgtgttgcagatcagaaggagaattacagttcttatttgggatctgcttttgtgtgaccttggccgagtcagttaactcctcggggctatggtttcatcatctataaaattgagggtttgaaccaggtcccccgatttaaagctctcttgccaagacttttcaaccttacctgccagaatccccattctagaaagggagcctttttcagagagcatggagaccccaagtttatgtgaacaaaagtgattcctttagtcgtcttcccaccaacaaagaaatgcccgtggtgctccttgtaaatttccaccagtctcagctgtggtgattccacttgtagctgagatttgtatgcggatgaggcttttgcttcatctttctctgggagctacaaaaaggaggatgtgtggacaaatcaaaacagaaacaaatagcagcttcctgctttgtcctgtagaccaggtaccctgatgccttcctagcatgcggaggaatgaggaggaagccatgcccatccttgtcccctctagacactttcccggctcctgtccagcccagccctgatgcctggaaaaataaggaagggaaagcaggaggggaggacaaggagaaaaactcccagaatccagggcctggaggcctcggggcccaactgcagccgccatgttttagggctaggccaagagcagctcgtttgctttcccagcttaacttaccacattggccctttcctgccatgattaatcacgtgaccgcgtttgtgcaaaggcatcccggcagagggggccggtgggctgtgtacagtctcagcttcctttaacccaatgaatggagctcaggcaacctgctttgaagctttattccgcagtccgctaagaggattcctggtgggttttgtgcattccttacttgtctgctgtagaagacttcagaaaaccagtcctgagaaagaaaaaattgcaacttaaaaaaaattgcactaaaataattagaaggaggcttgtagtggtttaacttgaagaaggctgcttgttaaacatgaacagcagcacgactgccatgtacagtgggacaggtggtgcactgcacaactccggggggcaccattcatcatgatgtaaatgacatcaccgacattgtgcaaggcagtggctttgagtggcagtgatgttgcacagatgagcaggccctggtcttgaaaaaagtgaccttcctagggagcagatgtcctagctattagagagctcagacagttgcttctcttctgaaatcctcctgtaaatctgaacattagcatcagggtctaagaggaggtaggagataggagagaacctgtgggttaagggcagagttttgtgacaacatccatccaaggtagaactgtcaggacctaggttgctttctccaataactagatgtgaatgaattttagggagagctggaaaagcagcttctacaagcaaacccgattctggaggctttcggcaacgccaaaacagtgaagaacgacaactcctcacgattcgtaagtagcaaagccacatggattttccagaaaagctttggtgtcatctcctgcctggggctgcagagtgtttgcgtgcagaggtgggaggggcatctgaccctggagagatgggctgtatctcacaatcttgcaagggctcctgcctctcactctctcattcattcattaatttattcactattcactcaacaaatattgattggcctggtgcggtggctcacacctgtaatcccagcactttgggaggctgaggtgggaggatcacttgagcccaggggttctagaccagcctgggcaacaaagcgagatcccatctctattattaaaataaaatttaaaaaattaggtattgagcacctggtatgggctagacccttatatccgataccattttatgtaacaaaacatgaattgagtgccaactgtgtaccaggcacacacctcctccaagaaatacttagtaagtacctactgtgtacaattactctggtaggcacttttacatgtaccaccattctctttgtttttttctcatttgctgtttttattaagtgcctactgtataccaggcactcagcgagtctcacaggattgcgatgaatagttcagatatggttccagccttcatgaagctggttcttccaactgaataacagagagtaagtgaggcagggggtactaccttcccatgcacactcccccaggctccaaagcaaaaagtttttgcctgagcccaacagggcaggggaactctgaaagtggatggttgatgataggtagacaacaatggttttattgtgcaaaagaagcggttgtctccgtaggagggtcagaaagatattttagtgagaaaagatgaaggaaaaattgcctctgcattccaggagaagggggtctctgaactgttgctcgctgagatggggccctgtgaaagactctttgcagaaagctctgctctgctgagcaaatgcacatggtggtccctgaccctgtgatccccaaggcccattttagtaacaaacaattacataatgtctcctttcctcgcccgaaattagaatcatagatagtatcacctcctacacgtattagatgaatacacatcagcataatgccctaactggaatatgaagaagaaataacataagacaattcataatgaaagtgtgcatttcaggccaggcgaggtggctcatgcccgtagtcccagtactttgggagactgaggcgggcagatcacttgagctcaagagtttgagaccagcctgggcaacatggggaaaccccatctctacaaaaataaataaataaagtgcatttcagcatatcaatgctcgggccaggccacaccaacagaagacacagtaagagacagacacttaggtctatccacggcgacagctacaaatacaaggaaaagggtcaagttcaggcactgatgatgttggcatgggattttccagaatggcaactgactctcagtgaagcgctgaaccaaagaacaatcttctctagagtcacacagatgggatattcttgtattagaacaacattttaaacacttgttaatgctttcatttaaaagcataaaaatctagaccaggcacagagtggctcacacctgtaaacccagcaccttgggaggctgagttgggaagatcacctgaggtcaggagtttgagaccagcctggctaacatggtgaaaccctgtctctactaaaaatacaaaaattagctgggcgcagtgacacatgcctgtattcccagctactcgggaggctgaggtgggagaattccttgaacccggggagatggaggttgcagtgagccaaagtcacaccactgcactccaacctgggcgacagagtgaggctcttgtctcaaaaaaaaaaaaaaaaaaaaaaaagcgtaaaaatctaaagtcataaaggttaggttctaagcctggctaattacaaacagatttttacctccatgagtggcaggtgagacattggaagagtcataagggatatagacaaggattggcatcagagactctccaggtcattgcaggactcccaaaatatccttggccccactgttcactaacaacagcggcccccccccaacatgtgacaagccaaataatggcttccaccgatttccaaaatctccatagcagatgtgccgcctccactgagaagcactgcgtttgcatgttccaattctgtgcaatgtttctagcctgtcataaatggaagcacgtgcaagacaaatccctaaaaacatcctccactcactggcgtccctgccatcttgggaaggagagtgaagaaggtgcctgggccttgcctgtgaccagccggctctccctggctccatctgggatatggtcatcccaaatcactctactgcatgtttcccaatggggaaagtttgaaggttttgtcaaggactgagcaagcctaggggattgtgtccacacacgccaacacttcccaccatgttatgtcatgatgggggaaaaggatgaaatcctgtctcacctgttgaggaaacaggaaaagggttcatgccaacagatggaggattgggttccatccttggtttcatggcttagctgaggcaggtagatagggccatctttggagatacttgttgagcctctagggccaggaacatgagccattcctgcctaaaggacatcctacacagggcctgcttgggcagtgtggccaatgcatactcacctgtcccacagaaaaggtttaatccatagttggatgatgtggatgttttggagcagggtggggtctggggagggagccctctagcccctgaatatggaaaaaccttctttctgcttagggccctacctctcaggagcaacgtcacgttggacaagtcacttgatctcttttagccttagttttcccagctttaaaatggggatagtgggctgggtgtggtagtttactcctgtaatcccagcactttgggaggctgaggtgggaggattgcttgagtgcagcagtctgaggccaacctggacaacacagtgagatcctatctctacaaaaaaaaatttaaaaattagccagatatggtggtgcatgcctgtagtcctagctgcttgggagggtgaggtcatggggaaaaggggattgcttgagcccaggagttcaaggttacagtgagctgtgattgcaccactgcactccagccctcgctgacagagcaaaaccttgtctctaataaataaataagtttttttaaatagggatagccatgatggactacggtcattgcaaaagccgaatgaaattgatctgtgaacatgttttacacgttctgttgctgtcaggcctggggtggtttcagctcagcagatgttggttccgcctgacaacttgacctgtggggttctgagtgttcgcaagaatctccccgccccacctcccatcctctgtaccatctgcctcctgcttgcccacagcatggggttaacggctgaagttgggcagcaaagcctgaactgtgttttcctgttggcagggcaaattcatccgcatcaacttcgacgtcacgggttacatcgtgggagccaacattgagacctgtatcctttccctgagcctgggccaaatgggtacccctgccccctaccaatctcctgcccagaggctgggagagtccaagagccacctctatctttccagcctcttaggtttcttccagaacaaatctccccttaacagcaggcattgtggtgcagtggttatacatgtgtggaccggacccctggtttgaaccctaaacaagcagcctaggctgcatgtgatgctcaaatgatctgtcccttagctgagtgaccttgggctggttactccacctctctgtgcctcatcagcaaaatggggatgataatgaatggtacctgcctcatagaaatgtgagaatagagtgaatgaactcatataaagctctaggcaccatgcgaggtgcagagtaagggctggctacgtagtgtctatcgtatgatcttcacttcatccttattcagccattgtccgaggccaaattctggacctgtcgtcctcttagagagttggtctgtgatcggctccacttcttaggtaggaaattgatgaaaacagagtttacccagaagaatgctggtatcgcaaggaacaagtagagcatctctttcatgaacctgagcggtgaagtggagccaagttagaaatttctggacgtgggggaacaaccaggtctagagttcagtgactgatcagcctcaggagctttgcaggcggccctagggctcaggcttcctgtggaacacgtgcttggcaatgtataggacctgggggcctgacttagcttctttctgcacctgaggtcctctagcagcacctagtggtcccatttttccacgttatgtgccctggataagagggtgggttgtggagtagcttcctctccactgtacttgtctaagctgtggggatttgggaaaatcactgaagctctctgggcctcagttttgcctcggtaaaatgggggtgattgcacctagtttctggagctggtgcaggggttaaatgaaataatatgcataataatatgcacagcccttggtacggtactgggcccaaagtgagcatctcataggtggtggctattgcgttaactcaatgttttctacgtttctactttaatctgcccaaaccagccaggattcccatcctgcagctaggagggctgtcaggcttcggtcaagtccagagccagggccctcttgtcctgcagccctgcacacacctctcagcaattcatttcctgtgtttagagcgagccccaggcatagccccgtccttctggcctcagccttccttttagatcagtggttctcaaagtatgtttccaaaccagcagcatcagcatcacttgggagctctttagaaacacacatctcagccaggcacggtggttcacgcctgtaattccagcactttgggaggccgaggcgggcagaccacttgaggtcaggagttcgagaccacctggccaatatggtgaaaccctgtctctactaaaaatacaaaaattatccaggcgtggtggcatgcacctgtagtcccagctactcaggaggctgaggcaggagaattgcttggatccgggaggcagaggttgcagtgagccaagatcacacactgccctccagcctgggtgacagagcgagactctggctcaaacatacgtgcgtgtgtgtgtgtgtgtgtgtgtgtatgtgtgcgtgtgtatacccatgtacaccatgagaaagtctgagaatcactgctttccagattggacatgggctgtggtagcccgggcactgctagctggctttaggacttgaagaagacaaggtctgctgatctagccccatcatcccgcaccatcatgcttagtgctgtggaaatccacccagtacagtagcccagcctcccagctgccctctcccatcaccccggaccctgtgatctccatgccaccctcacctgccctcccctctgctctccctcctgccaccccgcatcgcggagaagctctcctgaaattaattagtgtggcgtgtttacggtctctctcgcctccatcccgtcagaccccactcttggaacagagggcatggaagacagctttgccacttgttagctgtatcatcttgagaaaggacttctcttctctgagcctcagtttccccttattgaaaacaccgataatagttgcacttatttcctagcatactttgtgaggcttcagtgagacaatttatatcaatcatttcacacaggaatgaatcataaatcataggatcatagatggtgtcattatttgtattctgtcatgtctgaagacagctcattttaaagaagatttgctggtgatggctgttaggggaacatctcgttaccattaccttcttcctggagcctttttatgctttttcttttcactctattcccctcccttttttttgcatctgaagtctgctggcagcacccagcggttccatttgtccataggggcaatggtcaaagttagacattaccgatcccaggggtagaactggaaagtcatcccatgtgaattgggtgtgacagggatggaggtggaagaccagaggaacacccgcagtatccccagaatccctaactccctccaaaccagatctgctagaaaaatcacgggcaattcgccaagccagagacgagaggacattccacatcttttactacatgattgctggagccaaggagaagatgagaagtaagtgactagcaatgacatgtgattggatggcttgagccttccctttcatcagaatccggggttaagggattggctattaaaacagtctcagatcctgccagaaaggaccatgtctgtgagtgacatatgaacagttcttcatctcctcccaatgagtgagtgtggcttgtgttcagtcattctcatttactgagcacctactatgtgacatagtagccatcaactccaattagacattagatcattaatgattcatgtctcattagaccagagagcatcaagtccaactagacacaatctacgccttcaaggaaagggagaaagacatttgccttacttgccaatttataaaacttgcaaatataaaagatgcattctggttttataaggaatttgcaggggcagcaggactaagcatttttcattatacatgttttgccagtgactttgtagaacaggggtcaagactttttctgtaaaaggccagatagtaaatcttcaggctttgcaggccaggtggcttctggcacagctattcaactctgccattgtaatacaagagcagccacaggcaatatataaaccaatgagtgcaggcaacacataaaccagtgagctcaggcaacacataaaccagtgagctcaggcaacacataaaccaatgagcacaggcagtacataaaccaatgagcacaggcagcacataaaccaatgaacataggcaacacataaatcagtgagtgcagatgcatcactgtgttacaataaaactttatttacaaaaacaggcagtgtgcagaagtttgctgacctctgttgtagggaaaagtttttttatgtaaatataatacactgtataccaaactccagtaggaagttatgagttctggacctgcagctgtttactaactcttaaaaatatatacaaatcgcatagcttaaaaaaggaatggatcagtgactatctgtacatagtagagtctacatgttagtaataagttttgagtctgaaattctatgggaacaatacagactttgcttcccatctcttttgtggcccaaggttagttattttggttaagacagttaccaaaaggatctgtgtgagctcagaacttcgctgtgtcggagtgtattgtagacctcagctactagggggtggcattatccattatttaaatttccagggtggggcaaagtggctcatgcctgtaatcccacactttcggaggcagaggcgggcggattacctgaggtcaggagtttgagaccagctcggccaagatagtgaaaccctgtctccccaaaaatacaaaaattagccaggtgtggtggctggcgcctgtcatcccagctacttgggaggctgaggcaggagaatcacttgaacctagaaggtggagtttgcagtgagctaagattgcaccactgcactccagcctaggcgatagagtgagactctgtctcaaacaataaaaataagtttccttaatggctggctttcaggaacataggctatgaggtggagcaatttttggtaaagggggaatgctgaatggattttttatgtaccagcaaacatggtatattagcagttacagtgcaggaccctgtggaatgggccagggaaaaatgttgacattccttttccttttatttggcacccaagaaaacagtttggttgtttggtaccttgggttccagttttgtgctttgcctctggtcttccagaaatgggcaagtatagggctcagaactaaattcccaggggccgtttgtattctagatgatagaactggaaagatgttaggcttttagaaagaaccaaatattgctaaatgcatccaaactcgggataatgaagtcttggcaaagacctcaatcctcgtgacttgaatcaggcatttcaagttaatccaaaagtttgagttaactggtgccttcagtcaatttaacctcgagtttatcaagcagcttccaagtgacttgacccataaaagaccttgattttgaaagaaaaatatcttgctgacgtctctccaaaagtataaccgaatccatcctaattaaagattgatctggaagaggatccttgatgtattggagggtataataaaagcaaatggtgcaggagaaagaaaggcaattataaagttgggggtgggggagaagctgaacaacaacaaaggaaatgtaatcataggatacagtttgacacagaatatctaattaatgtcataaaaagggagttggcaaactgtttttgctaaagggtcagtagtaaacgttttagactttaaggaccagatggcctctgttgcaactactcaactctgttgcctagtgagaaagcagccatgagaaataaacaaggacatcagagcagctgtgtttcaataaaactttatttacaaaaacaacaggggaccagatttgccaacctgtgatataagccttatatattgattcaactaaaaatagctgggggtggctgggcacggtggctcacacctgtaatcccagcactttgggaggctgaggcgggtggatcacctgatgtcaggggttcaagactagactagccaacatgatgaaaccccgtctctactaaaaatacaacaaattacctgggcatggtggtgggtgcctgtaatcccagctactcgagaggcaggagaattgcttgaatccgggaggcagaggttgcagtgagcagccaatatcgcaccactgcactccaacctggacaaaggtgaaactccctctcaaaaaaaaaaaaaaaaatagctggaggaaaggaaaggtagtataagaaagctgcatttttgcctaccatagcaggaagtcactagatactatctaaacttgacatatccagaaatcgcctattacagcgattgtgctttgcctctggtcttccaataggccaaaagcacctgttacttttggcactgaggactggtttcctggaagaaaagttttccacagactgggcgggcagggttggggggatggtgtggggatgattcacgtgtattacatttactgtgcactttattattacattgtaatatacaatgaaataattatactagtcaccataatgtagaatcattgggagcttgttttcctgcagtcccatcggggggtgatgggggacagtgacagattatcaggcattagagtgttataaggagggcacatgtgcagctcacgatagggtttgcgctcctatgagaatctaatgctgctgctgatcttatgggaagcggagctcagacagtgatgcaagcgatgggcagcagctgcaaatagcggataaagcttcacttgctcacctgctgctcacctcctgctgtgtggcccagttcctaacatggaccggtactggtctatggcctatgggttggggaacccttggcctatgatatgtaatacataatggtatatacattataataggctagtatatatagcaagcctattgtacagagagatagtggtaactgccagataaaaagcagctaaaagagataaaagcaggtattatggagtaaggtagagttggagaagggatgtgacaggagaatgctatttttcattataaacctttggtagtaattgatttttaaaactcatgtgcctgtttgaatttgataaaaattttataaatacatgaataaggccaggtgcggtggctcacgtctgtaatcccagaactttgagaggccaaggtgggtggatcacctgaggtcaggagttcaagtctagtgtggtcaacatggtgaaaccccatctctactaaaaatacaaaatttagccgggcgtggtggcgggcgcctgtaatcccagctactcaggaggttgaggcaggagaatcgcttgaacctgggaggcggaggttgcagtgagccgagatcgcgccactgcactcctgcctggacgacagagtgagactccgtctcaaaaaaaaaaaaaaaaaaaaaagagtaaaggttgatctaactcttctgacagctttgtctctgaaggctgaaggcagggtgcctctagacaattgaggtaaaggcatcccttcctccaggtaaatgtaacttcgtgccagggattgtggcttagcaagcagaaccaaggctggatatcagctgcagtcactggagcagtgcacaacctgcaccgctgtgtaaggctggcagtggttggtgaggctgtctacgtgacgatgcgtgagggctttaaacggttcaagccttgataaagggaaaggaattatgatggcccagacccttgaccagatctcggtctcatgttgaaattagaagtatgtcttattgaccctgacctgtcttcctctccttctaggtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatgtaagcctcacaccttgagtctggagggtagcttgcctggataccagtggaacctgttaagaactcttctctggtcaggacagatttctgctctctgaattccccaccttccattaaaaaaaaaaaaaaaaaaggaggaaaatgaattttattctaggtggtttgtttgtgttgtagaaaagtggctgtataactagggttgcaagtaacccgagctggcttaaaccaaagggaaagtgactaactcagaatgttgagaagttcagggaggttaggcacagtggttcaggtctgtaatctcagcgctttgcggggccaaggtgggcggatcactttaggtcaggagttcgagaccaacctggtcaatttggtgaaaccctgtctctactaaaaatacaaaaaaaaaattagccagggctggtggtgcacacttgtagtcctagctactcaggaggctgaggtgggaggattgcttgaacccggaaggcagaggttgcagtgagccaagattacaccactccactccagcttgggagatggagctagactccatctcaaaaaaaaaaaaagttcaggaattcaagcttcaggtacagtgagatctaggtgttcaaaagatttttctagaacctaatttcttgtcttctatctctctcgactacattgtttctctataggatgcagtttgttgacagcaacatagctgggttccagcccttatattctttgggtttatgtccaaagaacagagtagattcccggcttaagttcctgaatggagtgtcattgactctgattggttggcttaggttgatatgcacattcctgagctatgcagcataggcagggttgtggaaagcgcagggtggtttcattatggtccctaagaatggattcttggagctgaaggtagagatgttggcctcatcaggaacatgtgggcagggtttaggggagggggagtgatcgaggcagtggatttactcaggcttttcctggaggggttgctctggtgatcaattgatattgatcaaaatcatccaaccaatggccaagaaacacactgggtcttgagaacaggacagctcagaaagaaattcttggtcgggacactgtgtttccagaaacgattttccttctgcgttagatgtgcctcagtgttgaaggttaatctctttcaggaacaccaggacagaactgtggaaagtttcccttccttcccacgcctacgcccgtttggagccccagaatagcactgaggttgctgaaatgctgcataaggggaggggcagctcctccgaagataacttggggtctggaaaattaggctgtatgggtcagttgacaaatggatggtgtatgtgggtcttggccagggtcccacatcagaatctagtgctgatagcctccttgtctgaatgacataggccctccaagaatgattcatttcatttgggacaggggtcagttttgcttctaatcttgcttttaaataacaatgaacaatggttaagtatttgctgtgtgccaggaatttaccaaatccttttttcttgatgtactacactgttcagtatagttttatttaaataataaaaaactggaacaggctgggcacagtggctcatgcctgtaatcccagcatttggagacactgaggcaagaggattgcttgagcccaggagttcgagaccagcctggataacacagtgagactctgtctctacaaaaaaaataaatagaaaaaaactggaacaaactaaaataggttgattaatagagggtttattaaatcattgtctgtccttgtgaaagaaaacaatgagaccatttaaattgttttgctgggcatggtggctcacgcctgtaattccagcactttgagaagccaaggcaggcagatcacttgagcttgagtttgagactaacctgggcaacatggcaagatcccttctctacaaataatacaaaaaattaactgggtgtggtggtgcacactgtagtcccagctacttgggagactgaggcaggaagattgcttgagcccaggaggtcgaagctgcagtgagccgagatcacaccactctgtcacctaggctggagtacggtggcgcagtctcagctcactgcaatctctgccttgcaggctcaagcagtcctcccagctcagcctctcaagtcgttgagactacagacatgtgctaccacgcctggctaatttttgattttagggtttttgttttgttttgtttgagatggaggcttgctattgtcacccaggctggagtgcagtggcacgacctcggctcactgcaacctctgcctcctgggttcaagcaattctcttggctgagcctcctgggtagctgggattataggcgcccaccaccatgccccactaattttttttgtatttttagtagatactgggtctcgccatgttggccaggctggtcttaaactcctgacctcagatgatccacccatcttggcctcccaaagtgctgggattgcaggcatgagccaccgtgcctggcctggggttttttgttttgttttggtttgatttttggaggggtgggtagagacaaggcttcaccatgttatccagtattctctggtcttgaactcctgggctcaaacaatcagcccaccttggcctcccaaagtgctgggattacaggcatgagccaccatgcccagtccccagtgttctcaatgtactttggcacttgtttcccctttaaccacagagaccagactccaggcccagcaccttcggcagccccaagcatctagctagaatttggtaatactgttttccttgtatttatatttataattgccatctatttatggcaagtgaagatgatttgtcactgaagatagagaaagttttctattaaaacaaatgtaaggaaagagaaggaagtaaatttaaagaaaatgattaagcaaataatggagcagatggtacacagagcaagcattcagacgatggcgtgcaaatgacgaactctcataggaaccaacttagtcctaaatgtacaccaaccccatttataaaccaagagctacttccaaaccctccatcaaggggcctatggagaagggggtgggtcaggcttcaggctggagcttcatgaggctccaagtgaccaggggacaccaggattttccccaccacattgggttctgcagccttgaactcctggcctcaagatatcctcatgcgccaccatgcctggcctggttatactgcttctaatgtattttgaagataaaaaataaaatcacctaaattgtccatcctgtgtatccctggtggtacacatgtctgatgttggaaagtcctgtttcttattcctcagcaagaagagaggtgtaaggccactgtaaaaaattagcacaaacttgatgccttaaaacaacaggaatttattctctcccagttctggaggccagggttctgaaatcagggtgtcggcaggagccgggcataatggctcatgcctgtaatcccagcactttgggaggccaaggcaagaggatcgtttgaggccaggagttcaagaccagcctgagcaacatagcaagaccccttctctactaaaaatttaaaaaaaaaaaatttttttttttttaaaagacaagatgttggcaggggttgttcctcctggaggcactgagggagatctgttccttgcctctgtcctggcttctggtggctctggctgttcctggcttttccttggcttgtctcactccagtctctgcctcatccttcatgtggcattctactctgtgggtcttctcttctgtccatcataaagacacttgacattaaatgtagggcccaccaggttaatccaagatgatctcatcttgagatcttgtacttgattccatctgcgaagaccgattttttccaaaataggccacgttcaggctgggcgcggtggttcacgcctgtagtcccagctctcagggaggcagaggcgggaggatagcttgagcccaggagttcgagacctgcctgggcaatatagtgagaccccggtatccacaaaaaggaaaaaaaaataaatgtaaccccccaaattaggccacattcacaggttccaggtggacatattttagaaagaccaacattcaacctaatataggtggcttccactctttatcacctactaggccaggcccttgctcagcatcttacaagacctaaacttcacgaagcaggtactactgttaccatctccgttttgcagatagggaaactgaggctcatgggacttattgagactcatgtagagtctctatcctctattcatccatgattcatccatcaatccatcctctatcatccatctatcctctactcatccttccatcacccatccatccatcacccatccgtccatccatctacccacccatccatccatgaacccatcctctatacatttatacattcatccatccattcaccctccatctgccatccatccatctccctccctccccatgtgtatctggacccggaactaggatttggaaattcagagataatgagatttataagaagcaaagctgggatttgaactcaggactctctaactgcagagcgcgtgctttgcaccagcacaccaggatgctgccagccgtcaccacccttgctgtgttgtgtctcctcactggtttacttctttgctgtctgctaattctgccccaaggttcatctcttatggcctgggagtggtggcattcttttgtcatttctggaattacatttaactataccagaaagtgcaaaccaatggttcctgagcccacaggagagatcggccactacaaccttcaaaatttttagaaattggttcctaaagtttaaatatgggtaggccgggcactgtggcctataatcccaaccctatgggaggccaaggcacatggatcacttgaagtcaggagtttgagaccagcctggccaacatggtgaaactccgtctctactaaaaatagaaaaattagccgggtgtggtggcacacgcctgtaatcccagctactctggaggctgaggcaggagaattcccctgaacctgggaagcgcagaggttgcagtgagccgagattgcaccaatgcactccaacctgggtgacagcaagactcagtctcacacacacacacacacacacacacacacacacacacacacacaccaaaaaacatgggtacacttcacataaaaactctgggtttccattatctagaaaaatcagaagttccagcaacacttggcttatatcccctgtggcaatgacggagtagctgctggccccttcagatgggtttgtggcctccttgggtccccacagtcctcattagttggctttgttcatttagaccagtggttctctgccagaggtgagtttgcctcccaggggacattgagtagtatctggtgacatttgtggttgtcacaactctgtcagggtaaccaccactgacatctagtggttagaggccagggatgctactaaacttcccatgatacccaggacagctccccacaatagagaattatctggcccccaatttctgcagtgacaagattgagaaaccctgagttggccggctcgcctgggctgtgcaggcatttcaggaatctttagtttaaattgacacttttaaaactgtgagtgcaactcttcatagtttacaaagactctttcatagatgttatggttaaaaggaagtgtgtttccaagccctgtcaacagcagcttcattcattttggggagaaggctttctaccatagtaagtgggagcaaatggatgggtggtcagcagctgggtccttttgctgagctgggccagggaccccatggcgtgagaatagctgttgtgaagggccttgtaatgtctggtttggcctgaggaaccagagaagtctgggatctctaggctttgttcctggaacatagtgactgatttgaagccagaactctgggtgatttgtacctgagttaagctaagccaagaatttgcattaatcatcatccatccattcatccatctaccatccatccatcatctgtccatccatccattcatccatccatcatccatccatcaatgctgtatccattcctccatcaattctccatccatctatccatcgtctatccatcaatcctctgtccattccatctatccatctatcctctatccatccatccatcatccgtctatcctctatccatgaattattcatccatcaatccatcctctattcatccatctatcctctactcatccgtccatcattcacccattcatctacccacccatccatccatccgtccattcatccatgaacccatcctctatccatttattcattcatccatccatccaccttccacctaccatccatccatctctctccctccctcccatgtgtatcaggaccttggaataggctttggaaattcaaagatgattagggcaggccctccactctccagaaactcatggtcttatggggatttcagacatagaaactattttaacagtaacatggcctgagtatggagtcagaaaggttccaagtattctgggaacacagcgtttttgtttggagacacctggacaacaagtggaaacaaatgtatatcttcttcatcccaacatgggcatctgttacacccagaagagtatgtaagaagcacagggtttttatttcaaaaatccttttattgacatatgatttacatggagaaaattgtgtatgccatagcgtgcagtgcaaagaattattataaactgaacacgtctgtgtaactagaatccattttaaataagacaatgccaccagccccatggaagctcccacatgcaccttctaagaacttccctcaattaaggataatcattatcctgacttctaacagcatcgattagttttgcctcttcttgaatggacggtctatatatggacttagacagtatgttcttgtttccatctgtcctcttttgttcggtatttgtgtctggaagatatgtcagggttttttttttgttttagagacaggatctccctacattgcccaggctgtatcaagctcctggcttcaagcagttctcccacctcagcctcccaaagtgctggggtcgcaggcatgagtcactatgctggccccaatacatcagttttgatttgtggtagttgtagctcattcattctcactgttctgtggcaggggttgctaacacatttttctgtaaagggtcagatagtaaattctttagcctttgtaggccagacgatctttgttgcaactcattaactctgccagtgtagcatgcaaatagttacagacaatatgtaaatgaatgagtatagctgttttccactaaaactttatgtataatagcaagcagtgggccagatttggtccatgggctgtaatttgccagtccctgctgcgtggcattccattgtaatgcaaggttttaagcaaccatatgaaaatattgagctcagaatctagtttcttcagaggaaagatgtaagctggctctgggtccccagtggctttaggctccaaaactccagggtaccttggcattgacctttgtgtctgctctgcccttctctccccacctcagccatattgaaggtggtatcatcggtcctgcagcttggaaatatcgtcttcaagaaggaaagaaacacagaccaggcgtccatgccagataacacaggtacttgccactttttcctgatgaccaatgactttggggttgggggggtgggggaggtgacatttaaccactggttatttttcaaggtgaaggtatctgggattttaacaacagttggactaggttcttatcactcactttttcaaacttttcagtgctcaagaccctatgtggaaagttattgaatcagagcgcagggattaaaaaaaaacaaacctaatagttttatttatttgttcttttttttaaatacaaaattttacaagttttaatagagacgaggtctcgctgtgttgcccaagctgatcttgaactcctgagctcaagtgatcctcccaccttggcctcccaaaatgctgggattacaggcaagagtcatcacgtcctacccctaatagtgaccagacaagatcccgagggaccatctcttctaaaataccccacttaattgttttgttaaagaaatatttctcaagcccctgcaatatgccactgggatacagcaggaaatgacacaagaatagctcttcttacggtatctgtggtcgtcttggggagacagacctcaattgccctgagaattaggggtgccagataaaatacaggatgtccagataaatttcaattttaggtaaacaacaaacctttttttaaattttaattatgtcccttgtaacatttggaccgtgattataccaaaagagtattcttgtttatctgaaattcaggtttaactgagcatcctgtaattttccccctaaatctgataaacctacccacaaataaacagtattttgtgttttgagaagctggcctggctaccactatgcttgttggtggctgagctgagagcaaaacttaggtttcttatttcccagcccaggctgtatattgtgttgctttttcccgctccctagagcccaccttgatcaaacctgttgcaaccgcttactgggtttaccttgcccacagcctagacagagccaattaatcaagacaggggaattgcgatagagtaagagtaactcacgcagagccggctgcatgggagaacagagttttattattactcaaatcaatctccttgagcattcgtggatcagagtttttaagcataatgtggttagggggaggccagtgagttgggggtgctgattggttgggtcagagatgaaattacagggagtcgaagctgtcctcttgccctgagtcagttcctggacagaggccataagatcagatgagccagtttctcgatctgggtggtgtcagctgatccacctggtgccagggtccgcaaaaatatctcaagtactggtcttaggttttacaatagtgatgttatccccaggagcaatttagggagggtcagactcttgtagcctccagttacaggactcctaaaccataatttcaaacctttgggctaatttgttattcctacaaaggcagtctagtctccaggcaagaagggggtttgttttgggaaagggttcttgtgttttaaactataaactaagaggctaggcgtggtggctcatgcctgtaatcctaggattttgggaggcccaggcaggtggatcacttgaagtcaggagttcaagaccagcctcgccaacatggtgaaaccccatctctactaaaaatacaaaaattagccaggcgtagtggcaggcgcctgtaatcccagctactcaggaggctgaggcaggagaactgcttgaacgcaggaggcggagattgcagtgcgccgagattgtgccactgcactccagcctgggtaacagagtgagactctgtgtccaaaacataaaaaataaactataaactaagttcctgccaagttaattcggcttacacccacaaatggttcagtggagcttggaggttagaagcaaggtggagtccgttaggtcagatcttgttcagtgtctcagttataattttgcagtggcagtttcattctcaggtgtttgttatgtattagagtccctaaatctggcaaattaatggaatccggatgccaaggaaagacctcagggaaagagaaatgaaaaagtgctcttgccaagagatggggaaaaaaaaatcctaaaatcactctatttactctgccttgcacatgcaaagcagcatgtaatgctattttcatgttaagggaccagctcgtggtcacaccactgcacttcagcccgggcgacaggaagactgcatctcaaaataaaagaagagcatttaggttgactctagcattttgctattgcaaacaatgctgcaacacatatcctagaagggtgaaagaaatatttattgaacagtaactgttcaataaatgttactattaataactatttaatacttactaagtaactgttaaataaatctcaagggccagtggctcacgcctgtaatcccagcacttagggaggccgaggtgggcggattgcctgagttcaggacttcgagaccagcctgggcaacacggtgtaactccatctcaactaaaatacaaaagaaattagctgggtgtggtggcaggcacctataatgccagctactcgggaggctgaggcaggagaattgcttgaacccggaaggcggaggttgcagtgagctgagatcgcgccactgcactccagcctgggcgacagagcgagactctgtctccaaaaataaataaataaataaacaaataaataaataaataaatctatctatctcagggactttacatactttaccttatttagtcctgggtaccaacaaggtaccgaagagctgaccctttttaaagctgagaaaagcaagatgctgggagggtaaagagcttttccaaagtcacatgacttggaagtgtgaagggacagggacttgaaactagaactacctgaccctaaacccccaactggggcctgcttcagcccaccccaatcattgcctctcagcaaaatactggggagtgtgaccactaatgacagcagcctttaggacacttcaagctatattcatggtcagcgggtcccatttccccaagagaacccgctgtattcacagatcacaaatatcccatgcgatgtgtcttcttgccaagctatttcttttgtgatgcactcacgatgtttcttttctccatccagctgctcagaaagtttgccacctcatgggaattaatgtgacagatttcaccagatccatcctcactcctcgtatcaaggttgggcgagatgtggtacagaaagctcagacaaaagaacaggtaatgatgtacttatcacttatccatccatgcacccacccatccatccattcatccatctatccacctgttcactcattcatgtattcattaatccattcacccatggtctgcctctgcatctgtccatccatccatctttctacccactcattcatctgtctgttcatccatccatccatccatccattcatctgcccatctatctgctcacccatcatctctccatccctcactcatccatctgtccatccatccatgacccagccatctgtccatctgtccgtccatccatcacccatccagctgtcattccattcattcattcattcattcatctgtccatgcatccacccatccatctctttatccctcatttattcaatactagaatattcacagtcccatgtcaggttttgtttgtttgtttgttttttgtttttgagccagagccttgctctgttgcccaggggggggtgcagtggtgccatcgcagctcactgtagcctctgcctcccagattcaaacgattctcctgcctcagtcccccaagcagctgggactacaggcatgcaccacaacgcctggctaatttttgtatttttagtagagaagggtttttgccttgttggtcaggctggtcttgaactcccgacctcaagtgacccacctgcctcggcctcccaaagtgctgggattacagtgtgagtcactgcacccggccaagaataaaaatcttcaccaccagcctggcttatgtgaaaatggagcccattgagaataaccgggttcccctggttgccctctgcaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtacagctcggtgggatcctaagagccatggtcttggttgtctgagatgggctttttcttggaggagtcatgattttggagaaaggcatgtagatggctactgtagggtaggaggctgtctagttaagggtggatcattgagggtataagagacagaaatccaacaggaaatgcattggtttctggaactgagaaggccagacatgtagctggatcccgtaggcagggtctgatctcccgccatcgttctctctctctctctgccttcctccatattggctccattctcaagcaggctctcccctcacgggggcaagatggctgccacagctccagactgcctctcagtaatcctggtaaaaaaaaaaaaaaaaaaaaagcacatatctcttttctaacagttccaaccaaaatcttggaattaagtctcactgactcttactcacctgaattgggctacatggtcacctccaagccaagaactgtttgcaggagcttgcaatacctcatgtagtagaaacatggatattggatcctttacccatgggtttgaagaaagttctcagagaaagggaaggttttttttttgtcttgtcttgtttttttttttttgagacagagtcttgctctgtcgcccagactggaatgcagtgtcacaattttgtctcactgctgcctccgcctcctgggttcaagcaattctcttgtctcagcctcctgagtagctgggactacaggagtgtaccactgtgcccagctaattttttttttttttttagacagagtctcgctctgttgcccaggccggagtgcagtagtgcaatcttggctcaccgcaacctccgcctcccaggttcaagtgattctcctgcctcagcctctcgagtagctgggattagtgccaccatgcctggctacttttttttttttttttggtagagacagagtttcaccctgttggccaggctagtctcaaactcctgatctcaaatgatccaccagcctcggcctcccaaagtgctgggattacaggtatgagccactgtgcttggccaatttttgtatttttagtggagagaggtttcgctatgcttgccaggctggtcgcaaactcctgacctcaagtgatcctcccgccttggcctccctaagtgctgggattacaatcatgagcactacacccagccaggaggttttaagattgatagatgtcccgaaagaagtgtactaccgagtcactttctctctgcgcctctgttttcacatctgtaaaatgtttccacatctgtacatgcagtagcgtgccttacgaggtttgtccatccatagatggttgtgcagatggaggagataagcatctttaaggtgtgtgagggccatgtgatatcaacttcaccagccctggtggactctaggcagcatgttttggggcctcagccctgtctgggtgctgggatggcagaacaggatgtgggcgggccatgggggcgctgtcgggtggagcttctgtggggctccttgtcttctgacttcataccaagatgctcacgccccgcccccacgccatgtgctcaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccggtgaggggcacgtgggcgtgcggggctccgtcacaccttgtacacgtgtgtggcctctgtggagccgacgtggaccccacactctccccatgcacatagcattcccccacccaatccatcacccagtcctgaaaggctgtaagctgaatccttgtgaactcttacaatttccattaacccacattttcatatcaaaggtattttctttaatttctgccttccttccatcctcttttttcttcctttttttcttccctaccctctttcccttccctttccttctctgccattgctttttttttttttttttttttttttatgacatggtctgactctgttgcccaggctggagtgcagtggcacaatcttgcctcactgcaacctccacctccctgcctcaagtgatcctcccgcctcagcctcccaagtggctgagactacaggcgtgcaccaccacgcccacctaacttttgtattttcagtagagacagggtttctactaattagccgggcctggtggtgcacgcctgtggtcccagctatttgggaggctgaggtgggaggattgcttgagccctggaggcagaggttgctgtaagccgagattgcgccactgcattccagcctggataacagagtgagaccctgtctccaaaaaaaacttttctaacaggaaccctaggtgaattcaagtcaagcaacaaattcatttgcaagaattatgaactcggccgggcgcggtggctcatgcctgtaatcccagcactttgggaggccgaggcgggcggatcacgaggtcaggagatggagaccatcctggctaacacggtgaaaccccgcctctactaaaaatagaaaaaatcagccgggcgccgtggcaggcgcctgtagtcccagctactcgggaggctgaggcaggagaatggcgtgaacccaggaagcggagcttgcagtgagtcgagatcgcgccactgcaccgtctgcctgggcgacaaggcaaaactctgtctcaaaaaaaaaaaaaaaaaaaaaagagttatgaactcttcatgatgttgcctgcgtgttgcccactagggggcggcagcaaacattatgttctgccttccatccctgttactggtccattgggcacagggtaatttgaaggtagatttggaagcatgggggtcataaactcatctttatatgtgggcaaatacagtatcagatctcggcggatgcccatgcgttgtgtatagttggccagctcttcatggaatgcctgaggttgggtgttctctctgattcaagccctacttgtctcccacagaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtaccagccacagggcccaggggactctgtctcaggggacccccagtggctgctcagcgcagagacagtctgagagtggcagaaccttgggctgcctggaaactgcaaagccatctgctgctaagcgaatcccaaccaagtcctattcgtaatttgtctacgcatctgtaaggcatcagctgtagccactctcatgttttccaaccgtgacgtccagacagttatttctttctgtttttgttggagacagggtctcgctttgtcgcccaggctggagtgcagtggtgcgatcatagctcactacagcctcaacctcctgggctcacacgatcctcctgcctcagcttcccaagtagctgggactacaggtgtacaccaccatgcccagctaaaatcttttttcctttttgagatggaattttgctcttgtcatccaggctggagtgcaatggcgtgatctctgctaactgcaacctctccctccgggttcaagagattctcctgcctcagcctcccaaatagctgggattacaggcacctgccaccacacccagctaatttttgtatttttagtagagaagggtttcgccatgttggccaggctggtctcaaactcctgacctcaggtgatccacccgcctcggcctcccaaggtgctaggattacaggcatgagccaccgtgcctggccgcccagctaaatttttaaattatgtatagatatggggtcttgctgtgttgcccaggctggtcttgaattcctgggctcaagagatctccctgcctcggcttcctgaagtgctgggattatgagcacgagccactgtacctggcctcagcctgcttttcttgtatagactctaaatccttcctgctacaagttatacccaacaggcggggccaactggaatggggtgactaatacatccacacctggcttcaacaaaaatctcccatgtcacggtcttgagtttgctattgccagcctgctctggccagggaaatctatgatagttgtattcatcatcatcatcatcatcatcaacatgccttggctgttattgtataggcccttgccctgtggctctcaagagtcctggataatgtacaaaggacatagcttagtctggcttgcagaattgtagtattctattgactcctcagtacctccactgcatcatgggcacaaacaatgctctctaccagggcctggcaacagagtccgatctggcccacagcttgttattgtaaataaagttttattggaacacagccatgcccatttgtatgcataatgtctatggctggctgcttttgtatactacagtgctagagttgagtagctgcgacaaagactgtatgacttggctgggtgtggtggctcacgcctgtaaccccagcaccaaggcaggtggattacttgaggtcagcagtttgagaccagcctggccaacatggcgaaagcccgtctctgctaaaaataaaaaataaaaaaaatttaaaaattagccagctgtgagattacaggcacacaactgtaacctcagctactcaggaggctgaggcaagagaactgcttgacccaggaagttggaggttgcagtgagctgagactgcaccactgcactccagactgggcaacagagaaccactctgtctcaaaaaccaaaacaaacaaacaaacaaaacattgtatgacttgccaagccaaaaatatctactatctgggccttcaccaaaagtttcccaactcctagcctatattcaagggggtatatgttcctttaagcatatagagacaacacttttcttttccctacttcatcagtggattttttttattattattttcagtcttctctcagatcaagcctacctattatcctgataacccacatcccatgataacccagcaaagctgtattatcagttcctttcatttaatattcaccatagtaaaaattacggctttgggcattgtcattgtttgagtcaggaatgtaaaaagcctatatgtcctttttctgtatatccatatatcaggatctctgagttacaaattatgctcattagagagtggaaaataggatgccatgcttaattaatttatttatttaattattttgagacagagtctcactctgtcacccaggctggagttcagtggcgcaatctcagctcactgcaatctccgcctcccaggctgaagcgattctcctgcctcagcctcccgagtagctggcattacaggtgtgcaccaccatgcctggctaattttttttttttttttgtatttttagtagacatggggtttcaccatgttggtcaggttggtcttgaacgcctgacctcaaatgatccacccaccttggccttccacagtgctgggattaccagtgtgaaccaccacgcttggctgccatgcttaatttctaaaccaggatgattgggaagatgatgaggggggagttttgcatgtcggcaggagggcatctgccgtcatgaaatctcttaatagtgtataactcacaggtactgtgctggcttaggaggagggaggctaccacagcagcgttagtaggagaatatggaatggaaactaggctttcccagcaatggctatcactggctgatgtcctactacgtgggcacaggtccctgggctgttggtctcttcactggtgtttgtggagtcccatcatggtggtcataaacgtcatttcctctctgacctcagaagatctggaaggacaatgggagggctggggtcctggccttggtttctaagtttctagtttcccaggggttctgaccagcagggtgtccttggcaggtggactataatgcgagtgcctggctgaccaagaatatggacccgctgaatgacaacgtgacttccctgctcaatgcctcctccgacaagtttgtggccgacctgtggaaggacggtaaggccttctctgctcgggtccatgttctgctttgagctggagaattgaacacccaagtcccccgactctcacacctgccccaggaggggaggcctttacatgggggcaggggaaggaagagcattggcatgggctggtgatgtctcgttgaaacaatttcttcctgagtgggggtccctgagcccctcaatcctacatgtcccgaggggattgaggtcctgaggtcagggctcaggcaatagaggagaaacagcatgccaggcacggggagttagactgccctgtccagagtcagaaggacttcactgtatcttgtctctgccacctcctagctctgtggtcttggatgagtcacttgatgtcattaagcttcattgtcctcattagtaaaacaggagatgcaataatagttgccgtctctactagaggtattatgagggttaaattagaccagtgatgctcaaactcaagcaggcatcatgaccccctggaaggctttgtttatttatttagggacagagtcttgctttgtcacccaggctggagggcggtggtgcaatcttggctcactgcagcctccaccttctgggttccagtgattttcctgcctcagcctcccaagtagctagcattacaggcacacaccaccatacctggctaatttttgtatttttagtagagacggggttcccccatgttggccaggctggtctcaaactcctgacctcaggtgatccgcccacctcagcctcaaaaagtgctgggattacaggtgtgagccactgcacctggccctctttggagggctttttaaaacccagatggctgggcctaccctaagatctaattctgcaggtctggggccagggatggggcgggcctgaaaacattcatcccaggtgatgctgctggtctagggaccacactccggctccctttgagaaccagtgaatagatgatccctgtgaagagctgctggagtgatgatgaggggagggggtttgctgtttgtccctggccatcagtgtccacagcaggttttattcttggcacagggcccatgggcctggggcttacaggactggtctccccttgttttaagcatgctaaaaaaagggctccaggaggggccagctgtgccctaaccatatgccaggctctgggcctagggaacaacatcgcaccctgggtctgtgtcatcccaggacacatgatgaagcctgtagtccctcctctgcgggacccacagtcttgtgggagagatgagactctcaaagacaagcagagagacaagcatgaggctgcgcatggtggctcacacctgtaatctcagcactttgggaggctgaggcaggaggatcagttgaggtcaagagttcgagaccagtctggccaacgtggcgaaaccccatctctactaaaaatacaaaaactaactgggcgtggtggtggtaatcccagctactcgggaggctgaggcaggagaactgcttgaacctgggaggcgcaggttgcagtgagctgagattgtgccattggactccagcctgggcaaaagagcaagactctgtcttgaaaaaataaaactaaaaataaaaaataaaaacaaaattagccgggtgtgctggtgggtgcctgtaatcccagctactcaggaggctaaggcaggagaatcacctgaacctgggtggtgaaggttgcagtgagccaagatcgtgccactgctctccagctgggcgacagagtgagagcttgtctcaaaaaaaaaaaaaaaaaaaaaagattgttacacagaatctgagtagaaggtgaagaaatggtgccatccatggcctgtgggttgggcttggcatgtgcaggacctgctgggctggtagaaaaagaaccttggaggtgatgatgatgatgatgatgatgatgatgatgatggccgggcgcggtagctcacgcctgtaatcccagcacattgggaggccaaggcaggggaatcacctgaggtcaggagttcgagaccagcctgaccaacatggagaaactctgtctctactaaaaatataaaaaaaatgagccgggcgtggtggcgcatgcctgtaatcccagctactgggaggctgaggcgggagaattgctggaacccgggaggcggacgttgtggtgagccgagatcacgccattgcactccagcctggccaacaagagtgaaactccgtctcaataaaataaaataatgataataataataataataataataataataataataataatacctactttttgttgagcacttactgatgtgccaggctatctcggagtgtgtgctgtatcttctgcctcagaatatttcttccgtggatacctacatggttacccactcatttcttgctggtttctgctcaaatatcaacttagcagagcccaccacctccttgtctaagagagcaccctcttcactctctctccgctttaccctatttttatttttctacgcacacctcactactcaagatattccatacttaacatctgtgatctctgtctgtctccttccctgtgatataagcggggtgagggggccgggtctttttttgttcacagcagtgtccccagggcctggagcacagaaggtcctcaataactatttgttggtggatgaaagattggaggctggcagggaataagtgccttctgtgccttatttttttttacccctgccctagaaggtagacggtattattacctcccttttgtagaaagggagactgaggcacaggatagtgccaagccaaggctagtcagtgagtggacagcgagagcaggcttgactcctaggtcagcgtgactccatcacagggaatttgttctttctgccactcaggtgctctcaggatttccccaatagacaatacttggaaaccctgactgccgaaggaggcgttggtgatggaaggaaagattggagtgggcaggttggtgggtggggctggggctgagcctctggcctatttaggggtgggtgggccagaggctgatgccaccctggctgtgccccatagtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggtgaggcccgccgcccagaccctggggctcccagaagccagggctgtcccaagcggtcacagcgtccccagggcgccctctgcccccacctaccccgaggaccccattttccatgtggggaaggctatctgaatctcagacccattccccatccctggaggaaaaggaggaagggaggatgcatccagagacttttcagttgtggagttgctgtgcaggtcatccagccactcattcattcattatcccaggaagtattcactgggctctgccctgtcctgggtgctggggagcagtgttagaaaaattgtagcccttccctgtgggtttctcataatctggtgcaggcatcttcagcttggggcgattgtgtcctctatatggacatgctacagacatttttggttgtcacaaccaggagggggctgttagtcagcatctagtgggtaggggccagggatgccctaagcattgtacaatgcacaggatggtccctcaacccccagcacagaatccctacaagatgccagtagtgctgaggttatgggagacacggggagaggtaaacatacagctgatgatggtgatggaatgtggtcagttaggagaacaccaaagagccagggctcctcccacagcctcaggactcagagaaagcttctggtgaacttgaacgttaagaatgtgtggccatcaacttggtgacatggaaggcagggtggggcctaggataagcagggggcctaggataagcagagggcccaggctaagcaagagtgtggaggtgagaagtgaaggaactaggtaagaaaatgctagatagtgtccaggcgtgttgctcacgcctgtaatcccagctactcaggaggctgagaaacaaaaatctgttgaacccaggaggcggaggttgcagtgagctgagattgcaccacagcattccagcctgggcagcagagcgagactccatcttaaaaaaaaaaaaaaaaaaggaaagaaaatgctaaataggtcatttcatgttgcaaatgtgtgatggcatgaggtaggaatcagatggtgtgaggtaggattgaggctgaatgggtaggcaggggctagatcgtggtgctccttgtgttctttctggagcttggccttctctctctaggcatgccattgggggtgttaaagcagggctatatcatggtcagatttacattttaggaagtgaatgagggggctgggcatatgctagctcatgcctataatcccaacactttgggaggttgaggtgggaggatcacttgagaccaggtgttcaaggctagcctgggcaacatagcaagaccctatatctacaaaaacatttttaaaaattttccaggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaagggattgaggggagaggcaagaccagagagagagaccaggtgggtggtttctgtggttgtccaggcaggagaagatagtggagacaatggtggtgaagagaagtgggggggttgggagatatttgggagctagaagcaatcaaactgctgatggacaggaagtgagggagacgaggtgatgaggaggaagccccaggttccagccaggcgatgctagtgtcaccaagaaccagagagatcatgaggcagccattgccgaagcaaagagatgaaaacccagaggggggcactgctttgcccctcggccctcagctaagccctccttgggtgcttctgttggtaccctcatggcctggccaggtgggtcatccaggtaggaggtttggggctttgctgcgccatggtttctggccccagggatccactgccctctttgacctttgcagtccggcaagctggatgcgttcctggtgctggagcagctgcggtgcaatggggtgctggaaggcattcgcatctgccggcagggcttccccaaccggatcgtcttccaggagttccgccaacggtaagtcccaaggtctggcccaggtagggcagggggtgagcgggactgggtggaggaatggatgctggaggtacccggggtgacttctgctctgtgtttcaagctacgagatcctggcggcgaatgccatccccaaaggcttcatggacgggaagcaggcctgcattctcatggtgagcccagaagtccaccagagacctcccaacctctggccgcaagccacctgctgctcttggtgggaccgttcttacccatgtcatcactggccaaatggcacagtggaaatcaggagctcttcctttccttccttttgcagatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaagtaaagatgctttcctgcatcctaatacctcaaacgcgaatcacaaacaggggcctttctgttctgattccctgattctaagaggccacctgtttaagatgcatcattgactgaatgacagccttttcttgaaggggaagaaatgcttctactttaaataaatgtaccaagttacgagtgcaggaagggaacgagttttagacctgggttctcatcgtggatgccccagtttttgctgatgaaccttgggcaagttactctacctctctgagcttccagttttttagctggaaactgagcataatcattttgacctcagagagctgttcatgaggtgtcactaagataacgcatgacgagagcttagaacagtgcgtggttctcaggtcagaaatgattgttgttgtttttacctccctccctcactccttccttccctccctcccttccttccttcctttcttcttcctttttgagacagagtctctctctctctctctgtcgcccaggctggagtgcagtggcgcagtctcaactcactgcaacctctgcctcttggactcaagcaattctcgtgtctgagcctcccgagtggctggaattagaggcgcccaccaccacactggcctaatttttgtatttttagtagagacaaagtttcaccatgttggccaggctggtctcaaattcctggtctcaagtgatccacctgccttggcctcccaaagtgctgggattataggcatgacccactgcgcccagcctagacatgttagaattggataaaccattgaggaaagaggacttgacggtgtctagatccccgtgtcccagtgggatttataaggcagggttttggagggtgtgatgtcccagctgttctgtgaagactgggagccggggaagggttcgggttccttaatgaaagtcataccccagggactgcagggacaggtggggtcgctctctgtctggggtgtgtgttgtcattgggcagagaccacaccctcaccagtaggaccctgatgtgtcaggttcattcattgacacatggacccaagatggtcaaggccagctttgggagctcttggccctcccgcaacagacctaacttgtcaagtttcgttactaagttccctgttgctgtccttcctggataactggggcaattttattcttaaagttttcctgtgtccaagatggcagccaagcagggaagacagaattacgttcactgttctatcgtttctcaatctatcgatagcccttaaacgggaagagtgctggttcagggtcacagtgtgaaattcctaaaacaacccaggagagaataggtttgacagggctgggtgtggtagctgacacctgtaatcccaggcactttgggaggccgaggcaggaggattgcttgagcccaggagtttgagaccagcctgggcaacatggcgagacccctatctctaccaaaaaaaaaaaactttaaaaattagctgggcatggtagcatgtgcccgtagtcccaactacttgggaggctgaggcaggaggatcatttaagcccaggaatttgaggctgcagtgagccatcatcacaccactgcactccagcctgggccgcagagccagaccctgtctctgaaaataaacaaataaataaataagttagtcagaaacagctggtgtaggctgggcatggtggctcctacctgtaatcccagcactttgggaggccaaggtgggtggatcacctgaggtcaggagtttgagacccacctggccaacatgggaaaccccatctctactaaaaatacaaaaattagccaggcatggttgtgggcacctgtaatccaagctactcaggaggctgaagcaggagaatcacttgaaccccggaggtggagtttgcagtgagctgagatcgtgccaccgcactccagcctgggcaacaagagcgaaactctatctcaaaaaaaaaaaaaaaaaaaaaagaaagaaagaaaaaagaaacagctagtgcagctggggagtacgggagcccccttaggaatgatgcacatagttgtgttttctgagtggtgtttggatctcagctaagtccagggcatgttgtgagccctgggtcttccttgtccactgaaaaaggctctgtcctgtagatgatttaagttgtttgcagccagacaacacatgtgtcacacagggtttctggaagaacctgagttggggagattggggcatgtccctgtgcaggttcaggatgctgcagggcagggctctgttgacagcagggtgtggcttcatgacccccgcaccttctcttcccccctccctagggcttttgccaagaggcagcagcagctgaccgccatgaaggtgattcagaggaactgcgccgcctacctcaagctgcggaactggcagtggtggaggcttttcaccaaagtgagtgctctgccccagcccccttcccaggggcccccagccctgcttcttcactctggagccttcacatttgggacaggaggtggtcgcaagtgggtgtggaatggagggctcgaactcagaccttgagcattggcggttctctggcccgaggaggccctgtcctttggcacataggctatagccaggaccttaacacaaagtattaatatttccatccgcactggaatccctcgtgtggcccatttatagccacacccacttcctccgtagccatggaaaccactctgttctccagttctgtaattttgatggttcaagaatgctgccgggggcggcggctcacgcctgtaatcccagcactttgggaggccgaggcaggcggatcacttgcggtcaggagttcaaaaccagcctggccaacatggcaaaaccctgtctctacttaaaatacaaaaattagctgggtatggtggcaggcacctgtaatcccagatactcaggaggctaaggcaggagaatctcttgaactcaggagacagaggttgcagtgagccaagatcatgcctgcactccagcctgggtgaaagattgagactctgtctcttctttctttttttttttatttaaaaaaaaggccaggcacggtggctcacggctgtaatcccagcactttgggaggccgaggcgggtggatcacaaagtcaagaaatcaagaccatcctggccaagatggtgaaaccctgtctctactaaatgtacaaaaattagctgggcgtggtggcaaacgcctgtagtcacagctactcaggaggctgaggcaagagaatcacttgaacctgggaggcagaggttgcagagagctgagatcgcgccactgtactgcactccagcctggtgacagagcgagactccgtctcaaaaaaaaataaaacaaatattctatacatggaattagagagcatccagactgttgcatgtatcaatactgcaggtttttttttttttactttttgcattttttgaaatggagtctcactctgttacccaggctggtcttgaactcctgacctcaagcaaccctcctgcttcaggctcccaaagtgctgggattacaggcatgagccacctcatctggccatagcatattattttttatttctggcagagtcagggcctccagaggactcaactggttcctgtagtggcactggttgcattgtccccatggcacaaagacatgctctgttgcaatagactaggcttctccttatatgcccttgagtgtatccactggtgcaaggctttttcaccaagcaaacagacattgagtgcctgctgtatcccaggcacatgctaggtgctgggggtgcagctgtgaacacacaccatggtccctgacctccatgaatattctagccgaattggtggggagtaaacaataaacagataatcacagagacagatacataatggcaaactgtgataagtgcatgaagcaagctgctggagtacatagcaggggcttccttgtgccaggcaggggcttgaaaacaaagagttaggaggcagcccagggaaggacagcagatgctgctttttggaaatgttcgtccccactgaaccaacttctgaaaaactatcctaagaaaatcgtcttagccaggtgtggtggctcatgcctgtaatcccagcactttgggtggccaaggcaggaggatcacctgggttcacgagttcgaaaccagcctggccaacatggcgaaaccctatctctactgaaaatacaaaaattagccaggtgtggtggtgggcacctgtaatcccagctactcaggagattgaggcaggagaatcacttgaaccgaggaggcagaggtttcagtgagctgagatcgtgccactgcactccagcctgggtgacagggcgagactccacctgaaaaagagaaaagaaaatcaagagttaagggcattcattatggccttatttacaatagcagaatttcagtgtccagtcctagctgaatgatgagttcaataatggttcatctatcaatggaatgttttcagctattaaaatgatggctttggctactgaataggtctgctaaaaaaaaaaaaaaaaaagacttctacctagctgtctagttggacactgtggcatgtgcctgtagtcccagctactctggagctggggtgggaggatcgcttgaggccaggagttcaaggctgcagtgagctatgattgtgtcactgcactccagcctgggtgacaaaacaagaccatcgctaaataaataaattaacttaaaagatggctatgtaaagttgtaagaatgatgtaacagcatggggtaatacatatcttataatttttaaaaaaattttatttgtggagacagggtctcactgtgtcacccaggctggagtgcagtggcacaatcgtggctcactgcagcctcagcctgcagggttcaagcgatcttcctgcctcagacccctcactagctgggactacaggcacacaccaccatgcctggttacttgtttttgtagagatggggtctcatgatgttgcccaggctggtcccaaactcctgggctcaagcgcttgcctcggcctcccaaaatgctgggattacaggcatgcatcactgttcctgtctgtatcatataattttaaataataaaagcagcctctacaactaggcagcatggtcttaagtctattttttaaacatagaaaaagagccaggaaggaaatgtaaacaatgttaataatgactttgatagggaggtgggtgggatatgaaagattttttttctcccttttgtccttggaaggaaatatcacttttcagcagtagttctctgttgggatggttctaaagtggggaagatgagactttttcctttcactttgtaccttttctggtgctctgatttagagctcctcagtcttgccactgttgatattttggggtgactaattctgttgtgggggctgtcctgtgcactgtagggtgtttagcagtatccctggcctctacccactggatgccagaggcaccccccaccccagctgtgacaatcagcagtgtctccagacaatatcccctagtggggatcggtgggggcaacattgtccctggctcggaaccactgatcgaatttattatgacaacatatccctttgccacaaaaacaaatgatgggctaaccgtgtgtgtgcaggtgaagccactgctgcaggtgacacggcaggaggaggagatgcaggccaaggaggatgaactgcagaagaccaaggagcggcagcagaaggcagagaatgagcttaaggagctggaacagaagcactcgcaggtacctgtatggatgcatggctggggttgctggggaacaggacttggccccgtggggctcacccgcctcctccccaccacctgcgtgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggtaaggtgtcacaggggcagcccgtggtgggtagcaaatcacttgaccctcaccacaggcctgtggaggtgcatccagggatatgtgtccctgctgggacagatgatgagacgggggcttggagagggttggtcatctgatcaaggccacacagctgggattgggactggaacacagtgagcccactctgttctattgccctgccttgcatgtgctaaccccttttctcctaacagcaagcctgaatggaggataattgtatttgttagctattgctacataacaaaacatgccaaactcagcagctaaaaataaaaagtattgcatagtcaggaatttgagagtggcttaggtgagtggttctggctgagggtccggcctgaggttgcagtcaaggtgttggctgaggctgcagtcatctgaaggctcatctggggctggaggacccacttctacttggcttattcacacagctgttggaggaggcctcagttccttatcatgaaggcctctcccctcagggctgcttgagtgtccttccaatatggcagcagagttcccccagaaggagtgatctgagagaggagaaaggaagccgcaatgccttttatagcctaatctctgaagttacattccatcacttcttcctgatttttgttgttgttgttagaagcaaatctaacccccactcaaggggaggagaattaggctccacctttttggagtcgcaaagaacttgtggatagattttaaaaccaccatggtacctactgtgctcattttatagatgaggaggttgaggttccatgaagcagagcagcttacccaggtctttattttttttttttttttgagacagagtctcactctcttgcctaggctggggtgcgatggtgcgatctcagctcactgcaacctctgcctctcgggttcaagcgattctcctgcctcagcctcccgagtagctgggattacaggagcccaccaccatgcctggctaattttttttgtatttttagtagagacggggtttcaccatgttggccaggctggtcttgaattcctgacctcaagtgatccacccacctcggcctccaaaagtgctgggattacaggtgtgagccaccacgctcaggcctttatttcttccttttaggaggctacagagttctgggcatcttcaggcctagcccctgtattcattagtccccagatcaccacgagagtaaatctgttataaccaaagctgttactcttttccctccacaacaaaggaccttgaagaacagctggaggaggaggaagctgccaggcagaagctgcaacttgagaaggtcacggctgaggccaagatcaagaaactggaggatgagatcctggtcatggatgatcagaacaataaactatcaaaagtgagtaggggccgggtgcagtggctcacgcctataatccgagcactttgggaggccaaggtatgtggatcacttgaggccaggagtttgagactagcctggccaacagggtaaaactccatctctactaaaaatacaaagattagccaggtgtggtggccagtgtctgtaatcccagccacttgggaggctgaggcaggagaatcacttgaacctgggaggtagaggttgcagtgagctgagatcgtgccactgcactgcagcctgggtgacagagtgactctgtttcaaaaaaaaaaaaaagtggaatcaagtttctgcattaaaaacaacaggcttaccaggatcagggagattttggggatttgggactttcagttctcaaagcagaaaagcccttagaaaaccaggacaagctggtcaccgtagtcagtagtcactaaccagccccacctgcttttagttctttgagctggatgtcagcttggcccctactgtgagccaggctctgtgttagatgcaggtatgcatggtgaaggaggacccttcccttgtggggtttatactgtagtgagatggcaaataatcgtcatttaccatggtgatcagggctctgaaggaaacgttcaccatattttaagagtgcggcaggccgggtgcggtggctcatgcctgcaatcccagcactttgggaggctgaggcaagtggattacctgaggtcaggagttggagaccagcctggccaacacggtaaaaccccatctctactaaaaatacaaaaaattagttgggtgtgttggcgggcgcctgtagtcccagctactcgggaggctgaggcaggagaatcacttgaacgtgggaggcagaggttgcagtgagctgagatagcaacactgcactccaccctgggcgacagagtgagactctgtctcaaaaaaaaaaaaagaatacagcagtgggggatagaggaagggtattcatagaagacttcctggaggaggtgacatttaagcagaaacttaaagatgaaggagcagttagaggggagtagaagagcatctcagctggttggcccactgtgcaaaggccctggggcagggaagagctggccagtggcaggaatggaaggagggtacctttagctgaccatacaatatgagggacaaactggcacgagatgagaaatggccagtttttggaaattgttatgggacttctctttaccatttaaaactctagttgtattttgttataatgtgggtttttctttcaactgtttacatggaaatcactaaaagtgaaacatagattctagagaaaagaaaaatcctaaagctatctctttctctttccccaaaaaggaacgaaaactccttgaggagaggattagtgacttaacgacaaatcttgcagaagaggaagaaaaggccaagaatcttaccaagctgaaaaacaagcatgaatctatgatttcagaactggaaggtaaaccagctaccaagagatttatttttattttattttattattttttttagagatgaggtcttgctctgttgcccaggctgcagtgcagtggtgcgatcatggctcactgcagcccgaaactcctaagctccagtgatcctcctgcctcagcctcctgagcagctgagactacaggcgtgcatcaccacacccagctaatttttttttattttttattttgtagagatggggtttcactatgatgctcagtctagtctcaaactcctgggcccaagcagtcctcccaccttggcctcccaaagtgctgggattataggcatgagccactattcctgggcttgaatgggtatttttaaaagcaggaaaatcagaaaggaaatttgaggatggcagatcatcccatgagtgacaactaactctatgccacctctcgaaatcacccttagtcatcacatgcactaataatatgataaaagggctgggtgcggtggctctcgcctgtaatcccagcactttgggaggccgaggtgggcggatcacgaggtcaagagttggagaccagcctggccaacatggtgaaaccctgtctcaaaatacaaaaattagccaggcgtggtggcgggcgcctgtaatcccagctactcgggaggctgaggcaggagaattgcttgaacccgggaggcggaggttgcagtgagctgagattgcgccactgcactccagcctgggcaacaagagcaaaactccatctcaactaataataatattatgacaatataaggtgctgttcatcgggagataatggtccagaccgtgactatgatggttactgattgggggatgtgttcatctcctccgggtaaaatgcctgggcaggaaggctcatttccgggcatctctctggggcctccccttcctgaagagcaccttggtttttgcagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggtagcggggctggcaaggggcatttgctgtgtgtccatgtatcccctgggcccctgctcattcgctcattcgcagtggctgtcttggtcaaggcggccccaggcccttggcatgaacttcgtttcccaggccaggcctcccacaagccttctcgaccctgttcactcccccagatcctcaccttcgactttcttctcttccctgcaaacacatcatgtctttgcagttgatctcacctactcccatggtgttgctgctgcctcttcgacatccaggcttttctcatctagacccccttctgaatttccgattgcccaatgagtcaatttccaccgtcatctcaaacacccctgtctaaggcgggaatgaccttcctttccccagcccctccctctaagggccctcttttttgtgaacaccaatctcctcctttgtttctgccgacccacagcaagcagcaaccttcagattctgccagtccttctaaatgtcccccacccatttcctctggtttttccctcttcctggctcttagctggatttacactaatgctaatactgcagcagccactatgaatgattatttacctgctcactcggtgctaagttcttttcaagcaatacctttgcagacacctggccaggtgtactgccggtgtctttgaggaggaagctgagcctcctaggggtaacgcaacaggagcaatgtcattgcttctaagaggcagagctgggatttaagcctcaaagctttctgattgatcccctggcctggctcttttgtcggccaatttgtgctatgttgacagtgctacggtgatgaagggaaagcatctctctggggcaggaacctgctcacaaaactttgctggctggatgcagtggctcacgcctgtaatctcagcactttgggaagccgaggtggggggattgcttgaggccagcagtttgagaccaacatgggcaacatagcaagaccctgtccctacaaaaagttaaaaaatgagccaggcatggtggtgtgtgcctgtagtcccagctactcaggaggctgagatgggaggatcacttgagcccaggaggttgaggctaaagtgagctatgatcatgccactgcactccagcctgggcaacagagcaagaccctgtctcaaaacaataataacaacaaaacaaaaacctaacttcactggcttactagggaaaatccagtttccttagcctcaccctcagagcccatccaccctctgcagtctcaccccaacccaactatttcactttctctcttgttgctgccctttcacaagtacagtaaaatcaaagtgcttgcctctcctgcagcattctgccatttaacagggcttcttgcagcccaccttgatctctggtcaccacctccaccagatgcagagccccagtctgaatatcccccgcaagcagtggctggccaaatgctgtgcatggggcgggtactcagtcactgagcaaatgcagaaagaacagacagttgccagggaagaagaactgtccaacattcagaaagcatctacacagtccctactgtgaccaggtaccttgccagtctggggtcaatgctttgcattcttgcacacacatgcacacacgtgcatacacacgtacacacacccatgcacatgtacaacctgttttgatgtcagaccttggcactcacatcctatgttaatctcatatagtctggcatgtcaagaagcagacctggggacatggatagaaggtgtttgatgtctctgcaacataactgtctggtcccagaaaagtttttggccacattgtaagagaggaaaccaagggacctgggggttcattctgctgggtctctccctggaaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcaggtgaggggcccatcaatcccaccatcctgctatcccactgcaccaatgggatgggggcagaagaggggacaaacccaaagcaaatcgtgcatcagcccctgtgcatttaccttcctggccgcggtttgctttaacttatagaagcatggttggctgtttcttttttttctttcttttttttttttttttgaggcagtctggctttgttgcctaggctggagtgcagttgtgccatcttggctcactgcaacctccacctctgagatttaagcgattctcatgcctcagcctcctgagtagctgggattacaggtatgtgccaccacacccggctaattttttgtttttagtagagatggagttttgccatgttgcccaggctggacttgaactcctggcctcaagtgatccacccacttccgcctcccaaactgctggtattacatgtgtgagccactgcacccgaccctcatcatcttatttctcatcagaagagtagtatataccagggatgtacaatcttttggcttcccttggccacattggaagaaaaagatttgtcttgggccacacataagatacactaacactaataatagctgatcaactaaaaaaattttacaaattggaaaaaacatctcatactgttttaagaaagtttatgactctgtgtcaggctgcattcaaaaccatcctcattggtaagcttggatatactcagagaacaatttgaaaactatagaaaagcagacataaaaaaaaatcacctttagggtcgggctcacgcctataatctcagcactttgggaggccaaagacaggtggatcacttgaggtcaggagttcaagaccagcctggccaacatggtgaaaccctgtctctactataaatccaaaaattacctgggcgtggtggcgcatgcctgtaaatcccagctactcaggaggctgaggcagtagagtcacttgaatctgggaggcagaggttgcagtgagctgagatcgcaccatcgcactccagcctgggtgacacagtgagtgagactccatctcaaaaaaaaacaaaaaacaaaaaaatcacccttagtcacaccagttaacattcttgagaaattccttcctgtctgtgtgtgtatcagtcagtccccaagctccaattcccaagtatgtgtgtgtatcacttttgtgttaaattttaaaaataaaattgatcagattggttttcaattgaagattcacttcaaatgaacaaacaataacaaactgcctgccagatcacgaatcctgactctagtgaaactaggtcattgattcattcagtaaacacataaatgtattttgatgcaatctgtggtgttggcatagcatgtatcatagcatatagctatgctagctgtgccaacaccatataccctggggtttacttcccccactttgggttttgtgcagtgtcacatgcacatagagcacagcgttctgctcccttgccgcttggcctttgatacagaagagcccagtgcatgggccaggtatggtggctcatgcctgtaatcccagcactttgggaggctgaagcagacagatcacctgaggtcaggagttcgagaccagcctggccaacatcatgaaaacctgtctctactaaaaagacaaaaattagccgggcgtggtggtgggcgtcggtaatcccagctacttgggagactgaggcaggagaatcccttgaacctgggaggcagaggttgcagtgagctgacatcattccactgtactccagtctggacgacggagcaagactcgataagaaaaacaaacaaacaaaacaaaaaaccaggctgagtgcggtggctcacacctgtaatcccagcactttgggaggctgaggcgggtggatcacctgaggtcaggagttcgaaaccagcctgaccaacatgttgaaaccccatctctactaaaaatataaaattagccgggcgtggtggtgggcacctgtaatcccagctacttaggaggccgaggcaggagaatcgcttgaacccgggaggtggaggttgcagggggccaagattgcgctgtcgcactccagcctgggcaacaggagtgaaactccatctcaaaaacaaacaaacaaaaccatggactcaaggtcaaggtttagcttctaattctggctccatcacacaatggctgtgacaccatgggtaaaactgcttaccctctcttagccttagtttcctcatttgtaaaatggaaataataacacacctgcctctttgggttgctctgaggattagatgatgtatataaaaaacttagctcagggcctggcatatagtaactgctcattaaataagagccaacattaatatttaagcaaaattttgcagttcacagacatcctttcaattctattactttgtgtatttgtttgccagtcattacagatgtcctaggcaggtgatatgctccacattttgcagctgaggaaattttaggtccagagatgttaggtgaatgacccaaggtcacacagctagagaggggtggtgatgaggactgcagctctgggtcctggaagagctctcattcttttgcacggcactgagatgaccctctgtctccacccaactgccattcactgtgttcctcccaccaagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggtaatgctttttggtgatgctttttggtgatgacacataagagtgacatcagcagcctcaaattactacaggtcagggtctgcataaagacaaaaaacaagttacataagattctaatgatgatgatagcagcttatatttatttacaaaatgcttcccatacaggctgggtgaggtggctcacgcctgtaatcccagtacttggggaggctgaggcgggaggatcgcttgagctcaggagttggagaccagcctgggcaacatagtgagaccttgtttctactaaaattttaaaaaagtaggccaggcgtggtggctcaagcctgtaatcccagcactttgggaggccaaactgggtggatcacctgaggtcaggagttcgagaccagcctggccaacatggcgaaaccctatctctactacaaatacaaaaaattagccgggcgcggtggtgcatgcctgtaatcccagctactcgggaggctgaggcaggagaatcacttgaacccaggaggcagaggttgcagtgagcagagatcatgccattgcactccagcctgagcaacagagcaggattccatctcaaaaaaataaaataaaataaaatattggccaggcctggtagtgcattcctgtggtcccagctatttgggaggctgaggtgggaggatcgtttgagcctgggaggttgaggctgcagtgagccctgtcatgccactgcactctagcctggacgacacagtgagaccttaatcaaacaataaaaataggctgggcacggtggctcaccatgtctgtaatcccagcaatttgggaggcaaggcgggcaaatcacttgagctcaggagttcgagaccagcctggccaacatggtgaaaccccatctctaccaaaaatataaagaattagctgggtgtggtggcatgtgcctgtaatcttagctactcgggaggctgaggcaggacaatcacttggacccaggaggaagaggttgcagtgagctcagatcgtgctactgcactccagtctgggcgacagagtgagccgccatctcaaaaaaagaaaaaaaaaaaagaatgaatagaaatgcttctcatacagtatgtcaattaatcttcacaaccaccctgtgagacgtgtactattaaactcattttacaagcaaagaaactgaggtcctaggtgcctagaggtgaagagacttacccaaggtcacactgctggtaagtgacagagccatgatttgcacccaaacagtctggtcctagaccccactttctggcctctacaggactgaaggcctataggatgggtggggcctatcaatatactgcccttcagggataagcaaaggtgtaacaacactttcggggagatttaaatgaaacttaaaactgggatcattctatccactttaatttctctgcagactggaggaaggccaggcatggcggctcatgcctcccgtaatcctaacactttgggaggccaaggagggaggattgcttgagcccaggactttcagatcgcctgggcaacatagcgatttttcttttgtaaaaaaaaaaaagactggaggaaacttgtcattatttgatttcaatggcagaacagctctctccggcataatttgagaatgactaggtcaaatcactctcccgttgttggaactctttgcggtgtatgggagtgggagctggtaaatagcagtaccgaatgctgaatcttgggtgctcttctctcctttggggtagtgcctgtgcttcattccccagggtaagttttttagcttgcgaccttcggccagattgttttcctgaaagcctgagttacattaccctcagcgttgcagctcctccacatccccttcagtggaagcttttggttctgctagattaagtgggtgcagcattgcctaaaaattttggggaatttgcatttggttctatcactagtgtattggtccgttgttgcactgctctacagaaatacccaagattggattatttgtttattttttgagcagtggagtcttactctgtcactcaggctggagttcagtggcgtgatcttggctcactgcaacctccacctcctgggttcaaatgattctcctgcctcagcctcccaagtagctgggactacaggcacacaccaccatgcccggctaatttttttttttttttttttttttagtagagatggggttttgccatgttggccaggctgatctcgaactcctgacctcaggtgatccacctgccttggcctcccaaagtgctgagatgacaggtgtgagccactgcaccaccctgagattgggtaatttctaaagaagagaggtttaattggctcacggttctgcaggctgtacagaaagcatagcagcttctgcttctggggaggcctcaggaaacttaccatcatggtggaaggcaacggggaggcaggcatgttttacatgaccagagcaggcagaagagagagaatggggagctgccagacacttttaaacaaccagatctcatgagggcagcaccaaagggatagtgctaaaccattagaaactgcccccaaaggccgggcgcggtggctcatgcttataatcccagcactttgggaggctgagataggcggatcaccaagtcaggagttcaagactagcctgaccaacatagtgaaaccccatctctactaaaaatacataaaattaggctgggtgcagtggctcacgcctgtaatcccagcactttgggagcccgaggcaggcagatcacctgaggtcaggagtttgagaccagtctggccaacatggcaaaaccccgtctctactaaaaatacaaaaattagctggacgtggtggcggtcgcctgtaatcccagctacttgggaggctgagacatgaaaatcacttgaacccaggaggtaaaggttgcagtgagccaagattgtgccactgcaccccagcctgggcaacagagtgagactcagtttcaaaaaaaaaaaaaaaaaattatggttggaagagtgaggccccagacagaatcactgaccctccccatgcttggggttcattagacgtgaacaggagctagaagccaagcccattcccagccaggcctctttgggaagacgcagttattaagaccaccagcagacggcatgtccattactgacccgcacaaagcaggtagaggtgcaaacctctgcccatctcaggtgcagggaaacagaggcctttgcctctaacaacttgaattctgatgtagagacctggttccatctgcttgtgggggaaacgtttaacatcagctcctacctgggctccccaggccctcgtgcggtttggccccagttctggggtcttaggctgggctaaggtttctgggagcccatgtcccctagggtccccgcttcactgctttgttaccaccaagagactccctgtccccatctgaggtctggcagctcttagtcatgtcttggagggaggacgggcatccagggctgaccggtcaacgtccagcacctcccagggactatgggaagactgagtggtgggtctcgtcctctcgggatacttgcgcttctctttccccttctctacaacctggaaagaagcccctcaccgcgtcctacttttgcccaacacgcttttttttttgagacaaagtctcactctgtcgcccaggctggagtgcactggcgggatctcggctcactgcaacccccgcctcctgggttcaggcaattctcctgcttcagcctcctcagcagctgggattacaggtgactgccaccatgcccggctaatttttatatttttagtagagacggggtttcaccatgttggccaggctggtctcaaactcctgacctcaagtgacctgcctgcataggcctcccaaagtgctgggattctaggcctgagccaccgcgcctggccccaacacactttttttttcctgtagggcaactcacatgcctacaggagctggttccataaaataagtttcccttaactaggacagaagtagcagtgtcaatcacacgacacctgtgaaggacgggggcggtgaaaggtgactgccccacctgcagagccagccgctacttagatgtggcagattgttgccttgaaggaaagcaagaccctctgtttccagatctttcgttgttgttggttttttgtttttgtttttaagtttaggattactgaggcatatgtagtaaaatttatccattttactgctccattaattttaacaaatgtgtattgtgtaactaccaccaccacagtcaccacatagaatgttagttattgattgattgattgagatggagtctcactctgttacccaggctggaatgcagtggcatgatcttggttcactgcaacctccacctcccaggttcaagcaatacttgtgccttagccaccccagtagctgggactacaggcgtgcgccaccatgcccggctaatttttccatttttagtagagatgcagtttcgccatgttggccaggctggtctcgaactcctcacctcaagtgatccacctgccttggcctcccaaagctacttatttctgaaacagggtctcactttgttgcccaggctggagtgcagtggtgtgatcatagctcactgcagcctccaattcctgggctcaagcaagcctgccatccgcctcctgagtagctgggattgctggtgtgtgccccccacacccagctaatgttttattttagtagagatgggggtctcactacattgcccaggctggtcttgtactcctggccttaagcgatccttctgcctgcttcccaaagtgctggggatgacaagtatgagctgccatggcatgccttcaaacattaaagttttttgaaaaagaagctgggaatccagatttttatgtgacatttattaaaatgtcggcaactcatttttttaaaagtagtgaaagggtcaaaggggacatgtcagcaggttggataccgcttgtgggattccagattgcaacccatgagctttaggaaaatagaatccaaaatatcagctgggtgcggcagctcacgcctgtaatcccagcacttagggaggccaagatgggtggatcacttgaggtcaggagttcgagagcagcctggctaacatggtgaaacctcgtctctactaaaaatacaaaaattagtcgggcatggtggcgggcgcctgtaatcccagctacttgggcagctgaggcaggagaatagtttgaacctgggaggcggaggttgcagtgagccaagattgtgccacggcactccagcctgggtaacagagttaagactccatctcaaaaaaaaaataacaacaaaaaaaccccaaatctcttactggtgattgtgtgccccctgttgtgtgccttcctggacctctctgagggaggaaagggcagggcctgaaacgttctcccggccacagcctccctgttatccctcccctctgcttccttcgccaggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcaggtgaggaggtggcgcggtggtgtggtgggcagtgctgggtggtgcccagttctgtggggaggagcctcttcccggctcgctgaggtctctcttgctgcaaggcaagtcctttcctctagttgcgttcctggaggagaggcgatgatctccctgttcaattaaatattaaaaaaaccttctggccaggcacggtggctcatgcctgtaatcccagcactttgggagacagaggtgggtggatcacctgaggtcaggggtttgagaccagtctggccaacatggtgaaaagtctctactaaaaatacaaaaattagccaggcgtggtcgtgggcacctgtagtcccatctactcgggaggctgaggcaggagaatagcttgaacccaggaggcagaggttgcagtgtgcggagaccgcaccattgtactccagcctgggctaaaagggcaaaactctgtctcaggaaaaaaaaaaaaaaagaaaaaaaacccttccttttccaatttgataagtatttattgagcacctgctgtatgccaggcactgtgcttaatcctgagatccaacagcaaggaagaagagacactgtcgctgccccagtaggactccagccgagtaaggggaagggaagggaagggaaagacatgaataatcacacaaatgaatgtcaaatgatgcagcaaagggaaggcacatgatgcccaagtgtaaataaccagggggcctaacctgggggaggaggagccacgaaaggcttccctaaggagcatggataagtctaccaggcagagggaacagcgtgtgcaaaggccctgtggtaagtagaaaaattaggagagagacatacagccagtagagctggagtgcccagctggggttgggggtagggggagatagtacagagtggggttggagggggagcttgtacccagatgatgtagggcttttgagaacctattacatgtatgttgatccttactctgggcaatgtgaagctgttgaggggttttaagctgctgaatgacatggtctttttgtctttggtcttctttcacttggcatagccatttaccctgccttgccactcatggggacgtggccaaagttttcacaaatgtttaacatgtccacagccagggaccaaggggcgagggaagaattaagtgagatgtttttttctcacatgcagttgagagcagggcttttgccgccctcatataagcagtgtcaagatcattcatatcctccttgtcaatggaagagatggaggggtaggctaacagcctcaaagggacttatgcagagacactagggagtaaaagccagagaatacagagaggacgtttttacctttagggcctgcgtctctggctttggccatcagggtcaaagagtaggagtgaggaaggaagggatgggacagcatccctgggacgttcaagtaccatcctggtctcccttctccagccttagagagtggaccagccagagcacctcgtctggactctcagacctgctgctttgtctctaccaaccttggcagggatctaggatccatttagtgggatcaggtcccagtcaataccattggggctcaaataagttcttagaaccacagagtctagggccagggtcccaactcataggtgacggagttcccttcaagccacagattctgttttttttgtgtgtgtgtgtgtttttttttttttttatcagagtcccatacctcacgggtattttctcaatcagtgaacacctcaagtactagcccatgtgttttgagtaaaaagggctcctttcaacgaggatccccttctagaggctttgactaaccagtctcttggcacccttagaatgaagttgagagcgtcacagggatgcttaacgaggccgaggggaaggccattaagctggccaaggacgtggcgtccctcagttcccagctccaggacacccaggtgagtgtcctgccacatcatccaggggacctggggggtggccttcctcggggcaggtccctgggacctctttgcatcccttttgcaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccaggtgcctgccccgtgtccttgcttccttcatgggtcctctcaacttctctgcgctgagatcccccgcaggcagatcgcggtggagtgttggtgcgatggtgcttgaccccccagcttcccctgctattgggtttctccaacgaggagacatggtcttcgcttctcagagtctgtggggccagggacaggggccactcatggtccccctctcaccctaccctggacgctgtccttgtagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcaggtagagggcgtggggtgtcccccactctggccatggacgctgggttggggaatcagctctgcagagtatgacgcgtggctctggcctgtgcctgcatcccctctccactctgtggggagccatgggaggctgtcttatcttgtcttgggcgaccatggagcattaacgctaccaggtcacagtaaggatggcaaagaagccttgatgactgtgacttttctgggtaccagcaccatgagggtcacctgcacacatggtgatgccttagtttctagcctgaagaaggaatgaggtgcttatttattcactaaatgtatttactgaatacctattgagtagtattccaagtaattcagtttctatacttttaataccactcttccctaagatttcattctgtaaaattccaagtacacagcaaagttgacagaattgtacggtgaacacctttaaggccaccacctggattcagtcattgacactgtattatatgaactttatcagatacttattttgagacaggatctagctctgtcacccaggctggagtgcagtggtgtgatctcagctccccgcaacctccaccactgggttcaagcgattctcctgcttcagcctttcatgtagccgggattataggagcacaccactatgtctggctaatttttgtatttttagtagagatggggttttgccatgttgtccaggctggtctccaactcctggcctcacatgatctgcctgccttggcctcccaaagtgctgggattataggtatgagccactatgcccggcccacatatttatttataaagactaattctatctatcatgccttatctcttgggtacatttcagagcaaattacagatgtcagtacatttccccttccacacctcaacattgcatattaattagagtttatttttaaacacaattttgcttcttttggggtaaaacttacatgtgatgagattcacaaatcttaattgtacgataaatggagacccctgtatgacccaaacccctaaataccaacttttaagatacattattatttagtaaatatgatttagtttacaagtgactcagggttattctaaaaatcagtttgagaggccaggcacggtggctcacgcctgtaatcctagcactttgggaggctgaggcaggtggatcacttgaggtcaggggtttgagaccagcctggccaacatcgtgcaactttgtctctactaaaaataccaaaattagccgggcgtggtggcgcacgcctgtaatccctgctactctggaagctgaggcaggagaatcgcttgaacccagggtggggtggaggttgcagtgagccaagattgcgccactacaccccagcctgagtgatggagtgaaaaccctgtctcaaaaataaataaaatgaggattgtacagtgaggctaaatgccagatgcctgcaggttccctacccctccctgactgacctcctagtgtcaggattctagataacatcccagtttctcctcttcccatcagctacctctcctctgggctgtcagctcatcttcaatgcttcgttatctggttgaaggcctgaggttgcttttattttcctgtcacatagagtgtagtgcagtggcacacatagtgtgggatttttgtgttgactgtgccatttagaggtccctgtctttgctgaatactggaagtttggcttttggatgttacaatttataatctgctctgttctctctgaagatgagattaacgtgagcatggaatgttctctgagttgcttctccaagcagagagatatgtgtgcagggccacccatgcttaccatttccctactgaggctcttaggatacttttgtaagatattaatagctacttgtggccatgaaacaaactaataactagcttctggcagctttaaatctcactttgacctcagtgtgctctaagcaacgtgggcaggtctagtggtttcgaagcacaaggatttggccaggtgtggtggctcacacctgtaatctccgtgctttgggaggccgaggcaggaggctcacttgagggtcaggagttcgagaccagcctggtcaacatggcaaaaccacatctctacttaaaatacaaaaattagccaggtgtggtggtgggcacctgtaatcccaactactctggaggctgaggcaggagaatcgcttgaacccacgaggcggaggttgcagtgaaccaagactgcaccattgcactccagcctgggtgacaaagtgagactccatctaaaacaaacaaacacacaaaccaacaaaaaaaaacaagtcagctgatttctggctctgcataaggttgatgtagaagtcagaacgccagatgattatataaattactcccatagctaacctacactgcttacacctgcacctcaatacattcagcaggacacagggcttcccccggtatttacaattcagtgacgctgaccccggatatgcctagaagtcacctctgggtcttgtgttgtagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtaagtggctctgggtggtttttctcgtccatgtttcgcctgcccaccctctgtgctattcaccagtccatgcgaggctagctcctggcctttttcatagcgaactatcatcggaaatggaaggaggtttttggactggtgcaggggctgggaggggctgagaatggcagtcgaggatgggtctgagttggggggtccgaggataaggctggggtctgaactctcaggggtcatcttgagtcccggccatgcatcctgtgggaggccaaagccacctccctgatctcctgaggtgccgctcacggtgggtttctcaatcgtcttcatgaagttgagcctcatagaatggggctgcccgctctgccggcaggtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacaggtgcgtgctgccggggaggccagcagagggaggtcgggtggcctttttcattcctatcaccactctcatggttggtgtggaaacttcgttttctttatttttttttgaaacagagtctcgctctgtcgcccaggctggagtgcagtggcgtaatctcagctcactgcaacctccacctcctgcctcagcctcccgagtagcttggattacaggcgcatgccaccatacctagctaatttttttttttttttcagtggagacaaggtttcaccatgttggccaggctggtcttgaactcctggcctcaagtgatccattctcctgttggcctcccaaagtgctgggattacagacatgagccacccacgcccggcgtgattccgttttctcatctgcaactggggatgagatgcccacctcacaagggggctgtgctggggaaggggtgcagtgatgtgctgcctaggtgagccaaaggacctcccaggggcaagtggggcagcacacatctctattcctcgcccagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggtgggtgacactaggagcttggggcatgggtggagggagggcacagttcccctcaggccaccgaagtcagcagagcgggctccaggaagcaagcctgcacctgccattggtgtgggttcagctggggtttttctggaaccattcaggatttggtggctgtctcctgccctgggtagggcagcattattaggtatttggccactgccctcagatcacatcaggggctcagcttctcaggcaggtctgtggagcccacccagaatggtgctcccagcgcaccaccagccacctggaactgagagccatgctcgtgcaatgggaacttctttgtggtcaactgcagaaaatccaaggggtgggtgtgcaaagctgaactgggcagcagaacttgggggagtaaggacatctgagcttgtcctccctgttgactcatgcaggctcagatgaaggactttcaaagagagctggaagatgcccgtgcctccagagatgagatctttgccacagccaaagagaatgagaagaaagccaagagcttggaagcagacctcatgcagctacaagaggtaaagcctcgccttgctaggagagcctcagatgcgggtgtcacggtagcaccccttggcagctccagtctgtgcattcccagatttcatttcgtcctcctctggggtccacctgtctagaaagacacacgcttccctcctctatgtattcacggggcctcccctgagctcagaggaagaacatgtactttcaagggtggctgagttgtcagggtggactcttggtggggcttggcctttccctggcagacaacagccttcctccctcccacctaggacctcgccgccgctgagagggctcgcaaacaagcggacctcgagaaggaggaactggcagaggagctggccagtagcctgtcgggaaggtaggaaactgaatggaggaagagggctctgaagcagaggatggggggacaggcagcatcctcgacccccattttattttttaaattttttcgagacagagtttcattctgtcacccaggctggagggcagtggcacaatcttggctcactgcaacctccacctcccaggttcaagcaattctcctgcctcagccttctgagtagctgagactacaggtgtgtaccaccatgcctggctaatttttatatttttagtagaggtggggtttcaccatgttggccaggctagtcttgaactcctgaccttaggtgatcctcctaccttggcctcccaaagtgctgtgattacaggtgtgagccaccgtgcctggccctggacccccatttcaatgctgctgctgacgaagcgtcctctgagattggggacagacccatggtggttaggttttccgtcagcgctttcatgcctgtttgggggtgtggctgctttcattcattcccaataagtagctgtgtggggagaaggggaggccaggaagagtcagggaggagtgtgctggtccccatcccaatcccagctttgctgacacggacccggcctgagtcccggctgtccacttcctggctgtgtaactacagatgagtcttctaatcttctccaagcctcagtttcacccattagatgatgagggcaatacccctgaggcatgactccaaggagggggcatcttttaaggcgggggagggtagaggcccccaccatggccgcccttcccccaggaacgcactccaggacgagaagcgccgcctggaggcccggatcgcccagctggaggaggagctggaggaggagcagggcaacatggaggccatgagcgaccgggtccgcaaagccacacagcaggtgagggccgcctggacaccacagtcacgctgcctactgtctctcctgcagcaggatcctgcaccagtcaacacacgcgtggcggcttcctgtgtgcaggccctggattgagggacaagagggtggtggggcctgagagtagagatccagggcccttacaccagtgcccaggctgctgtcttcagaatactcctctccacgctgcagtgtctcattttccagccacggcgtggctggctccccgtacctcacggccatccctggagtccgggccttgggatgctctttcattgcgttttcccctagctgaagctctgaccttatccagtgagcccttggtgatgtcactgagcactagttccatggtgggcactagggaccatccagtaacctgcagccccttgtggtgtagggtgaacaggcatcattctccaggcgactccaggacagagaaagcaagggacaagtcactcgctcagcctgggtggcactgacacttgtggaagcacctcttttttttggagacagggtctctctgtggcccaggctggagtgcagtggcgcaatcttggctcactgcaacctctgcctcccaagttcaagggattctcctgcttcaacctcccaagtagctgggactacaggcacgtgccaccactgcccggctaatttttgtatttttaatagagacggggtttcaccatgttggccaggcaggtctcgaactcctgagctcaagtgatttacctgcctctgcttccaaaagtgctgggattacaggcgtgcgccaccacgcccggcctggaagaagctcttgagtggagttttacaggatgaaggagaggacagggtgcccgggatcaagggactcgtgcagaggccaaacaaggcaggaagaggcatggtctcagtgcgctctcttgggcttccctgagtccgcctcatggccttcactctcctccccaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccaggtatgcgggtgtggagttccgaacccagtttgcaggggggtgatggacagcaggagtcatagtgaagtcagggaacctcttccagcatcagttctggcttgtaagaagcaagctctgtgatgcctacagtgcaggtatgttgtgagaactgaacgtaaacacagcaaagtgccctgctggttcctggcctagggcaagcacctaaagtgtgagctgctcttagcatctccatggtcctcctgacattaacctgccttcccagcagtacatatgacttttcccagcctctgcagggatagcatgctgacagatcaaaaatccaaccaggctggacgtggtggctcacgcctgtaatcccagcaatttgggaggctgaggcaggtggatcacttgaggtcaggagtttgagaccggcctggccaacatggtgaaaccctgtctgtaccaaaaattagccgagtgtggtggcacatgcctattatctcagctactcaggagactgaggcaggagaatcactccaacgtgacacgtggaggttgcagtgagccgagattgtgccactgcactgcagcctgggtgacacagtgggacccttccacacacatacacacacacaaaaaaaaccccaaaaaacaaaagtccaaccggcagcccatttggtacacacactggaagccttcttaattatgggtcgaatgaggcatatgatcacagcacatttcttaccattggattctaaggattctcacccattctcttctagtagctttttcagtaattcgcacgccctgcaatgcacccatttaaagtgtataattcaagggctattcatatattcacaaacatgtaaaaacgatcaccacagtcattttgagaacattttcatcggctcaaacagaaaccccaggccatatgtggtatttcatgcccataatcccggcactttgggaggctgaggtaggtgggagcagcacttgagtccaggagttcgagaccagtctgggcagcatagcaagacttttttatttttatttttttgagacatagtctcactctgtttcccaggctggtgtgcagtggtgcgatctcagctcactgcaacctccgcctcaccctcccaagtagctgggactacaggtgcacaccactgtacccagcttgtaattgtattttttagtagggatggggtttcaccatgttggccaggctggtctcgaactcctgaccacaggtgatctgcccacctcggcctcccagagtactgggattacaggcatgagccaccacgcctggccagagactccgtttctatgaaaaacttttaaaagtctgagcatgctggtgtacgcctgtagtcccagctacttgggaggctgaggtgggaggattgcttgagccaggagttcaaggctgcagtgaactatgaactagggtgaagagcaggcattggagcaccactgcactccaacctgggtcacacagcaagaccttgcctcctccccgcaaaaaaaatagaaaccccatgccctgtaaccactcccttcagtccctggcaaccataatctactttctgtctctatgaatttatctattctggacacttgatatcaacggaatcacacactatgttgtctgctatgtgtcttctttcacttggcaagaattccaggctcatccatgctgtggcatgcattgatactttattccttttcatggctgaatactattccaccatctgactgattcttgagaggagtccagatacggggctcaggaaagcactcaagatgccacctccaggtgacacaccagctacaaggggtgccaccctccgctgaaaccacctgttttccttgctgtttgcagagagaaacaggcggccaccaagtcgctgaagcagaaagacaagaagctgaaggaaatcttgctgcaggtggaggacgagcgcaagatggccgagcagtacaaggagcaggtagcccctgccacccagcctccctcgagcccccagcccccagccggcctcccctaaccacccctccaactctccgcgacaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggtgaggagcccgtggcccgggaggaccccgtctctcaggccagagaaaagcactgggggctcgggctcctttcggcctgcaaatgccccttgtgcccacagccgccactcccttctgtggtttattcctgcttctccttaatcactaagcttagtgtgggccaggcactgagatcagacccgggccctgccttgcctggtagcagctaaccttctagatcctttaacgatcgaccgtctcccatccggtcctccggctgaggaggaggaagaggctatccccactgtctcctccagcccctccttcattgcatcactgagtcttcacgacatccattgaagctgcaacaccaccccccgccacttcacctccttcctgacatgctctgctcctcctttctccccctcagcactgctgccatctgggctgcattattctcgggtatgggggctgtccgacattccccatcagaaggaaaaagatccctgaaaagtagcaggtgcttacatttctggcctctacccaccggctgcagtagtcccccaccaccctgcaatgtgacaaccaaaaatgtctctagatgttgccagaagtcctctagagatgggagggtacgactgccaccccgctgagaattcctgctgtcactggagtgggggctgttttctctcccatgcctctggtaccttgggggtcccccctgctcccaagggctgcttccaccaccctgtccatccatcccgattggctcccaggaggttttagctccgggcttcctgtctcccacaccactcctcacagttctccatgatttcaacatccaggtgggcgacgcagcctctcggttccttgaccctctgggtgatcctgctgcttctaccgggccaaccagtactcctaggagccctcacaatttgaccctcaggcatcccattgtctgcctggtgccacctttctttggctctgtccccaacggggtcttcactccattaatgccatcagcctctgacccagctccaaaccagctgtctagtaacccccgtcgcgcatcctcaacatccggttccccctcttgcattgctgcaatcatttggtgaaagcacaacccaaatgaaactcaagcttggctgggcacgggactcacacctataatcccagcactttgggaggccaaggcaggtgaatcgctttgagctcaggagttcaagagcagcaagaccccatctctacaacaaacaaacaaaaatcagccaggtgggatggcgcaaacctaaaatcccagctactcaggaggctgaggtgggacgatcagtggagccccagaggtcaaggctgcagtgagccatgatctagccaatgcacttaccctggatggacagagtgagaccctgtctcaaaaaacccaaaacccactctccaccttttcccacagagcaggccttgctcaggggtcctcccacacccctccctcatcttctcactctctgctgcttttcactttttctttgaacttatgatcgctcctccccattctctctcagctggggaccttacttcctacttaactcaaaagcagaaatgatcatgaaacgtgcacaagctcccactgcctcatcatcctacctccgtgcacctctgtacacttctattttttttccatttctatgctgaaccctctggcaccaaccgaggccaacacctccattggacccgaccctcttgttcactcaagcacatagctccaaaaatccttattttgcaaggttttctctttcatttgctccatcagcaaatggaataacctcttagccccatgtctaccttgctacccttactacaaaactggatgtgaatgccgaaaccctgtctctaccaaaaaatataaaaattagccaggtgtggtggtgcatgcctatagttccagctactcaggaggctgaggcacaagaatggcttaaaaccgggagagagaggttgcagtccagcctgggtgacagagtgagactcggtctcaaaaaaaaaaaaactgtatgtgaagagttgctggttcccctcgcccccacccatcactctcccagaagcctcccatgggtgacactaatggccagaggtcccctgacagggcagcagcacgtgacgcagtccatcatgcctctggcctaattcacttgcttccctggacttccccgacaccatccacacctgcttgtcccccgacctgtggggttgtccctcttcctctcctctgctgatccctcacctcgaaacctgcttgccactagaccgccccagggtatcaacttagttctcttttgggcagagtcttgctctgttgcccaggctggagtgcagtagcactatctcagctcactgcaacctctgcctcccagttcaagctatttttggcctatttttatatttttagtagagatggggttgcaccatgttgcccaggctggtcttgaactcctgatcttgtgatccacccgcctcagcctccccacgtgctgggattacaggcatggaccactgcacggccttagttgttttcatctctccccagcgctaggtgagaggtctcaactaatcttggcgctttagaattccatgtatatctaatgactcctcagttcatctctgagaagccctagcttcttcctagaacctcagaccaccctcccgttcccacatggatgtctaataggcagctcacaccaaacatgctgcaccccaagtcctgactgaaactcttcacccccaaactggctcctctctccagctcagcagctaaaatgatgaagttgccaacaattcacatcacaaacctcgtggtccttcttaacgttttggtctcctttataccccacatcccatctatgggagaatctggtcaactttccctaaagaatcctgcccaggctgggtgcagtggctcaccccttaatcccagcactttgggaggccaacgcaggctgatcacctgaggtcaggagttcaaggccagcctgaccaacatggtgaaaccccgtctctactaaaaacacaaaaattagccgggtatggtggggcgtgcctgtaatcccagctactagggaggctgaggcaggagaatcgcttgaacctgggagacacaggttacagtgagctgagatcgcaccactgcacttcagcctgggtgacagaccaaaactcggtctcaaaaaaaaaatctccagtgtctaggacagcaccaggcagagtgaacctttatccctcgggtcctagatattttccccgcttcattctcataccaccacagccatgtgctgagcctcttactacctttaataccaatgacttgatcttttaacagttttaatcatacatgaatataacggcaaataaacatacctcctctatatttttaaaccagcatcacctctatcaactggttacgatgaaagtaatatgataaaaatagtatcaagttcaatatctagctattgtggccacaacttgatcaccaagacctgaagcctacttctccactaaaaagggagtgacaacagccattagcaccaaatagactctctctgacatcataattagacttgtttaaaaagagttggaaaggaaatgactttctcagggcccagttcagttagcggatggcatgcccggaagccatctgaaatcacctctagagtttggggaccactgcgtgagacagggaaaagtccaaacccctctgagaaggggaagagagcagctggcgcagggcaccaagccttcagggaaaagccccactcgctgcatggtgagcgcttgttggtcccccatggataggagagaaaccaggcctaggctcccaaagtacagcaggggcctggaagcatctcccagggttgaggggtcagtggaggagagctgttctcactgtgaagactcctggggcaaagcgcggtggctcacgcctgtaatcccagcactttgggaggctgaggtgggctgatcacctgaggtcaggagttcgagaccagcctggccaacatggtgaaacttcatctctactaaaaacacaaaaatcagctaggcgtggtggcagatgcctgtaatcccagctactcgtgaggctgagacaggacactcctttgcaacccaggaggaggagcctgcagtgagccaagatcaagcctctatactccagccttcagagcaagactctgtctccaaaaaaaaaacaaaaaacaaaaaccctcagatgtgctctgctggcaaccagtccccctgcctctcctgagtggctgggctgagcgatggggatacagccactctgactccctaccccactgctgtctctgcttccctttctcaggcccagtgatttcttttctttttattatttatttttagacggagtctagctctgttgccaggctggagtgcagtggcgcgatctcggctcactgcaacctttgcctcccaggttcaagcgattctcctgcctcagcctcccaagtagctgagattacaggtgcgtgccaccacacctggctaatttttgtatttttagtagtggcaaggtttcaccatactggctgggatggtctcgatctcctgacctcgtgatccacctgcctcggtctcccaaagtgctggggttacaggcgtgagccaccatgcccggccggcccagtgattctttagcacacactggacacctcctgtgggttctgccccagacacttgagccttcttgggcagccaagggcaaagtggaacaaaaagaccatttttgccagttccgacacgaatacacacataatgcaggtggaaggtctgtcctgccttctgcatcttttgggtgcacaaaaacataaaatcaggcactagagccctgagggaggttggtaagcatgcctggctcctcagccaagaaggaactgtagtgcgagtttcaccaagttctatcagccagacgcatctcgacacaagccctctctaaagccagacccacttacctaccactggctacactgccagttacctccggcaagagctgtacaaggcctccacctctcctctcttgctagaggcccgaaagctaatgaagagcaagtaatcataaaccaagggacaggcggctgcaggttccttgcctgggacttcttggcttctgttccaacactgatttctcaaactagcttgctcaaatgcttttacttccctgaaccagtatgcaatcatgggatttataggaggttcttaaaagtagctctaaaggacagacattttcctttccatttaaaaaactgagccgggtgcagtggctcacacctgtaatcccagctctttgggaggccgaggtgggtggatcacttgaggtcaggagttcgagaccagcatggccaacatggtgaaactccgtctctactaaaaatatgaaaattagccagccacggtggtgcatgcctgtaatcccagctactcgggaggctgaggcaggagaatcgcttgaacccgggaggtggaggttgcagtgagcagagatagatcatgccagtgcactccatcctgggtgacagagtatcaaaaaactgcttatcctttcatctaccagcctcaccaaatgctcttggcgtcaggtgattcactgcaacgttgacttaagggtgcttttaatgccaggtgcggtggttcatgcctgtaatcccaaatcccagcaccttgggaggccaaggcaggaagatcattgacatcaggagttggagacaagcctgaccaacatagtgcaaccccatctgtactaaaaatacaaaaattagccaagcacgtggggcctgcctgtaatcccagctactcgggaggctgagacaaggggatcacttgaatccaggacgtagaggttgcagtgagccaagatcgcacccctgcactccagcctgggtgacagagactatctcaaaataaaaaagagtgcctttaattattaaatcgaagcaaatgtctttaacaattaagaatatacttaaccgggctccttcttgtttgctgatggtaacctccggggattctctctctgtttcagagggccccccccacaggaaacttcgcagtgatgcaccaggtatcatgccttcagcttcgcagctgtgtgttgtctcagtatccatttcttttctgcccaatgcgcccctctgcccaccccaatttttaaacccttgcacatttccacgagattcttgcaaaatctggaggcttggatatctttgtgcaaagctttcattgaaaccaagatcaggatgacaaatagacctcatctcttgacccactgtccttcctgcctctgggcagcacatgtgacatgacacccaacagtgtgcgcccttatcactgcatcttgacgagatggcagaggctgtgtgtgtagcttggatttttcttcctttcatgccaaaagccactcttacgtggttagggcactcagcagtgctgtcctcccttgtccagtgaagacactgcactgaatgaatatgacagttccactatctgggcacattcctggagaacgtacttggcttctagttggctggtctgggtcacaagtcagagatcacaaagttcacggtaactgcggcgcggcaaccagtcctcccatgattcagctttcacaggcttgtctgcgaaggaaatgagctcactgcgatgtctgacaaatgccgggggctgcacgtggcttgagtgatgtctagctacaaactgcattttcagcacacggggtggaagctgaccaccgcaaagccaagcacagtcctggcagagccttttctggaggcttcacgggcatgtacatgttcagggactggggagtggatacccaagactcaaggatgcacacagggcccttcccaagaaagcatgaagaggtctctgctgctctgggattttgcttttttttttttttttttttgagacggagtctcgctctggagtgcaatggcgcaatcttggctcaccgcaacctttgcctcctgggttcaagcgattctcctacctcagccttctgagtagctgggattacaggctcccgccacctcgcccagctaatttttgtatttttattagagacaggatatcaccatgttggccaggctggtctcaaactcctgacttcaggtgatccgcgcgccttggcctccccaaatgctgggattacaagcatgaccaacttttcacaggtgaagttaggccatgtggatctgacttcacctcatggagaggccaaaccaaccctcatttgtgtccatcttcatttttggagaatctcagctttgctgtcactaccaaaatacttaaagcgcagggtgaggtcttgttaagagccagttttgtgggggagcagatgagtttctaggacacttcaagcagctctcctaccagctgattgggatcataggataagccaaattccagggtgggctgaagtgcagaacccactggtcagtgggaaactgagtccttgcaaactagcaggtgcttacactcaagatgattcccgaggccttggataagctgagtccacgaatagaatccaaatgctaggccaggcacagtgggtcatgcctataatcccagcactttgggaggccgaggcgggcagataacttgaggtcaggaccagcctggccaacatggtaaaaccccgtctctcctaaaaatacaaaaattagccaggagtggtggcatgtctgtagtcccagttacttggaaggctgaggcaggagaatcgcttgaacctgggaggcagaggctgcagtgagccaagatcacgccactgcactccagcctgggcaacacagcgagactctatttcaaaaaaaaattccagattctccaggatcagaccctttaagaaaacctttaggggggtcccttagttcctgtaacaggtatagttggtgtcaaccttggtctaggatttgaaaccagttccaagaaaagcacttcagccaaaacagagtatcttgcaggctgacagccaagcaaggagcttcaacggcccagggcacaatgtatttcttaggtcaagggagcaaatttatccattaagcttttccagttagcaaatagactcttccaagagccaaaaagagagtgcctagagcactgatgtggaggttagggactacttcccagctcatcagatttttttttgtttttttttttggagacagtcttgctgtttcccaggctggagtgcagtggcacaacgttggctcactgcagccttcacctcctgggttcaagcaattctcctgcctcagcctcctgagtgactgggattccaggcgcctgccaccacgcacggctaatttagtatatttagtagagacggggtttcaccatattggccaggatggcctcgaacaactgacctcacgagtgatctgcccacctcggcctccccaagtgctgggattacaggcatgagtcgcagcaactggccaacccatcagggtttgaacctggagttaaaactgtgacgaagagagctgtgtggggagcgtacagggaacagtcaaactgctgctcctctgcgctgaatttgagcatccttctgagtcaagcgcttggaaaacagtgctaaaaaagaaaaagacttaagggtcacatctagagagagaaggatggagagttctctagtagggctgcaagtccagaagcttctctgtgaagctgggctaggagtgtttactttgaagtggctgcagctttaagtatttattcctgatcgctgcactgcgggaagtcccatcctttatagccaggtgggctttcccagccggggtctctcccatcctctgtcaacaaaagggtcatttgcgaattcctcttctcagtgatcatgaatctctgggccttgatttttttttttttttttttttgagacggagtctcaccctgtcgcctaggctggagtgcagtggccacatctcggctcactgcaagctccgcctcctgggttcatgtcattctcctgcctcagcctccctcccgagtagctgggactacaggcacccgccagcacgcccggctaattttttgtatttttagtagagacacggtttcaccatgttagccaggatggtctcgatctcctgacctcatgatccgcccgcctcagcctcccaaagtgctgagattacaggtgtgagccaccatgcccagccgagttgttccttttgactaaagaattggtcactgagttgtgttcatccttatggcttcttatccaacccttgcgtggggagcaaaagtctgctctcttctttgatgtcctaaaataagacctgtcttccgattcaggtcaaacagggccagatggccagagcccaacataattatttgttgcggttgctgaaaagagttaagtgtttcttctgaacggtgaaggctggcagcaggcagatctgatttttccttcttctgcccactctcttcctcctacccaaagtctcccctcacgtgaccagcccttcctgtgaagtcgaggtgataaactcaagagagaaccagcgcagagaggagatggcagcattaaggagagacaggggtgtcctactggctggagctaaaatccacctcagaggccaggtgcactggcacacacctgtaatcccaacactttgagaggctaagacaggtggatcgtttgaggccaggagttcaagaccagcctgggtcacatggcaaaatcccatctctgctaaaaatacaaaaattagccaggcgtggcagtgtgcacgtgcatgtagtcccagctactcaatactgaggctcaaggactgctggaactcaggaggcagaggttgcagtgagccaagatcatgccactgcactccagcctgggtgagagagactcttaaatttcttttttaaatccaccttgaaggccaggtgtggtggcccacgcctgtaatgccagcgctttgggaggccaaggtaggagaactgcttgagctcaggagttccagaccagcctgggcaacaatatcaagacctcatctcaatttaataaaataatccaccttggattaacacgtataatttccttttctaatattcactgggcacctgttttacgccatgtgcggtatgttccacgatcagcaaaacagatgcagcagtccctgcagtggggaaaactcagtccatgaacattcacaccagcagggggtgctgtctcgccttttaaccagggagcccctctgtgtccttctcaaggctgcccttgtccatttcaccttcttccaattcaaatcttgaaaactcacctctaaggcgaatgggggtgaggagatacagaagaaaaacagtatgttctctcttcaactctgccccatgggctatgaataaagtcagaagacaaaatcccctgcttggtttttggcgtttttttcctattctaaatcaaagaccacagcagaccagaatcctgtggcttctcaaatgaccaagcctgacatattgaaaagcagatcgtcttgctttgaaaaaccttctccacccacccccgcaaccaatttcagctgattaaattcaatcactcatgccttaagactggcaatgatttgttgacttcaacttgaatatctgcatcttatttgtgccgtgtgtgttttctgccataaaaaaaatttatattgcaataggactatagctacaagtttaaaatagatttataaaaaatctatcccaaccatgaagatttctttgctaaataatgtgttttcttacaacccacaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcac

SEQ ID NO: 35890 - DNA, 153875 bp, Homo sapiens; identical to SEQ ID NO: 35889

SEQ ID NO: 35891 - DNA, 153875 bp, Homo sapiens; identical to SEQ ID NO: 35889

SEQ ID NO: 35892 - DNA, 79542 bp, Homo sapiens
gggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgggtgaggagaacaaagtggctgcacgattttccccactttccagcccaccccccgcttccgtgggagcgacaggaaatggaagggcgcctcttctctctttgaacatttgccttttttcccctcctttccacctctccagaaaggaagacgggaagaaagggcaggcggctcggcgggcgtcttctccactcctctgccgcgtccccgtggctgcagggagccggcatggggcttctccagttgctagctttcagtttcttaggtaattccgtggaaacggtgcggggaggcggacggacttgggcatggggaaggaaaacccaaaagctgcttgctcaccttcgtgggatcctgggggcttgggagagggactggatggaaatgacgcccctgggattaaacgccaccgcccttgcttcggtggtggctggagacagcgcacgcggagcgccgcggaccctcatcccccgggctctgcgcccaagccccggcccctgcggcctcccgcggcccccgctcagggttttgcaccctcggccggttcaccctgggtttccccaccgcagagggcaggttccctggggttggcggtgctgaccgaggagggctctccaaaaatccattgcccaggagagtgcctgagctgagcggaggcttcattctgggaacagatgggggccatgtggctttaattaaccatctctgtttgtctccggatggcaccagaaacagcaggacctggcgcttccctggaatggagaagccttgaaaccactccagagccccagggactgtccatgggctcccctagctccggaaagcggcgtccaccgcgagccccggcgcctcgtccccagcgaagcgccggtgaccctcgcgcgtgcacgcacacgcactctcgcttcccaagctcacagatctccacgcgcacactcacaccgaggatgcgcgggctgccgcgtgcacgcgggttcacgtgcgtgggtgtgtggccctttgggggtcagcctccctgcgccgggctccggacacgtcgaagtggagggtctacacatccaccctttgttgggggagctgctccccggggctgatcagggtgggcgcgagcgtcggtgggtttcccgggagggaggctctcgctgctggacagacctgatgacgtgtgtgggtttctttccgtgtccttctcctttcggagtccctgccttcccagcctctcctgcgctcatctctccattgtcttttctgtgcattttgctttcttccgaatggactgtcctctctccgcacccactcccccgcccccgcttgttcgtttttttcgggctccactccctgcttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggtgagggctgagagcggggttcgaggctctgctagcgcctcctcccgtccagacctaaggggcaggccctggggactccgcatccttccagcaatccagataggaagcgcagccagccggggagtcccgggattaggcttgtagctcaacctttcgccccatctcagtttgcacagttgcatccgccacacatttcctgccggcgcggtgagtatggaaaggcaggactgccgacagccctggctgccctgacccagagcctccaaaaggcctgattgtgtgtgtgttttttaaaactttagttttggaagtgtgcattaaaggtgatttatcctctttttaaaacccttgggtttccccacccccctctaccgcatcttcacttgggtaaagaggattccagcaatgacaggcgtcttgcaaggtgattccaatcactgaacgaacccgttttcctctcctcatttggtgctgttcccaactagatatcaggatcagatgcttgcttttacgaaatgccctggttgccatggtaccctgatacaggaagaccacagtgaaatttcagggtgttacctgtttctaaaagagggcccaaattttagatttcaggggtcatatttatacaaagtcaaaagtaattttaaaagaagacacaaagtgtaaaatattcagaatcagaatacttttccttcatttttaaaaaggaggctggccgggagcaaaatggctccatgcctgtaatcccagcacttagggaggctgaggtgggaggatcactggagcccaagtgttcaagaccagcctggacaacatagactcagtctctacaaaaaatttttaaaacttagctgggcgtggtggtccacacctgtggtcccagctgtctgggaggctgaggtgggaggatcacttgagcccagtaggtcgaggctgcagtaagcgataatcagtccactgcattccagcttgatcaacaaagggagaccctgtctcaaaaaatttttttaaataaaggctgatatttctggcctctaacaaaagcagaaagtatcagtttcacattcggggcaagttccaagctaattgctcagaacatggtcagcccacccacctgtacaattgcccttcagaaggaggacagagtattgtgtgtggtttgcacagcagatcccttaaaatggagtcacttttacaaagcagaaagcccattctggagacctgatcaattagaccaaaggaatgtggtaaagtggattccgttcatttgcttccaggtttatacagagatgtctagactgcttcctcctgattagaagggaggctgtaattaaacttttttaaactttttttttttttgagttctggtgattgttctccagtactagtttccttgactacaagttattgaaggcagttgatgttacttttctaatattagcatttaaattttacctacaatattatgctaacacttacttgagaggccaggacatcctgtaaatgaatcaccagattctgaaatcagctttgaccaaaatgagaatcacactgtttgtattaaaagcaactggaaagactatcctctcagtgatgatttctatagttcgttactagagaagtttctctaaacatgtagagagcatcagaaaccacaaaaaagaggtgcagcggtctctcctgagtgtgaagctggctcttggtattgcttcttggttcttctcttcctttgggagagtaagaggaagaggatgcagtcttagtagtttcccttaaaaaaaaaaaaaaaaaaaagcaactggagccaggctctctggtatatatgattagccatgcatttgtgaagtgcttttcacagatagggcctaaagaaagggactggacatatgcttttctcaaacatctagtgggcatcaagattgagacaggaagcttgttttatccaggctcctaatgcatccctggctttgggtctctgttttttagacagtacatcttgccagtctccaaatccttttgagaagaaggtaataactaaataaatacgatgtgaaatacaacgtaaaagtacggtcagttaattgtgtccttataagaatattacccttaaatgctgtttgtaacatacatgtgggtctctatgtatttcagtcttagcctcattttcagacttaagaatagtctgcatttcagaaaatgtaggtacagagcaaagctccttgtggaaagagaactattaagctctgttgtttatgatttgccttgatggaatgcacaggaagtagataactctcctaacccaactgcccaggtggctctggctcccattttaggagaaagaaagtaagagaaattcaaagctaacctaaaacttacagtctatcttcatcctagttcatgcccatgttggggttctttgaactggccccagattatagtgggcccaacatggcgtggtcctcccaacagcctggtcctcccttccccagatattctgagcaatttgcaggttagcctgcatgccaccaccattgattcactgctcgggcagggtggaaacgaagaaatcttgttctgtggttcccaaagcttctctaaatacttctgcctaatacttggtttctgcttcatttaggttttagaaaatcaggccaagtgaactgtatttttttctttcatttttagtttgctttatgtcagcaaaaattctctaatatctcctctgcattttactgtagagtaagcttctctagctgtttattgagattaaggtttaagcctagaaatttgattttggttaaattaatagcttgtggaaacaatgccctcttttactttagatcttgaatttgcaaggaaggaggaaattattttcaagactattttagactcagcaagttaaaagtgaaagatgtgatacaaatctcctaagcaattttcacacaattatttttcttgaagctaataggttgatttttgtattaggagcttcatggggtttttttaattaaaaatgtttttaatgagattgctttctagactgatgaactcaactttgtttgtaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtatgtggttggtgtggggacaagttccgttgagtgtgattgataacttgggtggagcttacaggttcctgggtgtttgtaattatgattcacttctctgtcctgtaattatggcctctgacagattgactgcctggagcactaacttctcttggtaaaatcttatccttcttcctgaagcatgtatttcctataagaaagcagtctgtcatgctagaccaaaggagcatttcatagtccttattctgaggggcttttggagagaatacttgtgtgccgggggctgtctggggagggtatgggtactatctcaggcccttattcttccacaaaatgtaacatctttcattttgatcaatcccaaaggaaggggcagaatcatagcccccactcctccccccactgccttccttcatctacagaaagtgtcttgatagtaatagtaacactatgaataagcagcaagatgtaattttttcaaagactctgtcaacatggatatgaccccaagtcaaatggttcctccagtgattgcatgaattacaccctttttcctgtctttgctatttgggatttggtgtaatacattcatcaaatatgattttactattgctgtgacatgaagcccagatgagtttcacatttgtttcaaactcgaatgctgaaatttggggaataaaggtagagttattgtgttcgttaattaacaatgtactgttagatctttaaaataaataaataaataagtatcctcaaagaagtgaacctaaccctggccgttaaaaagcctggagactactagatttctttattctatgcagtacacctgggcaggctttggatgccgctgcagccatctatcattctgtaaagacaaacgcccttaatagatttctttgtcattgactgtttgtttgtttgtttgtttatttttgaggcagagtctccctctttcacctaggctggaatgcaatggcgcaatctcagcttactgcaacctccacgtcctgggttcaagtgattctcctgcctcagcctcctgagtagctgggattacaggcacatgtcaccacgcccagctaattttttgtatttttagtagaggtggggtttcacggtgttagccagggtggtctcaatctcctgacctcgtgatccacccgccttggcctcccaaagtgctgggattacaggtgtgaaccaccacgcccagccatcgactgttaaattgcaatattttctagactattggtttctaaggagagttggtttgttcattggttggccttggcaattcattggttacaaacttcattgggtcatcagaaagcatttatcatttagagccatgttcattcttacgggggcatattttggttgatacttcagtgtgaaagagaagtttctgtaaatctgcagtgtaccccgaggacttctgaaacagcagcaagcttattatgaacaaagactaggaacatttcctgatctcccacattcttctagtgaaagaccgtttgaagaagatgcctcaacattaggatggagactgtccccattttagtcagcagacagtgaaacagtttatcatgtgctgtagttctagaggaaggtttttcttagttatgtcgagttaatcaacttctacaactttgaatctctgggacaaaagagaccagatgccagaaagaagagattttccagtagaggggcttgagttctctgtcactctgtcacaagagattagatgagattagactgatggaacttagtctttagaaagtcagactgattgttactataccctatcatctctctgttgtctgatcacagtttaagagtttatgaatgtgattttatctattttctgtgtgttgtgcacaagttgtgcttatacgtggcggggctaaattatcagtgtccaggcacagaaacgagcttggaatgtacgactatttttacccatcgtgatgatctcttcctaggtctgacagaaatcaaatacactatagaagaatgaccttgtttcttttctctgtggatttttcttcccatataaaaaaaagcctgtagtgctttatcaggttataaatctaaatggaatgtgcttttggtgcacacattgcagcatatgttcttaggttacagaaatggcactagtcttgctttgcactttacattattttgttatctcttaattttgaacaaatattgtaggtttttaaaagcctggaagaggagagatgtacagttgcctaacatttcactcaaaaataaatgcccagtgtagttctgtaatatggttctttttgataagttaggtaagattagttagtgtgaatataatgtttttcttttaacattccagctaactcatatccgttccaatgaccactttcctcaccccccgccccctcaattgacttggcaattttccagcaagagtttatttcaaaaggtcctcctgatttcctgaaaatacaccagtctgtgacatgattcattctgacacattcctgtctttccgcatttaagacttcttttgctctcaagatggaccccaaaagctctctcaaacacaagaagcgtggcaagcctcccttgctgaacaggcaggcttgagagctctagggactggggaggaggtgctttccatctctggaattccagtggcctttttaacgtgtttaagtgagactgactgaccctcagggcaagggtgcaaaggctcatttgtttgttcaggctttcccctgaaagagaagatgttagtatttgttctgagccagtttatttgacagattctttttttctctggcgttgtttttcattgtggaaatgcatccaaaggtttccccatcagggataggtttttctaagttgtggtataactaacatatgtggtagactcttatttattttctttgctgctgcatagagaaaaaggaatatttgtgtttctactggaggaggattgtgtccttgtgcatcagactgcaagctgaccccctactgtgcacaggaagtgcccctcccttttttcctttgagagcagcttggcttagagggttgggaagatgtttcacttctggctaggcaaaggatgtctttcttgacagcagctagaggcactctgccagatgtcttgttccagtgagcagattcaatctgttgaactccagaatgatttgtggaaaactaaagaatcattcaacttgtgctttaccacctaaataagcccatgggattattatttagtttcagcttcagcttaaggtagaatgcgaggataatttctatggggaacataaaagtaatttaaaaaatagtctcaactattcacagatgtttctatttacagtttcatttattgttttattttttttaaatctcctgtaggtgtggaaaatgtaactatccaactggatttggaagcagaattccattttactcatctcataatgactttcaaggtaagaaatccatgactttctcacaaatgacacatgagagcactgtgtaatgtcccctttcaaaatggatgtcagatgtgagttgacctaaatgggaacttaaatattattgttgccataaattggggtaattgagcagtttttaaaacgagcatgaataactgcatttaacaaatactctatcttcatgacaataagtagaaagagcctctattctaaggtaattcaactgtaaacttttaattaggtatctttttatttccccatagagtaaggcagtgttgacccttttccaaaccgcaataaaacatctggagagtaaatccctggtcccttgtgtttctgttttaatactgactttggtaactggaaaggaagtgtgttctctttggttttcagagttttgcacaatttgtgagcagattcaatctgttgaactccagaatgatttgtggaaaactaaagaatcattcgacttgtgctttaccacctaaataagcccatgggattattatttagtttcagctaaataatagcttaaggaacagttttacagttccttaagaaatgtgtaatgccttcttaaatgtggattttctcatcatttttctttgagagatgtaaaatgactccagaactagggaatgtctctgtacaaagtccctttgtttcttcttaagcagctgcctggaaatgacaggcttcacatggcttaaagtacacattggctcacagaaaacccataatttagttattgcttctcagattaaaaatcacttttgaatagctttcagttggagttgggaaccttatctacaccctctcaggataggaaaaggtgccaaggatagatttaccatgtgggcgggtagccatgaaagtctcactgtctctgccaccaaagtgggaggccaaggagctagggtgggtgtgggagtcagaatgcaactaggagggatgctgggctgtgcctctgagcctttatccccttgcccactccccagcagcctgctgttcctgctggagcaggaaggtgggcactgtgactgtgacacctggtattgagagtggtggggaaggtttcactaaataaattgtcaactactccttgtcaccaaccgcttgtcccttcattgaccacacaatctggtgattaaactgatgctcatcggcctacaaggatgttacctttatgttatgtgacacctgagaatactcaaaatcatctttattaatgtttatgatcctattttttcctttgcagagggcatctgttcatatacatggatagttctgagttcatctagatccaaaatcctttaggcacatgttttgtagttgaatactcattcaggtgaatacagtgggagaaagatgaacttacttgtgtaggcgcagaaggtaaaacgggggtgatgattgaactgagacatgcagaatggctacaagttggggccaggcgtggtggctcacacctgtaatcccagcactttgggaggccaaggcgggcagatcacttgaggtcaggagttcaagaccagcctggccaatacggtgaaaccccggctctactgaaaatacaaaaattagccaggcgtggtggcacgcgcctgtagtcccagctacttgggaggccgaggcaggagaatcgtttgaaccctgcaggcgaaggttgcagtgagccgagatcatgccactgcactccagcctgggtgacagggtgagaccctgtctcgagaaaaagaataggtacaagttatcacactggtttatgagaaaacaactcatccttcgggtcctagctccagtgagaaaagcaacatctatggggttgggtacattgggtgtgaatccctgcctgctccttcttggcatgtgtggccagagctgtgacttcctcattggtaaatgggaagaggaataatacctacatcataggacataggacagaatggtgatgttctcctgttcccctctgttttttgttttttaaatactgagtcttgctctattgcccaggctggagtgcagtggtgcaatcttggctcactacaccctccgcctcctgggtttaagcaattctcctgcctcagcctcctgagtagctggaactataggcacatgccaccacacctggctaatttttgtatttttggtagaggcaggtttcaccatgttggccaggctggtctcgaactcctaaccgcaagtgatcctcccaccttggcctcccaaagtgctgggattacaggcgtgcctaccgcgcctggcctgttcccttctgttctgggaactgggataatcttgttgccctggcggatagtgggaacctgaaagtctttataaatgcagatgcttggcatatagtaattgctctacaaatgtttactgaatgaaagaataagtggataaatgaattcaaccatcttctgtttgtaagaaactaccctactttaagccttatgggaaattgtaaagatagcacagtgactgccctccaggagcttccagtcttccagaggagaaagatatacttgcaaataacttacagtatgtgacagaatgtgctaatgactacaacagaagttcagacaatctttgttagcctggaggagggtgagattaattttagcctggaataaagaagaaacctaggactgggactgcacttgacctgggccaggaagggagagcagggatgtcagtgggaggagatggaagaaaggccattcatggccggagggaaacagtctgagagcaaggcactggtggtgggacagtgggtcaggatttgctcagcaagtgctatgtagatttgcctcgagtttggggtagtgagagaaggaaaggaaaggaaagtagaaaagcagattagatgcaaaggacattgactccttgctagggagtgtgaactttataagaaatagggagccattacaactgatgaatcttagaaattctttttttttttttttttttttgagacgaagtctcgctctctcccaggctggagtgcagtggcgcgatctcagctcactgcaagctccacctcccgggttcaagcgattcttctgccttagcctcccgagtagctaggattacgggcatgtgccaccatgcccagctaattttgtatttttagtagagacagggtttcaccatattggccaggctggtcttgaactcctgacctcatgatctgcccgcctcggcgtcacaaagtgctgggattacagacgtgagctaccgcgcccagcctaatcttagaaattcttttagtaattttttttttttttttgaggatggagtttcactcttgttgcccaggatggagtgcagtggcacgatcttggctcactgcagcctctgcctcctgggttcaagcagttctcctgcctcagccccccaagtagctgggattacacgcatgtaccaccacacccggctacttttgtatttttagtagagacggggcttcaccatgttagtcaggctggtctcaaactcctgacctcaagtgatccacctgcctctgcctcccaaagtgcagggatacaaaagaggcatgagccactgtgctcagcctcttttttgtatttttaataagaaatgaatgatcatttcttgccaaaatttgccactatgaggtgattgcaataattctgttgcaaaaacattaacatttagtatgagtcttttttactgtattcttgcagttaataactgctgctatcatgttattttgtgctttatttttgtttatgccagtcttaaagatccagatttctgaatcttttaaaaaaaattaataccaaaaaaaaattgggaaccattgacaagaaaatgagacctgtgtttcaggaaggtagcccaagaggaaatacaaagcaaggactgggatggcgagaataaagggcatgttgggaggctctgttgatgtcagcattgatgaagcattaatggagggttactgctaatgcaaaaactggctgtgattcttaagtaggagggagccttttcctgcaacccaggagtcctgtaagaatatcttagaaagctttttcaaatcccatgtgtccactcactgccatactctgatactctctgctgttaactgcctttgaggatcattgccaagatgaggtgcccctgttttctaagggcagtcatttggatactttaaaatcaaaagctgaaccatgaaatggagaaagattagaagcagaacagtggaaggaaagggctgaatcaaaaattacttagggctgctctgcttatggagtagccattcttttcttcctttactttcttaataaacttgctttcacttaaaaaaaaattagttagtcaagtgaaataactaggaagatggtgaagccactgacagtagtgaaatcaggaagagaactgaggttgttgatttttttcccccaagttcgccatagagatggctaattgctaagtggatttagactagcaaaagctcatttagcatgtacacagtatgtttttctatattactagatgtttcaaaactcataactcttggccaggcatagtggctcatgcctgtaatcccaacacttgggggtgctgaggtggggggatcgcttgagcttcaggagttcaagaccagcctggacagcatagcaagaccctgtctctacaaaaaattaaaaaattagccaggcatggtggcacacgcctgtagtcccagctactcaggaggctgaggttggaggattgcttgagcccgggaggtcaaggctgcagtgaactatgattgtactagtgcactccagcctgggcaacagagcaagactctatctcaaaaaacaaaacaaacaaacaaaaaaaaacacaaaaaactcataggtcttttgtttattataaatttggaggcaactgtgcagcaatggcaggcctgggaaggttgatgactaagcagagagtatggaaaggattctattcgttaggtaaaatgtgttgttctggtttccagcagcttcttaactccacgggaaattggatgactcgtcaatggtcctttgggacttaaaagtttccaaaagagagggagaaggaagcacagccagaaatggctttcacagagccattggcacagagaagtccgattagaccttcccctctcttcctctccccaagcctcccagccaggctctcacggggagtttgccatggtacgtggcacacatggttcagttagtccttagggatttttctctcttactttaaaattcttaggctgatattctcttgagttgaatacggtatcattttcttatattcctgggtaggtgaaaaataaacctaagcagctagtgagtgaataagtcaaagaatctgtcaaaatgtaattgtccatgttcttatccttgacatcttttatcagagaaaaagctcagcaggattattaaggagggctaaaggaagcctaagcatgtttctagttttcaccattaaccctcacccaaatttctgtcaagcgttggttttaattcggaagtaagtgtctttatttaggttctgttttctaggtcagctgaaatttcctttgatctttttcccttgtaatctgacttccaattccccaaaatgcatcactgtgttggttagtgtcaaaacctttgcctgtttgcctatttttcagcgctctttctgcttcatcttttacttccagttgaccctgttcactacaccctcctaaatctccctcctgccttggtttcagaagactgcctttttttctcttttccctctgacactcatttttcagtcttctgtgccttcagccagtgagggagaaagataggaatggatttgaatctaagctctgcctgtaactagcaagtcagtgtctccgagcctcaattttctcatttgtcagacaaatgtgttgtgagggtgccttggtttcctagggatgccataacaaagtgtcacggactgggtggcttaaacaacagaaatgtgtcttctcacagttccataggctaggaatctcagggtaaggtgttggcagggttggtttctgctgaggcctctctccttggttcgggatggctgtcttctccctgtgtcttcacatggtcttccctctgtgcatgtgtgtgtcctcatctgttcttataaggacaccagacatatgattacagcccaccctcatgacctcatttaaccttaatcacctctttaaagagcccatctccacatctagtgacctgaagtatggagttaggtcttcagcatatgaaacttgcagacacacaaatcagcccaaattatagagagttaaagtaaagaatgtaatgaggggtactggcaccactctgttttccttgtctagcccctggttgatacgtttttctagagcacagacttaggctctctttatcttacccattccttttttctttttttttgtttgagacatcatatacttggaggtttcaaatatgtgtgtgcagtgactcccaaattcatgtttcaagctccattcttgcagctgagtgccagaccactttttccaagtgtctgatgggtgtctccaagtggacatcacacatgtgactaattagcctacaaccaaatgctttcacgcctcttccacgttgtcgtcattggcaacacagctacctggctacccaagttcaggtgcctgtatttctttcctcaccctgccttttccactacaatctaattgatcaccaagtgtaattcaatagagtcttctgtcactaaattttcagagtggtcagttccatccctttctatctacattgtaatttctcaggttaaaaccgtcatcttttttctttcacttggttttcctgtgttttgtatcatccatgtccagtaactaccacaagagttatttttctaaagtgcaatctgatcatttcatttgtccacttaaattttttagtgttctcttttccttgcaaaaacgtaagtcccttagcatggcaacttcttacctgccccgaccaacctcttctgccacgtgcagccgcctccacccactgcctggaaaacaccttgttgcccttttaagatccagtttggcccaggcgcgggggctcacacttgtaatcccctcactttgggaggccaaggcaggtggatcacctgaggtcaggagttctaaaccagcctggccaacatggtgaaaccccatctctactaaaaaatagaaaaattagccaggcgtggtggtgcgtgtttgtaatcccagctactcgggaggctgagacagaagaattgtttgaacccaggaggcggaggatgcattgaactgagatcgtgccactgcactccagcctgggccacagcgagactctgcctcaaaaaaagatccaatttgatgccttcttctctgtgaagtattcctagctttttttttcttggcagtaaaatatccataacagaaagtttaccattttaaccatttttaagtgtataaatcaatggtgttaggtatagtcacaatgttgagcaaccactaagactgtctatttccagaactttttcatcaccccaaacagaaattctgtggccactgtccctctgcccagcccctggtaactgctaatcaactttgtgtctctgtctacttaaccaattctaggtatttcatacaagtggaatcacacaatatttgtccttttgtgtggcttatttctcttagcataatgctttcaaggttcatccatgttgtagcatgtattggcatttcattcctctttatggctgagtaatatttcacagcatgtatatatcatattttgtttatcttcatcagttgatgggtacatgggttgttcccgccttctggctattgtgaataatactgctgtggtgaacattcatgtacaagtgtctgtttgagttcctgttttcaattcttccgggtgtatacctaataatgtggaattgctcgattttccagcttcttgagttattaatttcttcctcttgcttttccaaagcacattgcatgcaaccctactatggtgtttgacatagcatattgcaaattattgacacccatatctgcacctcattggactgtgtataacatatacaacatatagtccactggctgatactaaggaggtagtcatacctttattgaatgattaaatgaacgaatgaaggaacgagcactcaaacttgccactcatattacagtggacatggtgactaaatatacgaaagtgtgtttgctatttaggcctgtttataatcagcttctaaagagaaacagtttacttatccagtagggtggggaaaagtatacattttagaggttagacattttccttgcaagaagagtctctgtggaacagcttgaattatttgaaatccagccacagtctgaaatacaaaccatatgcagttcaagtttgtggcatgcagttgagtgacatttttacctgagattaaaaaaagtagagactaccaataaaaaacatcaaatgagatttttgctcctgcctttagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtttgtttgcttctgtgttttacattctacttgcaaatctactttttgattattgcagaagtaccaattactcttgtttccatttttaggtgatatttcgtgctttagatcctgctttcaaaatagaagatccttatagcccaaggatacagagtaagttcattttcaaacaaaagtgttttttgttagtttgtttgtttgttttgttttgttttttgagacagagttccgctcttgttgcccaggctggagtgcaatggtgcgatctctgctcattgcaacctccgcctcccgggttcaagtgattctcctgcctcagcctcctaagtagctggaattacaggcatgtgccaccacgcccagctaattttgtatttttagtagagacggggtttctccatgttggtcaggctagtcttgaactcccaacctcgggtgatctgctcacctcagcctcccaaagtgctgggattacaggcatgagccaccacgcctgacccaaataaaattttttgtttgtttgttttgttttgttttgtttttttgagatggagtttcactcttattgcccaggctggagtgcagtggcgcgatctaggctcactgcaacctctgcctcccaggttcaagtgattctcctgcctcagcctcccgagtagctgggattacaggtgcccgccaccatgcccagctagtttatttttgtatttttagtagagacgggttttcaccatgttggccaggctgggtctcgaactcctgacctcaggtgatccacccgcctcagcctcccaaagtgctgggattacaggcgtgaaccagcgcgcctggcccaaataaaagttttgatggtaaacagcagccatggaataagtcttactcagaatctaaatattcagtgctaaatctacctttttcattttccttctttctctgtgttacctgaccagagggtcttgaaattagcaataattactctccactgatagggaatacatttacatctgatataagatgtaaatacaatacatccgatataagattgataggttatcaagtaattgtgttgatcataataccttattttattgctcagtatattagggtatatattgggcttttgtatcaaagagtctccccaaatctagttgttcaaataaggtgaaagtttctttctctcttacaaaacccaccaaagagttttctagagaagaagtgtagctcaattgccataattaagcttaccagataaaatacaggatgatgcccagttacatttgcaaataaataattcttttttttagcataactatatcccatatatcccatataatatttgtgactagtacaagtgtgtctcatgcaatatttgtggttggtataaccatgtcctatgtgatatttgagacatactttatcctaaaaaatagttgtttatctgcaattcaaatttaactgagtgtcatttatatttacttgttaaatctggcaaccctagttataaggccatccatgtttccaggtttattcacatggttagagttagaccaccaccactatgtcctcacctcaactcgggagaagagggaagacgaggcaagcaaattccatttaaagatgagacatgggccaggcgtggaggctcactccgtaatccccagcactttgggaggccaaggcaggcggatcacttgaggtcaggaattcgagactagcctggccaacatggtaaaaccgtgtctctactaaaaatataaaaattagctgacatggtggcatatgcctgtaatcccagctactcaggaggctgaggcaggagaatcgcttgaacccaggaggtggaggttgcagggagccaagatcgtgccactgcactccagcctgggtgacagagcaagactctgtctcaaaaaaacaaaaaaatgagatgtggaagttgcacacgtcacttctgctcacatctcattggccagaattagtcacgtggctatactgcaggagacactgggaaacatctctaggtgtttcatgtgctctactaacactcttggcgagggctcttactgtcaaaggaacaagggaagaaagaatactgaagagaaatcagaagtctctgccattctcaatatactcaataaaatgagggttgcatttccgtttaatagaaaaataagctgaagcttatagagttggatgttattacgtaaagtgatatggctattaaatggcagtcagatcttgaatccatatgttacggtgctcagttcagagctctttaccacattcaacaactgctcttattacacaattacattttaatcttcttgggaggcatgtatggtaattaaaagaatgggctcactgggcgcggtggctcacacctgtaatcccagcactttgagaggcctaggcgggtggatcacgaggtcaggagtttgagaccatcctgaccaacatggtgaaaccccgtctctactaaaaatagaaaagttagccaggtatggtggtgcgtgcctgtcgcttgaacccgggaggcagaggttgcagtgagctgagatcacaccattgcactccagtctgggtgacagagcaagactctgtctcaaaaaaaaaaaaaaaaaaaaaaagggctttggagtcacaaagtcctggatttaaatgtgttcataaatcataaatgtgttcagtacatcaaagctgttgctacatttgttgctgttgatgttgctgtgactatcagctttggtttgggttttgcacaggactagttccaaatgttggaatgaaaggtgagcctgcctctcctgctactaaggtgcaaccagttgagtagaggcggggctgattcttgctgatctttcccagctgcacaaggccctatttttaaccaaggccccaaaaaacttccaagcttgaagcaaggaagagtggagtggaagaagtccagggaatattgccagaaaaatgctgcttccccatttaaattaattttacatgtggcccagcctgtctctggtctgtaatttactcattcattctcttgtaaaacaaatatttaatagatgtgtccagctctgtgccaatttctgagtgagccatgaggcctttcctgcatgtctcaaaatgcagttatgaaaaacgtccacaagggctctgggacagacaccccctaagtccctaaaaggactcaaccatctgctccctttaaggtgaaatttgtgggacttggaggatgtgttgtctttataattttgattcttttgtcttttgtggttaaatgacatcggagaatctttttctatgttacggaagcatgcatgttagctgatcatgcatttgatttactttgtaatcaagggagcaatatctctttagttgtctattgttgagacctgagactcacttcaaaagtgatttgccacttagaatagcagtcaagatgaggctcgctttttaaatatggcaggagagagtggggggagcatatttgctctactgaggggtttccacaaaggtcagttcaagggtttctaaatactccagctgctcttcaagtttgttgtttggcctcttgtcaataggcgcttgtgctcattttgtgcaggaggatttgtgcaggagaaaatgttggcgttcataactgccattcagttggggagtaccacggtttctctgtttagtttttgattttacaaagaacctaagtttaacacatggacttttcctttctacccgcagccatttctatagcttcattgtaagctatgcatgtattaaaagcatttgaaattgtatttgggctgtgaaaatatctgatgtactgggccactaccctgttgtcttatgttgtaatttataagaatgcacagacataaatgacagtaaagaaccgtttcaggctacagagcttgagagtgcagacagatgaatcaatctctggggatccagttcagcatgaagaacttagtaactcacgaaaaccccgtggagaaggttgaatggctcttcgtttgtctagttactatagaatgaattggtagcccagcatttacaataagcagaagtctgcagacctaggaagaagagggaaagataaaattgatttagaggtaacttgtatttgagaaaaaataatttgccccacatcctaatactaagcttatttatgcttatgtcactatataatattgagaaacgtggaaacgttttgtaaaactgggacaaaaaagttgtggaccaaaatgttgcttaaaaacttgaaatgttctctccttaggttgtagttattctatagcgttaacactattttggtaacttggatgtcatttaagcggtgggaaatttcaaattttcccttccaaaaatagagacaaaaatgtttctaactatcttataataacaatgagaactggagtgctttgataaatcttttcctacctgaatggaattttctcatgttgaaactgacattaattgctgtgggaagcagatggcattgtgctacttcaaattactgtctgcccgcaggttccagcagtcatgcagctgcgttcttataatttctccactttcacacttcttcctaaatagctgttctgcaaacagacccatcacagaatagctactcttttttgttgtcgttcaggcaactctcctgcctcaacctccagagtaactgggattacagatgcctgccaccacacctggctaattttttttttttttttttaaacagttttgctcttgtcgttcaggctggagtgcaatggcacaatctcggctcactgcaacctccacctcccaggttcaagcgattctcctgcctcagtctccctagtagctgggattacaggcggatgccatgatgcccagctactttttgtatttttagtagagatggggtttcaccatgttggtcaaggctggttttgaactcctgacctcaggtgatccgcccacctcggcctcccaaaatgctgggaatacaggtgtgagccaccgcgcccggtctaatttttgtatttttttagagatggggttttgccatgttggccaggcaggtctcgaactcctgacctcaagtgatccacctgccttggcctcccaaagtgctggaattacaggtgtgagctaccacgcccggccgacattcttatgaaactgatgagagggcagtaacctttcctctttgcagtcatgttatgttaggcttcactattggagtcatctagatcatacaagaggaggaacttaagctattttcatgtgtcatgcctttctctaaaaagaaatgatgcaaggaaaaaaaaaaaaacttcttgcttgtctgatcagacttttcatcttcttgatgaccttcctagatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggtaagtaagccctctgtgcacctttctcctttatgtggctggtaataaaatgcaaagtgaagctagtcttaccttaagccttttacattttctgggggttttagttttacagagttacatttagccctttgcaccatacaggtagctgattgttgattttctctttgaagagtttcttggacacggagaatgtacagactactcatttcatagacgatgaatttttggaatttgttgcttcaggctattgctaaagtagatattttagtcaacaaggattaaaaagttgtctaaataacaattgagtctgcctttacatagggaagattaaaaaccgcagttatgctagaaggcataaattgatctcaacccaaagaaatggatttttttttttttttcttgagacagagtcttgctgtgttgcccagactggagtgcagtggtgcaatttcagctcactgcaccatccgcatcctgggttcaagcaattcttgtgcctcagcctcccaaatacctgggattataggcccacaccaccatgtctggctaatttttgtgtttttagtagaggtggggtttcatcatgttggctaggctgatctcaaactcctgacctcaagtgatccacacacctcagcctcccaagtagctgggattacaggcatgtgccaccgtatctggctaattttgtatttttagtagagacagggcttctccatattggtcaggctgatctcaaactcctgacctcaagtgatccgcacacctctgcctcccaaagtgctggaattacaggcgtgagccaatgcgccctgcccacggctggaaaattttaacccacacccatgggatatcattttagggatcaaatggagttggtttctttctatcttttcctcctaattccattcttttccccacttttatgccacatttgcaacttatgtacattttgaaatttgggatttgggtgatttgccaaatggatagatgagtttattctattagtatctaggagaattcttacagacctagaggattttaaggccagataggacttatgagatcacctagaccaactattggtgatagagcccaaggattaagtaatttactagagagccctaagtaaatgagcagcaggtggaagctcaagcctctcctcactcagccccagggttccttcccctaagctgtggcctcccctcatgaaggctgtgcttatgtgctgttgccttttcaaagattgttagtccttagaaggtacaggattgagtgtattcagccctttaaaaacttctgccttccctttactccagttagaacttttgttgcacaacagaagttgaatttttgacggagcctgaaggggagggaggtatttctctaatcttattggtccatctttcagaatgctaggtagattatgttccctttacggcataacaaatcagctgtgtagctaatgtcctgttactatcacgggtctcacagcatgtgctgttgattcaggcccagtagggtcttatggtatgtgctttggaactggttttcagtttatgtaaaaccacctggtaataacaggactttagtcttctgctaactgcattcccaccaaggtgggtccaggagggacctgtctgtcctgttcctgaattccattctgtagaaactcttgttaaggtgagatgcccatatacatgcatatttagtggaccaaaaggccgtaattcatttatcatttatatgcctcaagggtcgtaagtgtgccttacagtgacacaaggcaaaatcatatatcatgggcctttcatcaggcaaattaatatatttcttttacgagatcttatatttccttacataaaaggaaaacataaatgtaaatgtgataaatgattaatttttaaaattttactgtcattgaaagaaaaatttaagtgctatgcctgaagtaaaaaaaactaaaataagctagctaacaaaaacctttttaaaaaaatggtgatttggctaagtggtaaatcgtgcagtaatataaattggtttccaggtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgaggcatgtagccatcaacaagacagacaactcactgcaggcagggagaaaataaaaacaaccaaacaacccttttctgtggtgagctagagattagtatgaaaaagggttttaaactttcaattgattatggagaaacgtggctattcatacatctcttcctttgttctctcctgtttttataactttcaaggttcacggacactgcatgtgcaggcataacaccaagggcttaaactgtgaactctgcatggatttctaccatgatttaccttggagacctgctgaaggccgaaacagcaacgcctgtaaaagtaagtctgtgttgaagggacattttaaatccattcaggctctagtatccatttcctaattagaggtactgtaacagtgtactgttttgcagagggtagaaaagttactgtcttttttccagcttcaccctgatactcctagacaaccaacaatctgcattcagttaattaatattcactgaacagcctctgtgtgtttgacactgagctgagtagtttggcagctacagtagaaaactaaggtgctgtccttgacattgtatctgttttgttttttggtttttttttgtcgcctaggctgtagtgcagtggcacaggcggctcactgcaacctctgcctcccaggttcaagcgattctcctggagtagctgagattacaggcacgcgccaccatgccctgctaattttttttgtaattttagtagaggagaggtttcatcgtgttagtcaggctggtcttgaactcctgacctcaagtgatctacccaccttggcctcccaaagtgctgggagtttacagatgtgagccaccgcgccagggctgtttttaaggcaagatgaccgtgagagaaaaatgaaagaactatatggcagggtagctgatgaaggtctaagagatatggagtagcatttttggccttgtttctgtgccagtccagctgcggcctctggcatacctccctccatccatctcaggggttttctccgggtggagatgtagccggcaacaccactgcccctccccactccacaaacagtgattctgatgcatgtcctccccttgaagagcagctccgcctctgcccccactgagaaggactattatagaagttcagcagccagtgagagctggagtggtcaaggcttgctttgtaggtaaaaaccagatggcccttgatggatacttaacatggagaaggaagggagggagggaggaagggaaggggaggaaaggaaggaaggagagagaggaaaggaaggaaggagggagaggaaaggaaggaaggagggagaggaaaggaaggaaggagagagaggaaaggaaggaaggaggaagaggaaaggaaggaaggagggagaggaaaggaaggaaggagggagaggaaaggaaggaaggagagagaggaaaggaaggaaggagcaagaggaaaggaaggaaggagcaagaggaaaggaaggaaggaaggagaggaaaggaaggaaggagagagaggaaagaaaaggaaaagagaggaaggaagatgggagggagttcaggtaagaacaacaatgtgaagcacaaggccgcaaggatgttcttgaaaccatcacagagtccatgctgggaaggattactccaaggttcacttcaaccagtgtattgagagcagtactctgttgggcaccaaggatgtgagtagataagacacagtccctcttctgcaggctgttgtgttgcagggggagacaggcaaggtgggaggctggagtgcagaggctcaggagggccaggctgagtcaagcttccctgtgcaaagacaagaatgggattgttaagcccgagagcgagatgattaaagctgggtggcaccaagatgaccgccgaatgggctcgcagaaggaagcgctgcacccaagggggtcagctagctggctgttaaacagacctaccttccttactatggcctggcctggtgtggtggtgggaatatgggaatacggagaagggaatccatccttcaggcctcacggtccttgaagcagggagcccgtggacaggctttcctagcagcacatcatctggaaggtccctcgctacagtgttcttccatccagtcccacctcgagtggaccagaaagcgccctcagtgggatggcagccatcctctgtcatacacttccaaagggactttcccttagagttttccatttttcatagcccattctcttccacagaggtcagataactgtttattttataaagttcacatttttgagatttctcatctactttagggtttaaacagtgtcatcggtggatgcgtcctttttccccaggagtcctgcttgttgactgccattttgtctgaacttagtccctggtttcctaaaggatcttcctgccacccccatcctccattggtccatagatttaaaaagcttttcttgacgttgctcttgtcacgcagaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgtatgttgagaaatgtcactcactgtgtgggacctacttcagattgccttccaaactgaatagtcagtagtctcagagctcatagtatgagcagtaaagccagcattgttattgtaattgcagttgaagacgctgggagtggaatttacttggtagttgtgctgcttttagtcgacttttgtgagatttagagggaggaagggaatatatgtatttatacaaagatacattgagtttcctcctgattttaacctggtgctttgcattcttctcaggatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatgtaggtctgtttgctaaaaagtttgggagttttcttgtgtttgaaattcccattttactttgtaattccaaagccagattattatttgaaactcacgtggtctgtgtttctccacttcattttgttttaatacagcttgtgcttgcaatcctctgggaacaattcctggagggaatccttgtgattccgagacaggtcactgctactgcaagcgtctggtgacaggacagcattgtgaccagtgcctggtaagtaaatcctcattacgtgggatgggtggttggtgaggatgacatgttttaatagagaagccttttcgccattgtagagtctgcgatcaccctcacgtgtacgtgttaaaagacatgagtagacaatgcacacaataggaattactaatggatgatttcacaagatgttcaccatccctgttagaagtgtaaaggaaagccacaataaaataccacttttatagacacaattaacacaagtttttaaaaatgggaatgtttactattaggatatcatgaggtactgctacttcttggctgctggtgggcatccatattggtttgtacttttgtgaaaagcattttggagatacatatcagtagcttgtagaaatgggcataccctttgacccagtaaccccacctctgggaatctattctaatgaaataatcagaaaattggacaaagatttattctccagaagactcattgcatcttttattaatcatagcagaagacttggaaacaacagtggaaaaatagttaagtgtggggacttctatacaatgtaatatttggttgccactgaaaatgacaataacatcaggaaatgctcatgctgcttgctatatttaaaaaaaaaaacacacacaggatatgaatagtatcttgattaagtaggaaataaaattcatcaaggaaaacaaaatctggaaggaaatacaccaaaaagttcactgtaataattccaagtaggataattatgagataagtttttaaaaatctgtatttttaataacattgttatactttctaatttagggaggattcactacccccaaattattaccattaaatatgtatatttatatataatcttaatatattcttaaaggagatttctggaagtctaaattgatgagcctggtcaggtgtgatgactcatacttgtaatctcagtgctttgggtggccaaggcaggaggaatgcttgagatcatgagtttgagaccagcaagaccccatctctaaaattttttaaaatcataaataaaataggctgggcacaatggctcacacctgtaatcccaccactttgggaggctgaggcaggtggatcacttgtcaggagttcaagactagcctggccaacatgatgaaacgccatctctactaaaaataatagaaaaattagctgggtgtggtggcacatgcctgtaatcccagctactcgggaggctaaggcaggaaaattgcttgaaaccaggaggcggaggttgtagtgagctgggatcacaccactgcactccagcctgggcaacagagcaagacttcatctcaaaaaaataaataaaataaattggtgaacctgtttttatatactcatttttgaagtgcacagagctcctcttccctactgttccatttctctttatttccatctctggtgctctaaagatctgatttcctcgtggctcagtggtgagaatagtcgtagctgtatgctacatttccacataaattcttggagggctttctgtatgggattgatgacagactgaactgagggcagatttaaaggcctgccaaatccttgccataattctcttacagccagagtaattataatgaggaaaattggtatctttactgcttgctcttcttagttgttggatggaggttatctatagggcagagcagctagtctttgacctggcacgatcctgtgattgtgaacggctctcttacgccagtgcctacagctcaggtttcttgatttcagaatactccttccttttgttggctttctgctttaatgatgaaaatgagcatttggtggaacagccgaaacaagctttaacttgcttgttgctgagtctgttgcataattacagaaacctaccgttacatgtttcacgttttgttctgcagccagagcactggggcttaagcaatgatttggatggatgtcgaccatgtgactgtgaccttgggggagccttaaacaacaggtaaatggagctctacgtatgctcttgtcctcagtcttccaggaaagtcatgacttacaggaatgggtgacattcagttgtttctcaaaaagacatgcaaaatattttttgtatgtcttgataaatgtgtgtaggtacctctatggactagattcccagtgatggaactgctaagtcaaagtacatatgtatttttaattttaatagagaatgttaggttgttccagacatattgaactagtttattttcctatcagttacaaaagtaccttttcccccatccccagcaacagttggtatcatcaaccattttatttttcaacaatctaagcacatggaaaatggactcctgttttgatttgtgtagagaatcttttcattttctttttttcttttttttttttgtgacttccaagtccattaatgaaaatcacatgagataatgttgagctacttaaatatgctagtattccttgaataaatgaagcataaagctccaccagaagctatcagaacacacatttggcaagatgttaaatctgtgggagtttaaccaccttcgagtcaaagagaatgttggtctctgttcctggctcagagtcagaacatctggaacagatagtgtaagtgactgctgagagaatagacagatgtttccctgtggccttgagtcttcccagagagaacactctgaattcattgagcaagcttcatgtactcaaaaatggactttctttcccaattatttcccaacaccatagtagtctgctgggaaggaatgaggtattcagcagcaagaacatgttgtgtttgtcctctttatttgggtttgttctgttcgaggtcgtgccatagacccagtacagcatgtagcctctgaaatccggtgtgaatatctgttcttagaaaacctccagagaggaggaagctaggataattccataaaagcagggaagaaagacagaatgctgtctgcttgtggaatcacttttctgacttttcctttgtgactcccagaacacatgttgaatcctttagtaaatgactcctcagttcaaagctgtcatcactcctaaagtccttcttgatgagataaaagtggcatatgcaattccccaaattatgtcataaactcaggaatgtcctatgattcttaaccctaagtaagttttgttcctacactcccttcctctttttctctattccatacacacttcctgtctgtctccacccacgcacaggccctagcctgccctctaatctcttgtgcaaaaatttataaaaaccagaatgtattcaccaagagagtttgggaagcaaaattgtctagtaaagatttttaaagcaggtaatcatctgatctttctagcatgattgatgggatgccctatctttgagaatcattggtggaggggaaaaaaagaacatttaaagatgccttgtagtctggtgactctagagtgttttatggtgagccttttcaaagttgttgtccctcaagaggaatttccccaggagccccttaggcagggtcaactgaagcactgattctactgggagatgtgcacagatgccgcttgggaaatgtttactggatgattggtttgttgcaatcactcatcaaaaccttttacctgatatttctttttacgtagtaaaagaaatacgttgtaggtactgaataaatgctgattgagtagaatttaaaaataaaagatttctaagatgttaaaaactagatatgtactccttagagaggcaatctctaaatgtgatcccagacactccttagttactttgttgagggacagaattaaccataaaaatcactggaagtggtaaaagctttaagatgttttgtatagtgagctaaatggatttttggtagtacaacaaaagtttaataatccatgtctattatattgacaactaacctgaactttggaataattaaagaagtggccaggcgcgttggctcatgcctgtaatcctagcactttgggaggccggcgcgccagatcacctgaggtcaggagttcaagaccaaccaggccaacatggtgaaaccctgtctctactaaaaatacaaaaattagccaggcgtggtggcacctacctgtaatctcagctacttgggaggctgaggcagggagaatcgcttgaacctagaaaacagaggttgcagtgaaccaagatcacgccattgcactccagcctaggcaacagagcaagactctgtctcaaagaaaaaaaaaaaataataagacctaattaatttaaataatctaactgaagccaagttaatgaagttttgcctagtagattacctgttttaatgaaaaagaattggcattggttgctaggtaaatgctacttgtaaatgtttaataacattgaaaaatataaacatttttacagcatccttcaagattattttaacaatgaaatgtagagttttcatatctggcttgaagcccacccccccctttttttttttttttttgagacagagtttcgctttgtcacctagactggagtgcagtggcattgatcttggctcactgcaacctccgcctcctgggttcaagcgattctcccacctcagcctcccgagtagttgggactacaggcaccagctaccacactcagctaatttttgtatttttagtagagacggggtttcaccatgttggtcaggctggtcttgaacttctgaccctcaagtgatctgtctgcctcaggctcccaatgtgctgggattataggcatgagccaccatgcctggccccacctcttttttgaactcaccgtggtgaagccccgaaccctcccttgatgcattgcttctgcatctcttttagcatttattttgctcttatagttgtgttaaaaaggtctctttggacagagattatgtcatctttgtttttgcatctcacttggcacccagcacggtggacctggcaggtactcaataaatgagggactaaaatttattgtacttcgaatccagaacggaagttagtagatatttttatcattgtattgaatgactatggtgtagctaaccctttgttaattataatcatgtactgcataataacatttcagtcaaggatggaccacacatacaacggtggtcccataagatactgtatttttactgtagcttttctacattttgatatggttgaatacacaagttcttgtcattgtgttacaattgcctatggtattcaatacagtaatatgctgtacaggtttgtagcttaggagcaataggctatactctacagcctgggtgtgtagtaagctataccatctaggtttgtgtaagtacactatgatggtcacacaacaacaaaattggcgaacaacacatttctcagaacatatcccagtcattaagtgacacatgactatactgtgatagaacaggattataggacgtaggtcttaccaaaaagaaagtgtcctagttgggggtggggaggaatgccaccctgagaaaatgaatggtgctgacggaacactgtggttggttattatgaatgatgttttttatgctttaatatttttctgcctaattccttagtaatagggaaatgttaaaattccattttctttattcaccaccatttaaatgaaatggaatttttaaatgttgccaatttctatatttatgattttttttttttttttttgagacggagtctcgctctgtcgcccaggctggagtgcagtggcgcgatcttggctcactgcaagctccgcatcccaggttcatgccattctcccgcctcagcctcccaagtagctgggactacaggcacctgccaccatgcccggctaattttttgtatttttagtggagatggggtttcaccgtgttagccaggatggtctcaatctcctgacctcttgatccgctcgcctcggactcccaaagtgctgggattacaggcgtgagccaccacacccagccataaatgtatttttttaagaaataatcttggccttcacccactgagaaaacatagagcctgtatcagttttctattgctgccataacaaattaccacaatttggttgtttaaaacaatataagtttattattttccagttctatgtgtcaaatacagtctcagtggaccaaaatcacgatgttggtagggctgcattgttttctaaggctctaaaggagaatctgtttccagctaatttgggttgttggcaggattctgctccttgcagtcgtaggctgaggttccccttcttttgctggctgtcatctaagggctattcttgtcctctagagctgcccacattccttgactcatggtcccctctctccatcttcaaaggtaccactgggtcaaatccttcttatgtcacagctctctgacctacttacttccctgcctgcctctcccacttttaagaatttatgtgattagattggacccacccagatcatccaataatcgctccatcttgatgtccttacccttaatcacatctgcaaagttccttttgccatatgaggtaacatcccacagataacagggatgaggatgtggacatctttgggggccattattctgcctcacacaggccttatttattttatgtccttattctcccttactgatttaatgaaattgaatctctagtttacagagaaatttgtagagaatacataagaatctaagatgtgccatttctatcagatttgatttttacttgaacacaggagagagtaattacatgtaataaatcattggtatcactgtgaagaagccaggatttgtgcttgagttttgaaagctgagatttgaaaggtgcgattagtgagcaggggagggcctccgagctgggagggaaaagatgggtaaaggcacagagatgggaatgactgtagcaaggtcgagatctggtctgatcttgaccatctctgcccacattcccccatcaccctctttgctcctgttattcctgtcctctctctgcctgtcaagtcctctccaggctttaaggacacctctttcatgacgcctccctcagtcttctcaatcagatgaatcatatcttcttctcccttagtgctttgcttgtaactctatcaatgcataggttcttactgcattttgatttgttgcattggttaatttctttattgtttatccccaattagactgtaagttcttgaagacagggactatttttttttctatttctctttctgtatatcatttagccagaaataatagacttagtgaggaagtaaggattcattcagaacaaagttcacaatggactaaaatgtgagaatacctgcactgggaagcaaggctgctagggccaatatttgatcagtaaatatttgctgaagagtatgaggagtgtggctcattggaaagcaaagagtcggcaccagaaagagaagccgttttcagaggatgggttatggaggctgcagaaagccaggcagaggcatcatggcttgatatcataagaaacaattgtgggttttcgtgaaacaatgaaagcagcactgtaggaagatcggttggcccgtggtagacaggatggactaggcagaagaggaagaagaatttgagaggtcagtttaggagattgttagagtaacaggtatggggtgatgccatcctggactgacgcagtggcagtggcagtgacaatgagaggaagctgctaagttgagaaacattttgaagtaaaagctgagtattgggataaaggaaagagaaggtgatgtctcacctataccatgagaagaattttaaatctactggcagaaacagcagagctgaggataagaagtcagtgtgggtggtgatgatctgtttgggacaagatgaattagagatgacagctggccagtccatggaaatgtcccattgatggctggaaatagagaagcagagcccagccacctgctgggtgctgagagctgtagggtgagggccatctgcataggaaagccacaagaatgagttcactgaaggagccagtgttgaatcagagccatgcctatctgtgatgacaattcaagcctgtggacacagacttgtgattggcagggccgctgttaagggaattcctttcacatgatcagctctcatggagccattccttgtttagaattgtgctgcagatagaggcagcaccgggagcctgctggcgcctttgtcctcaccttcatttgctcgttctctaatggttgcatgtgaaggtctagttgttttcttctttggtggttcatgttttggatatttgttgtctcagtaaacatctggggaggaaagaattttcttttgtccatatgatgtaatgtctgatgcctgaatttctgaaaatagcttttgttcatggactgtgccaaaagaaggctaggtcctaattggaacaagctttcctttcttgggaattggctatgggacgttaagaattcctattcctggctgggcgtggtggcttacacctgtaatcccagcactttgggagaccgaagcagatggatcacgaggtcaggagattgagaccagcctggccaatatggtgaaaccctgtctctactaaaaatacaaaaattagccaggcatggtggcagtcgcctatagtcccagctactcaggaggctgaggtgggagaatcgcttgaacccaagaggcggaggttgcagtgaaccgagatcgttccactgtactccagcgtgggcgacagtgcgagactccatctcaaaaataaaaaaataataataataaaaagagttcctattcctgtaggataacaacatgatacacaaaaagaggacttcagctatgctgcggcagggtcgtttaggattttatttatttatttatttattttgagatgaagtctcactctgtcacccaggctggagtgcaatggcatgatctcggctcactgcaacttccacctcctggtttcaagtgattctcctgtctcagcctcccgagtagctgagattacaggtgtgtgcccctacacctggctaattttttgtattttcagtagagacggggtttcaccatgttggccaggctggtctcaaactcctgcaagtgatccacctgccttggcctcccaaagtgtgggattatagacgtgagccactgcgcacccggccttgggacatttttaataagcctgtgagtgcaaagtgttcctgtgagttgcaacttgccttaggtaccttgtttaaaactttgggatgagaaaaaaagaaagaacaaaccttgagaatgagttgaaagtaacaattccaaaccacagctcttctttaagtgaagtaaaaatggatacatgtaatttgagttttgtattgtatacaaaattatgatactaataaaagggacataagctgagaacagaagtttcactcttgttgcccaggctggagtgcaatggcgtgatctcagctcacctcaacctctgcctcccgggttcaagcgattctcgtgcctcagcctcccaagtatctgggattacaggcctgcgccaccacgcccagctaattttgtatttttagtagagatggggtttctccatgttggtgaggctggtctcgaactcccaacctcaggtgatccgcctgtctcggcctcccaaagtgctgagattacaggcgtgagccaccgtgcccagccgcatttcttatatttagcatagcatagccaatggaaagggggaagagagacacaagatgcagaagtaaaaatcacagaatttggttcctgatggagtgtgaagaaagaatctggagaagaacggggactaaatttctgacttggttgactcagcaggtggtagtgccttcaccctgatagagaccatccgagggattgagggcttctgtcttagatccgttggtttgggatgctctgggacagccaagctggagatgttcttcagggagctggatatttgagcctaaatctcaggaaataagcaaaagatgtaacatgccaaagcaagaaggtttgggatgtggaaaaccttcatgtgatgcggacggcgtgttagtcaagagagggcaagggaggtaaaaccgagaagaccaggttctcagccacgcttctggagtttgggattaatccataggcactacttttttccacatatgtattttctgaagaaaacaagaacatgctatgtatttggtcctgtgtactgagtaatggcagctgtagagctgcttctggcgggttgactcgcgtgaccatgaactcagctgatgtggctcctcctcccttccagttgctttgcggagtcaggccagtgctcatgccggcctcacatgattggacgtcagtgcaacgaagtggaacctggttactactttgccaccctggatcactacctctatgaagcggaggaagccaacttggggcctgtgagtaggggagtgtgtggcaggtcggtaaagcagtgttttggggtgtagtggaacatacatgctttgtaaagaccccatttcagaagcatttttatagctttgtcagtgagcacaaaataaggatcaggaccatgccttcctgagaagagtcatatttaaagctaagtaattctataactcacaaattggctttggagcattcactgataaggcttttggttggtttaagaaatgtgtctttacaagaaacttttcttctctctacttatgctccaaagttatcaacctagcatggtaaatactgaggcaaggatattttttcatctattcatccccaaatttagtgactttaaatgtatgcctggctcttgagctggggtggctgaaacagctggaggctggctgggcatttctctccacacgaacacgacctttcttttttctttttttcgagactgagtttcgctcttattgcccaggctggagtgcagtggcactatctcagctcaccacaacctccgcctgctgggttgaagcgattctcctgcttcagcttcccgagtagctcgattataggcatgtgccaccacgcctggctaattttgtatttttagtagggatggggtttcatcatgttggtcaggctggtctcgaactcccgacctcaggtgatccgcccgccttggcctcccaaagtgttgggattacaggcgtgagccactgtgcctggcgatagtgagatttcttagatggcttccagcttccaaaaagaggaaacaagctgccagctctctgaaagcttggactcagaagtcctagaaagttcctcaggttctgttggtcacaagtcacaaggattcatggaaaggataacatagtttgcacctcttgatgggtaaggccacacacgggtacatacagatacatacagggaatgaaagagttgatcccagccatttttggatatgaccaaccacaggtattaaaaaataaccctgtaaacaattaatcagaattaactcatcagttgtgaacattcattatatcaagtttcttcacttgaaaatggagcctgaaactaatgccagtatgagagacagaaatccactagatactggactaaccttatggagaatctgggaagcaccttatgattcctagacttgcttataacggcatgtgggatgttctcttttttcttttatgcttactctcctggtcatatcaaataaggtatatcccaagcctttgagtgctatatccagtgtcccaagactgctccaaccacaaaactaaaaagaaaccagtttcctgtttggatatcagaaactttttacaatctattaggggagatttgactataaaaaatagacataaggtagccaccctttttgaatctttgggtgacttcggattactttgactattgaaaattattgaattccatttcaaatacagaataaccattgtttgccatgccctcagggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacaggtaaagaaaccacttagtggactggtggaggagggaggggagaatcagtagaaaaatagtacttctaatgggtattatatatagttatgaaatatggaggttgcattagaacagatcagattcctatagtctcacctcctccatggaagttaaaataaatgtaccattttctttctttcttttttttttttttttttgagtctcgctctgttgtccaggctggagtgcagtggtgccatctcggctcactgcaatctccgcctcccgggttcaagcgattctcctgcctcagcctcctgagtagctgggattacaggcatgcgccaccatgcccagctaatttttgtatttttaatagagacggggtttcgccatgttggccaggctgatcttgaactcctgacctcaggtgattcgcccgcctcagcctcccaaagtgctgggattacaggcgtgagccaccacacccagtcaaaacgtaccattttcttgaatccagtttctcaaacgtagtgatcttttgtgaggcactcaaccttgctgacgactgaggtggtgatgaggatgtatgagatcctctccttccctcacaacctggctgtgcagtgacagactgaagccccgaactgtaacgaaagactgaaggtgacggtgtaacagcagagagatgcatgatcctagaagatgggcatgcaccagccagcccgagccagggctaccaaaacgttttcctagagaatcagagctaggccttaaagtgtgaatggaattgtggaaagttggcacaaaagtaagaaatagtgtgagtggaagagagaagagagggttttgtttttattgagaatcattccacatagcttgatgagagatatggttggagatgctgttggcaaaaatactaggattagtaaaggaatttggactataatattcacaggaagctattgaagcatttcaagcaggggattgtcattatctgagctgctttaaagtggactgaaagggacattgggaagaggcagaaaacagttgagaggtgtttcagcatccagggcagaagggatttgggctggaaccaggggagtagcagaggtagtagtaaagagaaaagtgaagagcaactgtttgttttccatttcaacttggcaattgattgattcagagaggtctttttataaacaggcagtggtgggctaactatcttttcattgtttgtttcttattctagctacccgaccactgggaaaaagctgtcatcacagtgcagcgacctggaaggattccaaccagcagccgatgtggtaataccatccccgatgatgacaaccaggtggtgtcattatcaccaggctcaaggtcagtgtgacggtggtttggcagctcaacgggcttcatatgcaaattagtatttttctaatattttgcgagttttcaagtcaccatttcagagccagacgttgactgctgacttttttcctttggaattatcgatgcagagctttgtttttaatttttattttttggatgcatgaaggttgactttcgttgttgtctttcttttttgtttgggggcagatatgtcgtccttcctcggccggtgtgctttgagaagggaacaaactacacggtgaggttggagctgcctcagtacacctcctctgatagcgacgtggagagcccctacacgctgatcgattctgtaagtgcgagattgcttctggcatatgcaggaaagcctgggcggaaagtgcccagctgctctcagggtgttttgttgaggggtaatgctgaggccagcgtaagcagaatcattctttcttgcctccacggttactttgcttatactccaccccatggaaaggatttattccttctaaaaatataaaatgtcttttaaaaaaaacagcatttcactaggcgtagtgactcacacctgtaatcccaacactttgggatgctgaggcaggaggatcatttgaggccaggagttcaagaccagcctgggcgacaaagcaagaccccatctctaaaataaaaataaatagcatttaaaagccatcaagctgtgtaaaacatatctaaaatttcctgccaagagtatttaggaatagggaggtttatactttatttaatgagtctaatgatttctgttcaagggtcaaagaagcatttgggttttctacacgtttgcttgcttaaacccatgccatggggcaccactgtaaggatgtttggccgttctcatttcttcacagcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctgggtaggtattgctgggcagctgcagcagctgctgtttctggctctgagtatatctggcacatgaagtacagtggagtgcccaccccctagccctgtgttaggcagcacaagggaaatagtgtctcagttacagtttgtctttatctttttaagtaatatttcagtgaaagagcaccactgaagatggaattgatattcaagaaatatgcaaataacaggtgaccaggggaaaagtccatgaggataaagcatttccataagcagggtagggagaggggaatggaatcagagaagcatcaaatacctgaaatgtatgtttttctctttgaaacgtcagaccatcctctgaaggtcactgggctttggtctaatgtcctgtgatatttgagctttgaaggcaaggggagaaaacattaatgacctcctgcctagaaaaactgttttgatctgccaactctgcctcccctttcttcccttccgctcatcatagggatgatactgttttaaaccagaactctgaataatccaaagtagttaaaggagaaaggatcagggagagcccgatgatgtgctgctccgtgtcatgggttctggcctctctttacccacagcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggcagttccttgtttgcctgtttctttagcttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtatgcagatgctgaaagtaaggagaatgtagtgatctctggctgagcagacagcatcttagaccaaccacagaattcatctccaccaggcttcagctcgctcattcatttctgaccacctcactattttctaggatcttgtttgtttatccagtacatattgagttgacatcctctatgtgccaggcaccgttctggtgctggagataccgcagagaacaaaactgacatgaatccgtcctcttggcgagtcaccctagagcttaccatagggctgtatagaaattctgtctgtctcagcagattctggcggaggataagagttgtgaaatgctcctgcctaatttaggcgaaaggagaaactaatccaaatgggattagtcattttaaatagctttgtttttcagaacgttttatgcaactacagtttccaggagactctataaaacatgcctaagtagatctgttctccagttagcaaatgtcagttgaataatcattatggatgtgctagatgtagagtaagaataggagagagaatatacctccataacattaataggatagctcaatagataaaaaatactccgtatgaaaaagttacctgctgacttacactgtttattactaattaagaaatgcagacagtactgttagaactggctttttgggcgtaatagtctccaccttttcactgtgataatttttctctcttccaacatccattcgccctatcgaagatatttgtttttaaaagtcacttgtgaaacattgcagcaagtgcttcagtcagtggtgaagttactcatcaggtgaaagagaaattgttagtgaaaaactgagtatgtgattaacttttggcatgaagatgttcatggaggcaaacacgtggctctcggctcaatgctagaacggtactcaagaatttggaggtcccacggactaccctttgaataaaaattatcccttccaaccttaaaattgtgttgtagaaagatagcaaggacacagttatacaacagtgaaaggaggaaattaatattttggggtcatctttttcttttcagccgttttccattattgttttttcaaagagagatggagaataagtacgagagaaagatatgagaaaacagagaaagacatgagaaaaagattaacagggagcagagagaggagggggaacagaagcaaacagcaaagggagctgccacaatgctgattcagaatcagcactcacactgtagaatgcatttgaacgaacatcatgtcagaatggcatagttgatatctgtgaccagctttggattttatttgtaaagggttttgagaatgagaaagggtatgggagaaggaagatttttaacaataggtttgggtggcaaacacttgattttaagtatttggaattctactatctagtttgagccagtttctcatcattcttttttctcattccaagataaccagagtttcaatcctgtgaatttacaaaaaaactctacacttagattgtccccaaggggaggcaagaaatgaacactcagtttctatcatgatgtatttggattgcctccaaaagacttgagaaacaaattgaattggaaatccttggacctcagttcctggcccaattctgcttctaacttgctttctaaccttgggtgagttaggatatccagcttctagaaaatttttttgagacggagttttgctcttgttgcccaggctgaagtacagtggtgcaatctcagctcactgcaacctctgactcgcaggttcaagcaattctcctgcctcagcctcccaagtagctgggattacaggctttttgttgttgttgttgtttgtttgttttgagatggagtctcattctgttgctcaggctggagtgcaatggtgcgatcttggctcactgcaacctctgcctcctgggttcaggtgattctcctgtctcagcctcccaagtagctgggattacaggcacaggccaccatgcctggctaatcttttgtatttttaagggagatggggtttcaccatgttggccaggctggtctcaaactcccaacctcaggtgatccacccgctgcagcctcccaaaatgctgggattacaggggtgagccaccgcacctggccggaatatccagcttttcataagtagaataactaggttggatgagattgtctccaaagttccttcaagatgttatgttgtaggacataaaaaagtaacataattaccattcaccttgacaagcaggctaacatagtaaaagaatgtattgctttaaggaccccaaattcaaattctggctcattatttaactagttgtataaactttgagaatcctttgacctccctgtatttgttatctttaaagagtgggattgacatgttggatatgggaattaataagtaacatgacccatccctgcctgagtttggaaccacctgagagacaaacacaggggctacacagctggagagcacccctgtcaccccctcagctccagtactgggaaaagctgggttatagcacatggctttagacctgtggccaccgtgggcttgccaacacatcacccctctcaggcataggcagaggctgacaggtataagccccgcctaggaggacagactctgtaatacaaggagggagcagaactgaatggtcaggacaggcaggcagctgatagaacaatcaagtgcacatggggagaggtggctcttcctctggggagcagtgagtgaggggccagatgaagccatgggtgtcactcgaacgcagtggtcctgcaagtaggatccctagatcagcagcatcaatattatcggggacctactgaatcagaaactcggtgggaggagcccagtcatctgtttcaggtgattgtgattgaagctaaagtttgagaaccactgttcccatagtaaatcttccacatgaaaacataaagagaggtgggcagatcacctgaggtcaggagtttgagaccagcttgaccaacatggtgaaaccccatctctactaaaaatataaaaattaggctgggtatggtggctcacacctgtaatcccagcactttgggaggctgaggtgggtggatcacctgagatcaggagttcaagaccagcctggccaacatggtgaaaccctgtctctactaaaaatacaaaaattagccgggcatggtggtgcatgcctataatcccagctacctgggaggctgaggcaggagaattgtttgaaccaggaggtggaggttgcagcgtgctgagatcgtgccactgcactccagcctgcgcaacagagcgcgactccatctcaaaaacaaacaaaaaaacagccaggtgtggtggtgtgtgcctgtagtcccagctacttgggaggctgaggcaggagaatcacttgaacccaaaaaacagaggttacagtgagctgagatagtgccactgcactccagcctgggtgacagagcaagattctgtctcaaagaaaacatgaggagtggagaagagtgtgcccaaacagaacagttttcaagactttccttggaacaggtttcttagaactgtggggtcatggcctgttctcttctgtgactgatgcaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggtaagtcgtgtgcatactttgggaggcaaagagagagaaaaagatgtctttatgagttcattgttaatgagaaaaaaagatgcaaagtgaaccaattaagtctacttttataatttttaattaaaaattagaaaagatgctcttttcctatttggcacatggagtggagtcaattcatattgagtctctgataagaacgttataacacaaagcaggaaagtaagctcgtggaaatctagaaaccctgtggaacacttttctgttattaaacattagaaagattaacttaagttttactcctgcctttctttatccaactcctagcaaaagtatctcaaagctgtgaggttaccaaatagtagtcagaagaaagaaataatatcatccagggaatcacaagatggccgaatatattcttcactgttaatgatactcacattatctatcaagattcaattaatctagctgggttgttaaaaactccctcttatttcatccttgaagccactgttacaaatactgattatgtttatatgtaactcagtaaaatttttttgcatataatttcagaatttcttagggaaattggtcatcattaaagatcccatttttcaggttgctcacagaggagtggtaacttttcagtttctgtaattctttgttttgttttgtttttgagacggggtctcactctgtcacccaggctggagtgcagtggcacaatctgggctcactgcaagctccgcctcccaggttcacgccattctccagcctcagcctcccgagtagctggggctacaggcacctgccaccatgccccaccaccacgcctggctaattttgtttttgtatttttggtagagatggggtttcaccatgttagccaggatggtctcgatctcctgacttcgtgatccacccacctcggcctcccaaagtgctgggattacaggcgtgagccactgcgcccagcccactttctgtaattcttgaattaggctgggtgtggtggctcatgcttgtagttccagcactttgggaggctgaggcaggaggattgcttgagcccaggagtaagagaccagcgtgggcaagatggcgagacaccatctctccaaaaaaaaaaaaaaaaaaattttacaaaattagtcaggtgtagtgccgcaaacctgtagtcccagctgctgggaaagctgaagtgggagaattccttgagcccggaaattcagggctgcagtgagctattatcatgtcactgcattccaacctgggtgataaagcaaggccccatgtcttaaaaaaatgtaatccttggattaggatttctacatgaagctatgctttacattgttagtttgctcccaacatgctccacccccatgtgctcagaagctaaagtctcatgtgctaggacctaactgtccacagccgctgtggcctctggggcagttgcaacactgttagagactacaaaacattagattggtgcaaaaagttactatggtttttgccactgaaagtaatactgccttcctctcacaactcaaagcctattctttccccttcagatgtgatcaccctgggctctttaaacagtgcagtgaagatgaagcaccgccacgatcagctctctctaggcatgagtgtcggtgcactggtgagctttcagtcaataagctaaacatcttgtgtttggttttatcgggtgacaggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaagtaagatgcacatttattctgcccacttcttagaatgacttccacctttttttcattatcagcagattttattcttcctgtatttatttcacttgggaaaacacttgttcagagaggtaaaatttcactttcaactaaggaaagatgagaccaattttttttttttttttaatgagacagagtctcactctatcacccaggctggagtgcagtggcatgatctcagctcactataacctctgcctccagagttcaagtgattctcatgcctcagcctcccgagtaggtgggattgcaggcaccccccaccatgcccaggtaatttttgtatttttaatagagacggggtttcaccatgttggtcaggttggtctcgaactcctgacctcaggtgatccacccgcctcggccttccaaagtgctgggattacaggcgtgagccgttgcacctggtcatttttatttttttctttacatccacattttctggcaggagtgaggtctcaagatgtgactcagtgcctgggagagataacaggaaagaaaaaccatgtagctgtccccatgataaatggcatccagtagagggtactgatggtatgctctgcccatgaacttgctggttggatggacttcgaaatcctaaatacccactgtggtcccaccttttctagtggcattgatggaatagagccttccagcttaaggaagagaaagaagtagcatctctaacatctctcttttggacctctttatttctctcttaccgagatcaactagcatttcctcttgctgcagctgcacagcccccaggctcctggctttgtttatacaaacatgtgtggaatgctagggaccagcaggactggattccttaaaagccttagtagcttaaagggcttttacctgctatgtccaacacgtttattacggctgttctctgccaagagtttgaaattattagatatctcaattcccactggcattttttaaaattatttccagttaagccttcaattttaaaatgactcaccagcatcttgtcaaatctgtgtattttgaacatacttttaggtgaaatgtgtcattgtgtgtatctgggaaatgtcagaactgtgtaagaaatcacgagaacttctaaacagtaattttagctttatttttgaatcacctccatttctttccttctttgcatttcaaggtcaagatgtgaagtgggaacatcttagcatttagatgtggctaacatccgcatgcctgtgtatttgggagtgtgacaataagtaaatgtgatgttcttttgcagagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgaggtgaggggctgctgctggggatgatgcctttatgagctcaggtgtcagcccatggtgactttgccccagttagagcaaggcaccagggcacacagcttgaaacacagcgtggcctggatcttagccctcatttgtaccccttggctgggtctacataactgtgcacagagtccccatcagacacatccatagcatttcagtagagggtcccagctgcagatgcagactcacttaacaatagacaagggtgtgctatttctcttcagtacctgggcgctgaagcagactcttttcttagcttctcgaaaggaaccaattagccatacccagcattgtaaaaagtgctgttgtttcctgacacatgctaaggagggcatactccctaagtcaggcgagtcaaaggtggcccaggattgtggctgatctgtgaggataaaagtgaggaaatatgtaaataaataataacatgccacagacctttccaagccctgttgcaaaagagcacttagatgctggcatggggctctcgacacctacgattgaagtgggagtcccttttcctagtcaatggagaccttctcaggtaaacagttcattcctacttctaagtggcagctagaaaaaaaagatgacaactggcttctggcctgaagcctgcttgaccaaggtctgtgttctggccgcagttcacggggcagtgccagtgcatgcctgggtttggaggccgcacctgcagcgagtgccaggaactcttctggggagaccccgacgtggagtgccgaggtgagttgtgggcgttctcgcattgacttgatcagagagtggagggaactggggttctacaagagccttctgtaaattataaaacacagtacaaattaacgtgtctataagaacctgtatttaattgcaaaataaattaacactgattgtttaaaaaacaatctaacaaatctagccctgcccataagtataggtagtcaagagtggatgtgcatactctcccggcctcacaccctggggtaaagtttgtttctgtgtgtaagcacacacacacacacacacacacacacacacacacacaccacaaatacacacagagctgctttttaaaatacttttaaccaaggtgggaccatgtgaaccctatgtttggcaaagtgactttttatcccctctgaacagtattttgtggccaacttccttgatggcacaagaagaggtaaatggttatcctagtaagatcactggattcagtggatcaactagactctgttgacagtttaagctcttggcgtatgtgtgtaagataacatccccaccagtgaaaactggagggcaatgtcatggagacttcgtgcacaacaaagggctccaaggtcaggggctccaagtcagtttaatgtgaataaaacccagattttcacctaagcttatgattaaacaaacaaacaaaaaaagatggaaatgacattttcttacaaacaaaaacttgttaaaattatgtgaatcatcaggattgcttgatttttatggtattgcagtttttttgacctggaaaattatttttcagatcttaaagtcaaaatatggaaaagactgaataggctgttgcaactctgtttttatattctttctttcctacttgattttcttccctgtttttaattgatcattatggataaaaattttctgtagtttcttaagtgctctttcgtatatttgttgcacatctgaaattataggtctctgttggactcttgaattttttttttttttgagacggagtctcgctctgtcacctaggccggaatgcagtggcataatctcggcttactgcaacctccacctcctgggttcaagcgattctcctgcctcagcctcccaaataactggagttacaggcaagcgccaccacgcccggctaatttttgtatttttagtagagatggggtttcaccatattggtcaggctggtctcaaactcctgacctcatgattcacccgcctcggcctcccaaagttctagaattacaggtgtgagccactgtgcctggccaggactcttaaatttttaaaatgaccgttttctttttttggacacaactacagcaagaaataatacagatcttcaagttggcaactcattcaatatctcctacagaaggtcaggaacctagaaactgtgttccttcagggtgcaaacccatgtgttccttaacagcagaaaaaggtcagtgggcaagaccagaacaaattagatatgatttgttttttaagttgaggcttagccagaagggtttgtatggacctcttagattaaggtttgtttcacagtggggataatgtttgctatgtcaataaacaggtacttttctttcatcattctccaaatttggttcttaatgagatctgacatcccctcttccattagaaggtattgaaatccagtggaccagtttctccaagatgtctcttgaaagtaaaactctgcttaaaatctgttttttccagggctctaatcactactctgttaaattcctcaaacttgtaatgccccaaggcttgattttttccagataatggctctatcgttgcacataccctgattctgtcagcatgtgtcattggcaaaatagctttctctgccaaagctttctgacctttggctccatcttagctttgttagcaggaaaggcctgctacccagagtcagagtcaatcagagaattgttcatgtggtccttagaactttactccttacccttttatcttttctttaaactttcgcctctaaatctgccagggaaattgtgacttatagaaaccttgtcaacttgtttgggtcaaaagttagatcctgttttagaaactctgcaaagagtgagattcatggcatcattgttcgccaacttctttgttcctttcatccagaagaaaggtcagctcattacgtaagaaacttttcatcaggaaaagcaaacaaccgataaaaaacagaaactaagtattctgcaaggaaacctggtttaaggagaatgtattgaaactggatatgtctgttcctttttactcctccctttggcatttcctttttttttctgtaagataatcatagaaatttagttaatggaggaactacaaagatcacatggctttatggtttgcctattatgctggccaatcccggtggcacgagggcagcagggatgcagacagatgaagaggtcccatagccaagagtgtaggtcctggagccagactgcccacattcacttcaagcaattggtactcctgtattagaagaaaacaaagtcccttctcatctcctcacccagtatactcctctttttactcagcttgataggaatctttccagtcctctctgcatttatatgtatacatcattcgtattcgtgaccctaataatgatacccagtcagctcacaccagcaagaaaaagtatttttcaagccctctggaagcattggaagctccaagtgagcataagtgaaaataccctaagagatacttccaggttctagatccaggtgtttcattttccccttgttttcccactacattgtcatctctccaaccttatctttagttttgtttttttcatggaagaccagaaagcccctttccccaaagtgttaaaatctggggtgaaggcaactgacctcattgcatactttggcaattcaaagttataaaatgttagccgggcacggtggttcacgcctgtaatcccaacactttgggaggccaaggcgggcggatcacttgaggtcaggagtccgacaccagccggaccaacatggtgaaaccccatctctactaaaaatacgaaaattaatcaggtgagatggcgcacacctataatcccagctacttgggaggctgaggcatgagaatcgcttgaacccaggaggcagaggttgcagtgagtgagcagagatcgtgccactgccctccagcctgggtgacagagcaagactgtctcaaaaaaaaaaaaaaaaaaagaagaagaagatataaaatgttggggcatctttatttggggtgttaaagtagatactgtctctcctttgtgcccacagtggctgagctggggtggggacatttggaaatttgggaggaggggagtattttgggtcatcaccataatggggtcattgctataggcacttggtatgcaggagccaataataataaatgtcccacagtgcttaaggcagtctgtcaaacagagaatgtgtcggatcctcaatgcttttagcactctttggagaaagctcataacctacaaagcacccagagagagtgagaattgatttgagtggacaatgggggattgattcatggccagctatggggtctggtgcagacagggtggcaacaggagtaggaccagtgtggcctgtgaaggcaggggccaagatgcagaggcagacaaggctcttggttatgtttgtgctggaatgcattcacgattagaaacaggagcacaggggctttctgaagggatgggcccagagatcagcagggacaagaagaggtgtcattcaaaattagatggaactatgcaaaaagaacatcagctcttttctccagttatgtaattgcttgacaaatatgttttcagttgaattggttgttagagggcataaatttagactttctgatgccaactagctaacaatatgcttatagaaagatttaagtcctagctaagtattctccttatggaaaaaaagaatgtagttatgtaaaagacaaatgagttgagcctccaacttacagattgttgaatgttcctattgtccaggcgggttggggctgttggtcgatggtgccaagcctgaacaagcccaccactgtgctgggatggagagggaatctcatccacccaccatgaacgtgctggagaaaacagcctggagcgctgcattgtcctcctcaggagtcaaagagtcacaggaggaatctttctgttgattcatagatagcaaaaaggaagggtaaagtttccatttggggcctctggctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctcccaactttcattccaaaattgaacctatattactgaggccaaaaagggaaaaggataaaagagaatgtcagaaaaaagaaaatcccatgtaagaaataaaaattatttaaattgcccttgcttttagtaaatagaaatgcctaagtaaagtatcagtaaaattcttggcattgcagcagatcctggagtcccacgttgctttgaggcaaggtccacggcagaagaaaaccccattacctgaatcttagggtgtagcagtttctctgtcccaaggcaaatttaagtttccaacaaaaaggaggataatcagcccagtactgagtgaccaatggtatagagtggggagtggacacagagagaacagctgatactgttctgccacttgcaggctatttggggacatggggtacataaaatgaagtaacaagatagcagaaagtaagtggcacaaacttttcagttgtcagaagagggcaagatcagtaggaaatggagtcattagggaagggtttgcagaaaagattagctctagtggccatctacagagaacgtgctgagtgccaagcacttttaggcatattatataagtattcttaattttatccttgcaacaaagaacctatgggggtaagtatcatctccatttcacacttgactaatctcagactcagagaggttaagggacttgcccaaagtgaggaaagaactgggatctgaagccaggcctatgtggccctgtgtcccagctgtttccacaagcctgggggctcctcattgacagctggtatttagagaggaaattatcatccaagctaaaggacaacacagacaacatgaagcagcatggctctgggaggtgccctcgggaaacagtctcagctggagagtcatggagagatttggtttcaccagattgtgtgaagccttcggtgctgggccattaagggtagactttgttcagtgggcacaggaaggtctggaggaggagagggaaggatgtaaaggaagcaggcaagttaggtctatgtgataaatgggtacatagactatttcccattgtggcattgacttgctagtgttttcctctggaccttagtatctttaaaatcggtacaatagctttcatttacctacttcttaacaattatgtttgaaatgataagaaaacttagtaaaaatagaggaagcctactggccacagaacagagagtgtgtttacagatgaaagtcaaattattatggcttgttaaaatgagtatctcatttaaaaaatactattcttcatcttcatgatttgttcatcttaaagattaggcaacaacttttgctatgtatgctctcctttccaagagaaagtttctgattctctgccaagtaatcccatttcttaaaataagactgctttatctaggtcatttggattctgattcctttctcttaagagagaaggagcccactggacctcatcagctgcagcctgaatagtcagttcacagtttttcagatcctggtgggtgtgtgagatgatgggagaatctcctccatacattagtgtccatgaagttttactaacttgtcaagtgtgaactgacctttctgcttcagccacgtgagtgtgggagtttcactgaaaatattcttgaagtggagggggtctttttacaaggttgtaaaatgtgggccttctggtgcctgcctcttaggtgactccaagagaagcaattctggaaattcaatagccagggaaggaagcacatgaccaggggcttcagcttgaaatcaaaacctggtacatttgagactagttatttggtgccctcccggagagtcaggcccaactttttcaataatgacactgcaatccggtcatctgtgagatttgatggtttacttttcaggtgggagaaaggaatgttggtcagtttggctgaactggttgttgacttctggagagagccgaagctctgctagctcattggaactcttacccaggctaatttccctcggccagataaagagggaagccttatctgccttttaagtctttcagggttgggctgttttccccttaaagatgcctatgacagaatgggagcaagacatgtctttggcaacgaaataaatgaaaaatgatcacagaaattaaaaataaatcaacgtatgcatgcatcccttgccccaagcatgaatccagcaaaaacctaatgtttaggactgaacaaaggtatacctttgcatcatctatgggaaagaaataattgtctaagcaaactataagcatatgcaactctgcctcagttgtgtcaagtctaagggagatgggtgagtaggccccagagggctgcctcaccctgaccactggctggtagacaaggtaagttttattacaaatggcatcacttcttcctctgttacgtaagtcctgagatttgtgcatcagcctacattgctgaacttccgaagtcgtgattctgctccagctccaccttttgaagggtatctctttctccatctctcacacagacacacagatacacacacacgcacatgctctctttttttctctaatatacagaaggcgggcagaaacagctgggaaagtaacagtcagtgctccacaaaacggggtcgcgtgactgtgaacatcagtatctcctgggaacgtgatagaaataaaaatagttctgggccccacccagacctactgaatcagaatctggggatgggaggagagtagagaagcaatctgttttttatgaaccttccaggtgattctgatacctacccaagtttgagaggtgaggacccaggtgactcgggggtaacttttagctttctggaagatgactaaattttaccaaatgataatggaaatgtattcctaaaatctaaacaacataaactcttaaggtactaagttatttaagttatttgtaagttatctaagttcttcctaatctcagaaatcgattaatgtagtggttttcccaagcctttctcattatttctcttgggtgtcactggcattgacttccactaaaaaaagatcccatggtcaaatgactttggcatacatacaactggataaaaacaatataaaacagtttttcctgcagaactcttctgagtctgtaatatgctgacacttgtttttaatcttcaagataaggatacagaacttttcatcatgggatagttttttcaaggaacacatcatagaacgtatggtctacggatcaccattaaagttatccatggtttgcctaaacagcttcctgattcattacgagaatattccccaaacaagaaaaatgaaacatactttaagtacctggaaaggatctgttttttgaaaagcatacacccaagttttacttttgaaatcctaaggtcttggttttgaaaaccccaggcgctaaggaaattacatgttttaaaatcctaaaggttgaggaattaatattctaaacttcaaatttttgaataatcatgacgttattggcaaatacatataaataaacatataaccggaacacgtttttcccctttatccaatggaaatacgatcaagcatcactcttagcagaagactaccagacacttgtagggacacgaaaagtgataataaaaacaatttatttattgaatgcttgctatagaccagatgctcttctaagcactttgtaattattttatcttgaaagcagtcctgtatttataatcattacctcttcttacagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgagactcttccaaaaaaaaaaaaagtttttcagaggcaaatcacagctattgacccaagagtggctcacacctgtaatctcagcactttgggaggccaaggcaggcagatcacctgaggtcgggagttccagaccagcctgaccaacatggagaaacaccgtctcttaaaaaaaaaaaaaaaaaaaaaaaaaaaaaaaaaaaagccgggtgtggtggcgcatgcctgtaatcccagctactcgggaggctgaggcaggggaattgcttgaacccagccaggaggcagaggttgcagtgagccgagatcgcgccattgtactccagcctgagcaacaagagcaaaacctccgtctcaaaaaaaaaaaaaaatccgagaaagcatgaatctgttgtgctttgccacagttgacattgcacttcaggaggattattttcttttatgaaggtatgtaagtgtccttgcatgcctagactaaaatgaggttagggcttcatttggcaaagacgtttggattctgattgcaagttaaccctgagtccgatgctgaaaaacgaaaaatggtttaagatgtgcccctgcccttggagtccacaatccagttagggaaataagatagtatattctttatttattcctgtctttcctcagaatgggtggaagcccagcgataagatgttagcataaggcctttcgtaattcaaaccctgtataaatactttcaaatgtcagatgttgatataaaaatgatttggtcacctgaaatttgggaatctaagccagggttcaagggcacagccactgtgctaagtaatctcagccacagctactggccaagaacacattttgtcctgtacggcacgtgattttcctgtgccatttggctttgcatgaggtgccaaccctattgggcctgtgagacgctgagactgaatggctcccaagatccctgcttgtagtactggcagtggtcatcacaatggcagacacccccaagttagattatacttagttgaaagcctttaaactggatacttagaattcctttgggttttgttttgttttgatcatgtttattgcatttcatcaagtatgttttgttgtgagatagagtcaggtacgtaaagagcttctcatttgtgatgtatccgatgccaggtggcacattatcaggatgtaacctggattgtttgtacagacatggtctgtggggaaatcctaagtaagggggaggcaaaggcaggacggaggtgaagagtatagactccggagttgcaaagaactgaatcagaattctggcgtggccttttccttgcagtgagacttggggcatgttacataatctctctgatctctgagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagtaagtagttaatgagccagaggaattactcataaagctgaaaaaatattgtgagttaacagcaaagatttcctggcatggtgcttccatcaggaggttttgttagtcctgtgggtgagaacagattctgagccatttattttccagcagtcttgactgggcatttgggtgagtgaacgttggcacatcagtggggaccagccttctggaggctgcagtacagaatatgcaagcattatattcagtgctcctccttgcaaatcatgttctaagtcagtaaaatgggaggaatgctggatttagaagacaaagatccataattgagtcttggctctgatgctaggcttgtgaacttggatgactcaattcctgagcctgtattttctctcctgtggagaaggggtaggataatatatgccattaccttatgaagtaatgaaaggatttatatataaaataacaacaggattgcagaaaattataaattaagtattgctactatgggggaaattccattacctcaaaataagactgcttacttcaagttttttctgcttctccgccattagtccaccagaccagtgcttcattcatctagttataacagctgctctatgctgaaaagtcctcatcccaccccttctctaggtaatcttccctctgattggacagtgtttgttagtggaagcctagagaattgaccttctcaaggatcatttatctaccctttctcctacctcccctctcttgcccctaaacttcccaactccttttgccaaaaaggaacccccaaaacagcacaataagacctaagtgctaaaggacaaaaatagaaaagggtatgaggcatctgtgcttccctagatgctatggttttttcactgcagactcaccatctaggcctgaggggactgcttcacagttaaatcctgcacactgaggtgtttatatgacgaaatgacagtaacattttttgtgtgtgatgagactttaatcagcacctttaagaagccagagggacttttcatctcataccaggcatgagtagcagaggacagctgacattagctcaagcgacttgaaggaggtccttcctagacctagatttaaagtaactggaccttgatgtcaagccttgggttttatgcccaagaccatgtagctggccagagtgttaggaaacgtctgatgtagagtgacaatgcatttagtgaggcattttacctcactgaaaagactaagcctcctaatgtgcagagatcacagttttggcaggccgtggtccgaatgcaagcccatttaggaaatgatccttggcctgggtcttaggcatctctgggaggaagaaaaaaatctggtgtcctttgagagcctgccagaagagagattacattcccaaaacagctctgtttctaccgtcactattcatttaactagacagattgtaataatcacaggaaaactagttccattactcttttttttcaacatactatccaaggatacatgttttaggaaccaaagtggccttattttaaaatacgatgttagatttgcttgttttaaaaaaaattgtatcattttatgagacctgagaagaaatgaaagccttctgtgagtcatataattaataaaagcaaagcactgaaaaaagaaactatgtatattagcctcaggaaaaaaaggcactgaaatgtaatttaatctaccattttaaaccatccctttaagtactttttctttgagttgggttatagttttatctcagccttacatatcatttttctaatggctcccaacctttcagcatctttacattttcctggttttttatactattatatcgccaagaagacaattacattcaattaggtgaaccagtaatacccagaggtaaaatctgctcaaatattactttctttacaatacacatacaaccctacccacacccacctggagcacactcgcatgtgcacacacacacccatatccacactatgtacacaataatatacaaatagatgtcaaaagtacggctttgtaggtttgaaagtacagaacaaaatgcagtttagattccaaattaaatactgtgaaagctaaatcttcttatttcattcttagtagatgctattttcttataaaaaataaaaaggctgttggtagaaggaggcccctctgacggaagagaggagtgtatgaaagctgatactggtggctcctgttgtctttgtggcaggctatagggcttcccctctgcatgttccatcttgaaggagatccctgaggcttagggaagaatgttttgggcttgtggctgggaggcctaattgtataactggagtcatttatgtcttcagttttcacaattgtaagggcttgaagctgcctgtgaatagagccagaactccacactctgacctgtgctcatcttacagcagaaatttggaatcccttaaatggcttgtctgccacaactcagctgagtggtacttctgtgtttctctcaaaagtcattgaacaaagaaaaattgttagatttaatactatctgttataaggaaaataaaactagcacttagggatgaaatgttacaaattactgaattggtttgaaattagtaatggatacagtactagtagaaaatatgaaacgtgaaagttctcccttgggtttattttatgtaagtaagcttaactttctctttacaggaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgagcattttttggtgcaaatagtcccagacaatggatttaacgatatgtctaacgttttaatatagcacttttggggaaaaaaaaaagttttctaataaattttaaaacttttgctcatccagtttctggcacaaatgaggatcaaagtccccattttacaaatgtgggacttgggcacagagaacctaagagacatagcaaaggtcccacagagtgaatggcagtagttgtatcagaatggtatccatttcctgattttttttttttccctccagttagtagtttaatcccctggccttttcttggaagggggttcttttgaatagttaaggtattaatacttctgcaaatcctttcacattcaagaatgctgcttggtcagaaaaaaacttttgcaaatcattatttatatcatagactgtaaaggatcctcagcaaaaagtgaatgtagaaatatgttacatcatactgtccaactatccatactgttttatgcatgattgcttttggactaaagctaaaaacatgtcatgctgttatatataataccgtcatcccttggtatccatgggggattggttccaggacccactgcagaaaccaaaatccacaggtggtcaagtccgttatataaaatggcacttgcatataacctatgcatatcctcctatatacttctttctttttctctctctctctttctttctttctttaagagatgggctcttgctatgctgctcaggctggtcttgaactcctggactcaagtgatcctcccgtctcagacttctgaatagctgagattatagaggtgaaccaccacacccagctttacttttttctttttttcccttcagtatatttaaaagtaatctgtagattacttacaatacctaatacaatgtaaatgctatgtaaatagttgttatactttattgtttaggaaataatggcaagaaaaaagtctgtacacattcagtacagatacaaccattttttccaaatgctttccatccacagttggttgaatccacatatgtggaacctacaaatatggagggctactatattagtcatttgagtggatccgaataaaggattgagaaaagtcatctagtcatataatcttcaggctgcctgaaaccagctatttataaagaactggatgtttgcttgtgtatagaaacaagattgcatgattttcttaatttttcatttttcacccagatgtttgccatactcgagctggagtaggtgctaatgggacaaaacatattcattgctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaacaaagaaaaacaaaccatcttttgtcattattacaataatttgcaaatgaatcagcaggactgaaactcctaggctgaggtctctggatcctggaatggggtatctgtaaccaagacagattaaaagcagcagcatatgggtttccagccttcccctcttctgtttctctgtggtcctcaactaaagaatgaatcatgactattctcccatactgttttagctactcagtgacaccgcactgaaacttgatcctttttacactgtggacatttctttaatattttttttcctaagtagagacagggtctcactacattgctcaggctagtcttgaactccgggtctccagcaatcctcctctcacctcagcctcctcccaaagtgctgggattacaggctaacaccccagcccacccccacccccgcttttttttttttttttttaaagagatggagtctcactacgttgcccaggctgacctcaaactcctaggctgaagcgatcttcccacctcaccctcctgagtagctgagatgacaggcatgtgccaccacacccagcttggacattccttttttagtttgttctgatttgaattataaaacccatctcagtgtaggaattcagagtcattctagaaggggcttccattaaaaattaaagggagcaaaagaattttttcacgggtattagctattatgttcctttgttccagtaactttacctggtgaagattaaccctgaaaccagcctagaaagtagattcatttcccagaagcttttaaaaaggaactctggagccaaatgaaattgggttgtgagtttaatgaaaatcaggcagaaggccccaaaaaagcctaactgagcctgtttcttcctcttccttcctgtgttttcaaggaaggatacctatgtgaaataatttggagggtattttttatagactaaggtttgtgttctcttagcccagagacacagagaaagttaaagatggaaggtacataggcgcagaagagttcaaacttcattacagctttgtcttagtgatgcttcctccctcctctcatcactttctctgaaatagacaaaattggtcacaatataagacagtgtttattgatgcctgctaggtttcatactcattatcttctgaaactttatagcaaatagggagcaaataatctgtcatttattaaatggaaaaataaaagatgaagaaaaaagaaaaatgaaggcttagagcaatgtgtaaattgcagctaacaggagacaaagttatgaagcatgaaatgccaattctctccatctttcccttcagcattgattccttccttacatattgtagttaaaaaaaaaaaatcagttatcacaaacaagttctgtgtgacctacaagaaacagctaagcatgctaaaggatttttgtcttgaaccggaggcatctccgtgggcggcagggagatgcatgggcggtgggtggggttcggggttcctctggcctttcaaatgtgtgcccttccctgtgcttgcttttccacctggtaaactacctagggattagcagctgcttcagttctcttactgtgtttttgtctttgttaatgatcctgtgagaattctttctgtaagttctttactgccatttccttgtgtagagagagttttgtccttttgtttttcaggtacttctagttctgtatctttgtggatgtttagctagagccatactgtgtttttttttttccatgtctgccccatctgttgaaacaaaacagatcttctatgtgtgctgtcagattgtttttagaaagcaaccgaggttttacacttatgttcttaagactcatgttttacagcatgcagaatacactttattttctgaagctttttgtttttgtaagccagataaatgacttatttagttgtaatttgagatataatggaattataattatcttaaaattattaggctaaatagttgattgtatttatttaaaaactacttttttgtactttttaataacaatacttgtttgggaatattctgttaactccttttcactgcagtaaatctttgtcttcttttcagtatgagaatttccacaaacagctctaaatgcaattttctccctgctcagccttttctatcatatagcacacttgtattataatttatcaatttgcatttgtatgccatgaccaagtggtgatctttgagaggttttggtaggtaagaaaggaggactctatgcatgtgtgatggcagtcgggggtggtaatttgggaacacttcatctacctttgttcctttgtttgtactgttttctttaacctgtggaatgttttcccacttcccctgctcaaatcccaccagccaacagcttcttcagctacaactgtagcattcctctgcagtctctcctttgtctactttctttcatagtgactgcatctgacctattcttggctattttatgtggaatgatccagtcctaactagatgggaagttactaaaacgctaggtaatagatcttttatgtcaccatatttactggaggagttaacatggtgctggtgctggtcccaaagatggttcacaataggttttttttttaaactctaactggttagaaaaaaaggaaggcattccttggcccttgcactggcagaattcaacttgatatagcagatgtttgcatcctgggcagagctcatatagtattttaactcatttgggcagaagatattgatgagttgtaaacttccattgtttccttggaaataagcaggttagtttactcctaaactctctgctcctctctccattctgtctcccaaacactgttttcaagcacccttgctgaggaccacctacacattctctggggccacccaggccctgcacagctgttttgctgcagcagattcactatccgaagtattgtgcctgatccttggcttgttgcagacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtaactcagtggatggcctcagtttttgttatgtatgtttgctttcagctgtggactaaaggatctgaaagggagaaatcaattctaaatgctaactgaaatgaaaagggcatatcacaatcaaatatgaaagttcatgtttctgtgaggtcagagaaagagatggggagattttcttcacagataaagaatttgctttctcctcactcaacacatgctttagagcaagatgtttaaatcttatactggataatttgagatagccatcttacttttctgactccagggttataaatacatccagctgtatgacaaaaactctatactaagcaattgagcatttattcttctaaagtgacacacactttttaagtatttatgtgggcacctgagaaaaagactcaggactattttataggccaggagttaaaaaacaacttgaaaaattttaaatgctagttctatttatatcagaatactgtttaggaatctctatactgaatacttgcagtctgtaagatacaatactttgttgaatgggagaaagttgtttcccagacatatgattccaagtacatagtttttcaacatcatttttgagccatttccaatattctggtctcctttagaaagaatgaaagtcttccctgggtaatttattcttcatatttaggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccgtaagaaattttttcattttacttttagacatttgtttctgtgtgattctctgtttacattttagataaaatccatttctgtcagggtactaagtgacatttccaaataagaaaaacgtccgtatattaaatgtttccacttcttaaacttatatatgtgtatcaaataactttctccaatgttacgcagatacagacacacctgatgggatactcaggtagccaatcaaaagtcaaatatttacattgaaaattgaacgtggaatttgttagaaattacgtatagtaatttctaaccttaaagaagtggagtttgttattttggcattgcccccaaagctttgtaattctattatttacaggatattatacctatagttagttaagagtgttgctagtcacagttcaagtgttaccagtaaagatggttttggctgcaaattacagaaaactctcaagtgaaagggacttaatcaaaaaggatgtttattatctcacatcttaataagatatccagtagcaggatagcttcctgggtctgcgacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtacctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcggtaggcatacacaatcattacatgaatgggaacacacctacatatacacttaccagaaaagtacatttgttatctatgaacagaaattcttacaactcaacattaaaggattcctttaataaatctaaactactccgttagcatggatgctaaaaataagtggagataggttttcaaggaataaaaggactctgattcagacactggaccattacgtcccatctcattttctcccccacaaagtctgagaaagataaaaacttctattcttgggcgggcatggtggctcacgcctgtaattccagcattttgggaggccgaggtgggtgggtcatttgaggtcagtagttcaagaccagcgtggccaacatggcaaaaccccttctctactaaagatacaaaagttagctgggcatagtggtgtgtgcctgtagtcccagctacctgggaggctaaggcaggagaattgcttgaaccggggaggtcgaggttgcaatgagctgagatcacaccactgtactccagtctgggcaacagagactccatctcaaaaaaaaaaaaagcactcctattcattgaggaaacagcatatactctgttcagtagtatgaagtataataattttagaaaactgtcctgatgttataaagcagcttatctggttaagaaggccaatgtctcaagattttggtcatcaaacattttactatatagtagttttggaaactatgggagaacagtcagtctgctttcaatacccaattctagagaaacctaatagagcacttatagctaaacaatctgttctgtttagaatgcatggaaaacttaatgttttttataagaaatatactgtgactaccagatattaaaagtactcattacgaatttttcatagggatctagcaccttgctctaaaaatcctctttatctcttaaaagaagtaatgcaaacataattccattaaattcttttgtttctcagaaagttaatgttttcgttccaattttacgagtttttaaaaaatgaagaaaattgatgagttatctaatccctatacaggttctcagaatatactttgaaattaaatgctcccatacccagcattgtcagccttctcaggccaatcctccatgtgtttaaaacctgggaagatgaattttcaacatgcttttcttaccattagttggtaaaaacctgtgttcccctattctattgctgtcagttaaatgaaggccaataattctgtccattttcctccttaaatttcgagtatcaataagactttttcttcaggctatttgttcaagtttagaaaaattatgttttcccaccagactataaatattttgatgtttcgatctctaggtttttccattttctcagtttgctgttaatattttagtgaatattatgtcagtgactgtagaaattattgttttgaaagccaggtgcagcagtgtgtgcctgtagtcccagccacttgggaggtggaggtgagaggatcacttaaggccaagagtttgagactatagtgcactatgatcatgcctgtaaacaaacagtcactgcactccagcctgggaaatatagcaagaccctgtttcttgaaaaaaattgttctgaaaagcaaattagaaaatactgaattataggtgagatgtggcttgatgatgcaagttaataattggggttctgtttttcaggggccctagggggcaggaagtgttttaggttagtaacaataagaaacaaagagaacctctaactaaactgtgttcatgaaagcttatcagaaacaattcactcaaactttatcttctaagaattataatttctaagaattttattctaattaaagggtccttaggtttgaaatatttacaaattttagcctatgtcttatactgacccttattaacttcattatagcagtactgttattcagttaattctatgtaattagacccatccttgaagatcattttaaagaaaaattgagtgctcagtgaaattgattcttttgtcatgggctcaactgcttactttggctagcttttaaaagtcaatgtttattgattctactttgaaaggagatcagatgtggatcctcaccagttgcccagatatttttttttccctaaataactttgtgtatttagagtttacagctgtaacgttcccagaccatacatcatctcacaattctatagaaattcaaagaacatccctagtctccatgtcttcagtaattagctgaaatctccactactagagtttaacatttattttcccactcacattaagttggaaatttatgtggaaatccctcttcgcacagctgcttatttgtgaatgttctttagccaaagtttgcaggtgtccttaaaatgctttctcaacacatcatgctccttggggaggtggggttttttgtttttttttactgtcagaaaaaattttacatcaatctcagcttagatcatcagaagtactgaaagaatgaagtgaatatatgaaatgtagcaaagactaaagttagatacttcatgtaacttttcctgaaatattctttttagtaattacttcttttggtctagagcaaaatggcacagcagacttttaaatcttcctccaaacttgtactcatagtaattccatttcttaaactaatgtcttgctggaaaattgacatgcttttagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaaggtacgtaaatctttgtaatttcagagctatgttgttaaaggagccaccagtctcctccttgcctgccttagagtaagggacatggacctaacagaaacagaattcatcagaaatatcaaatgacctgttttgcaacagccgtctttagaagtgtggatgggaaagaatatggaaatatctaataagtatgacctatgtcctcaaatccaaatttggacaagagtttagaagaacggaattaacttaggggtagaagtctcaaaacaggctttttttttttttttaaaccaactatattgacaaaaaccagtcatattgaacttttatttctgtgcggtagtcagttaaattcttcatggcatatagtaattatcaggccatttgagaatattttacaagcaggttggaacagagaacaggtagtaggaaaccaaatcttatctctttgagactcattttgaattaactacccctcacctctcattcgaaggcactatattttgcagagaaaaactcacacaacccaaatgtttaatcagaagccatgtaataactgaaacacatgttcagtttctcaataatgcttatttctaaagagaacattaaaaacttggtggcgccggggtggggcttaaaaccattgaatcactggtccccaacttttttggcaccaaggaccagtttcctggaagacaatttttccagactcgggggtggggatggtttcaggatgaaactgttccagctcagatcaggcattagattccataaggagtgcacaacctagatcccttgcatgcacagttcccaataggattcgtgctcctatgagaatctaatgtcaccactgatctgacagaaggtggagctcaggcaataatacttgcctgcccacccagttcctaactggtccgtaggcctgggggcacctgcatttactgacctaatttcagtatttaactccctactattcaaaaattttctggaagttactgtagcttttcgggcattacgtaagagtaactttccctacctctctctaggttgggaaagagaacaaaacaatgagaaaagttcactgccacaatatcagacagctgtcttttctgttttggtttgtgtggtttcctgcagtactgaggacacaaatttctcaagtactctgcttcagggcattttgcataatgacattttatcacaagagaaaggaacaaaatctcttgaaatgaaatttccataaatggctatttgaacagtttctaaaaagaatcatttgcattccaaccccacaccccatttctcttctcctcactcacttcttgcatatgctacaatctcacctttccttcctgtatcttttgtttaatctttttcctctgatttccttataagcaagtcttcacaaatcctaatttagtcaagatccaaagagcctccacttcttcaatatgggcttctctaatgtctaatctacttttgaaaaatctgcgcttctctatgtaatttgcaatacaattatgctacaacttttctatagaaaagtaataatcaggagaatgaggacttagccctaaggatttgctgcaactccagaattttttgaaatgttctttaaaatcatgtcaattttgcattcaattccactgtttgaagataaaattttaaattacttaccagtgaatatccttggtggcccttaatccagaatgcatgccatgattacactattgctcttaaatgtaattactgacactaacattaccacttctttctgtctaaatgtggaactatagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaaggtgggtcttttcacacaggcttattttttaaattactttaaggcatccatagtttatttaaaagtgaaaaatatattcactttgtcttgagatcatcatagtataaattgctcagactttatatatatatatctccccacagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaag

SEQ ID NO: 35893 - DNA, 60486 bp, Homo sapiens
agtcaagatggaggagtacgcgcgagagccttggtgagcttcaccgctgtctttgcatttctcttgcccccctgcccactgccctccttctcccttgtccaggctcccaaggtgcaagccagactcaaccgcagcctcgtcgacttgggcctggtaactgggcaatgcggtctttcgcggccagtcggcttcttagccctgtacttagtacctccccggccgcgtgagcctccctctcccaacccagcacccgtgtgaccttgtgatggatggtaaggaggtccagacttgagtttgatagaacctcggaacctcctcccaacgcagggcgtaatcgactttatgcggggccagttataatcccccctgttcgtcgaggtgaccttgggcgcgtccctccgtctcgccttgctcagttcctgcgttgaggaactgaagaataggcatttgagggagtgtcattcttgaggttttacttgtatcatgatatgtgtccacagagtgaagcattttaaatgaatggaacatagattttagccaaggggtctggataagcttctttattgcgtggggccttgttttccttcttggaattctttcttgagggtagagggggacaaaaattacctgggaaataggaagaggtaatagcatgtgttctctgaaaagccatggacagaaattcattgttacatccagcgtttattgagtatgaataaaccagacacatagataattataaaacgatgtaattgctgtcagaagtctcaggttgccagagtttaaagtttctagggtcataggtaaaaaatcaaatcttgatatttcggttaatcatttgttttattgtgtaagagcaacaaccaagatgtcctcaatttgtgaaagtgcccaggaccttaaattactactctggtatcctagccttgttgcatgttttatgttcccctctcccataaatggcatacaaaatataagttttagggtctcctggctcttcaaacttatcttcttcaaagcagttatcctccattctggattgtgctcagatatgtaggactcagcacactgtaaatagctgtttgatgtactataatgacacaggttagcagagagttaaaatatttaactatgttgagttaaagatcttagaaaaataaggccgggtgtggtggctcacgcctgtaatcccagcactttggaaggccgaggcggatcacgaggtcaggagttcaagaccagcctggccagtatggtgaaaccccgtctctactaaaaatacaaatattagccgggcgtggtggcacgcgcctgtagtcccagctacttgggaggctgaggcaggagaatcacttgaacccaggagacggaggttgcagtgagccaagattgcgccattgcactccagcctgggtgacagagtgagactccatctcaaaaaaaaaaaaaaaaacaacttagaaaaataatgggttttcatttactaaatcattaggtagcccctttgctttctcttagtacgtatgccctgaaacaatataatcagttacctggttatctttgtagtcaaaactgctttgattttttgactgccctgtttgattacagcatttcctcaagtcattttataggccaaatatttattggttgcagtgggccctgcagtataatctgttccattataatccttactgtattggcaaagaagattttatggtttgtgaatgagaaatatggtcttttttttccccctgttcttagcccatggcgaattgtggatgactgtggtggggcctttacgatgggtaccattggtggtggtatctttcaagcaatcaaaggttttcgcaattctccagtggtaagtgggtgaatggtcttattttatcatcacttgcaacttgggtttgatgatattactggtggtcccatcagtggcttagaaatgtacttctaatatattttttgttgcttccttttttttgttatagggagtaaaccacagactacgagggagtttgacagctattaaaaccagggctccacagttaggaggtaagcagaattttcattttaactgaactatttttttctgttcctttgaagatggagctatttttatttttagattacaacaattagtgattttagtttggtctaacggtttgtcacaaacatatatccctatagtttcttcttgatttgtagtttgtttgaaaaattaacctgaattatgatacccatttgaaaatcttgtctctgtccttcagacactcggtgattttttttttttttccttctccagaagaaagacagttatttaaagctcaggtgtgaggccgggcacggggctcacgcctgtaatcccagcactttgggaggccgaggtgggcagatcacctgaggtcaggagtttgagaccagcctgaccaacatggagaaaccccatctctactaaaaatacaaaattagctgggcgtggtggcgcatgcctgtaatcccagctactcaggagactgaggcaggagaatcacttgaacccgggaggcggaggttgcagtgagccaagatcatgccattgcactccatcctgggcaacaagagcgaaactccgtctcaaaaaaaaaaacctcaggttcgtgagtcaggaccgatagcttctgaggtaacataaagctgaagagaatgtgatctgaaggattggggtttcatgcaggagaaacccatcaagccgattgggctcttctccaaggttggttttgggacattgtgcagaggtcattggaaaatttgaaaagattctattcattgtactttgtaaacttggttattcagaagctgggaaaagggaggtgacaaaaaatgtttgtaggttatattcacttacaaaggtatagtcagggttgggcgcaatggctcacgccaataatcccagcagtttgggaggctgagttaggcagatagcttgagctcaggagttcgagaccagcctgggcagcatggctgcccatttccccagaaaaatggaaaaattagccaggtgttggggcatgtgcctgtggtcccagctactagggaggctgacatggacggatcacttgaacccatgaggttgaggctgcagtgagattgcaccactgcactccagcctgggtgacagagaccctgtctcaaacagcaacaaaaacaaacaacacaagggtatagttagattggagagaccgtatataagacatgaaaaaatcttaatacttcagtcgttccttagatgttttgggtatcaaaataatcttctctttgcttttcttaactctcacagtaatgaagaagttagtactattattatctcccattttccagatgaggaaatttagttcctgagggttgaggtaatgttgtatctttttcctttgttccctgtgtaagaattatctaccctggaaagtaattagtaactaatttctctttgtttttgtgttggtggttattgtgttattcaagaatgatgagtggtattaaaaagttcacaccaaacccagaacctctagtatatgcagaagccatataggtttttgcttgttttttgagaggctgcttctatcaccttacgcattttcagtgagttaaaataccatcagataactgtcactgccaaaagaagcctgtgaagacatagcaactaaattattagctgggcccggtggtgcatgcctgtagtcccagctactcaggaggctgacgcaggagaatcgcttgaacccaggaggtggagtttgcagtgagccgagattgcaccactgtactccaggcggggtgacagagcaagactctgtctctaaaaaataaaataaaagggctgggcacagtggctcacgcctgtaatcccaacactttgggaggctaaggcgggtggatcacgaggtcaggagtttgagaccagcctggccaacgtggtgaaaccccatgtctactaaaaatacaaaaattagctgggcatggtggcacgtgcctgtaatcccagctactcaggaggctgaggcaggagaatcgcttgaacccaggaggtggaggttgcagtgagccaagattgtgccattggactccagcttgggtgatagagtgagacgctgtctcaaaaaataaataaataaataaaattaaaaactaaatgtaggccgggcgcggtggctcacgactgtaatcccagcactttcggaggccgaggcaggtggatcacaaggtgaggagagcgagactaccctggctaacacggtgaaaccccatctctactaaaaatactaaaaatacaaaaaaaaacaacaacaaaaaaaattagccgggcatggtgacgggcgcctgtagtcccggctccttgggaggctgaggcacaagaatggctgaacccgggaggcggaacttggcagtgagcccagatcacaccactgtactccagccagggtgacagcgagactctgtctcaaaataaataaataaataaataaaaataaatgtaatgtggtactgtggaacagaaaaaggacattagcaaactaaggaaatctgaattaagtatggacttcagttaatagtaatgtgtcggccgggcacagtggctcacacctgtaatcccagcacttcgggaggctgaggcagtagattacctaaggtcgagagttcgaaaccatcctggccaacatggtgaaacccccgtctctactaaaaatacaccaattagccgggtgtggtggcaggcacctgtaatcctagctactcgggagactgagggagaagaatcgcttgagcccgggaggcagagtttgtagtgagccgagattgtgccattgcactctagcctgggcaacagagcaagactctgtctcaaaaaaaaaaaatagtaatgtgtcaatattgggtcattagttgtgacagatgctccatgctaatgtagatgttggtaatagggaaaaactggaagagtttattttttcttacaaagcacggtgaaatagaggaagagtgagtggtgatatgagtgaattggaattatccatttcaaatcctagaggttagccttttttaggaagctattgagaagtttttatggtattttaaattctaaaaatactaggatgatgattttattaatttggtgagcatttgctaaggtattcagatcaaggtgcagggagggacaggcagtatgggaaaatcatagttgtgttctgaaaggtgttatattttctttctttttttttttgagatagggtcacccaggctggagtgtggtggcacagtcttggctcactgcaacctccgcctcccaggttcaagtgatgctcccacctcagcctcctgagtagctgggattataggcatgcgccaccacagccgggataatttttgtatttttagtaaagacgaggtttcaccatattggtcaggcaggtcttgaactccctacctcaggtgatccgcctacctcagcctcccaaagtgctgagattacaggcatgagccaccacgcccggacttaggtcttatattttcttttttttttttttttgaaacggaatttcgctcttgttgcccaggctagagtgcaatggcgcggtctcggctcacgtcaacttccatctgtccggttcaagcgattgtccatcctcagcctcccaagtagctgggattacaggcgcatgccgccacttctggctaagttttttgtattttagtggagatggggtttcaccatgttgcccaggctggtctcgaactcttgagctcaggcagtccacccgtcttggcctcccaaagtgctaggatcacaggcgtgagccatccggcccagcccaggtcttatattttcatagagaaaataagataggattttgacatgtccctgttactctttgaccactttcttgcattttggaagaagacgtttcaggctcatcttgtacttttcatgccctagctgtgggcagggcagcttttcctgttgtagccatttctccaaagagccccagttccttttagttgagaatggtatttagggccagaagtggtagctcacacctgtaatcccagcactttgggaggccaaggcaggagaatggcttgagcccaggagttcaacacccttgacaacttagagagaatgcctctctacaaaaaaattttttaaaagaaaaatcaagaatggtatacaatctatatttctgtatatctatacatactgaaaatcacaagtttatattgatatctcgtatttccagttcatcccacaggattcattattttcttccttttcatatgtatacctgccttcttaacctgcttgggctatggtaccccacaacaggctgccctttgtcagagtatactctgacactccatgccaggctgccttccttgagaatctctctcttgcttaggctctaaaaccttgttctcgggtgtccaggtgtatagacgttcgcctcatctggctctggatcctcacaccaggctaccctttatggatctcctcctcatcctgcttagactcaaattctccattctcattagtagccaacacttattctggcaatgattctcaggggaagggtctcctgagattttaggctcatgaggaaatgggagggtcttgtcagaaaattttagtgaggtaattctaatatacctagacgtcatagctctctcccagggcatagaattactgagttagaagaaataactggtttgtttttacataggatgtgatgtctaatattgtactaaaaatgaggatgcttatgctatactccactggtactatccactggatttatttattttttttattttttgagacggagtctcgctctgtcgcccaggctggagcacagtggtgcaaacttggctcactgcaagctctgcctcctgggttcacaccattctcctgcctcggcctccagagtagctgggactacaggtgcccgccatcacacctggctaattttttttgtattttttagtagagacgggggtttcaccgtgttggccaggatgccctcgatcttctgacctcatgatccacccgcctcggcctcccaaaatgctgggattgtaggcgtgagctaccgcacctggctgtttttgtatttagatagagtttaagtgcaaagtaatctgctgatttaaggttgttttaaattcatatctgaggaataaaggatggacaggcaatttccatccctttgatgttccatagttctagctatttatatcattcatttgccccttcagcatggattggcttacacctgtaatacgttccagaatagctggatttcttttgttttcccatcggtgattttcatagagtagatgctcaatgacatataatgcagaaaggccaaaaatagaggtaagtaaagctatgaaagaaaagaagaacgaaagaggaagcagagtagtttgattttgtttattgctgcttaaaccagagagatatgttattctggaagggtgatttgcttgtttttacacatatgcagcctgactgttttaggcttggcttcttttttgtttgtttgagatggagtgtcgctcttgttgcccaggctggagtgcagtggcacgatctcggctcactgcaacctccgcctcctgggttcaagcgattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtagctttgcagtttggggagggctgttttccatgattgactgtagtatggttcaagtcagaggaaaggaagatccctggaactccatcacaagtggtgccttaacgggagccatactggcagcaagaagtaagtagtcattacagacatactagtagaagccacacttttaggaaaacctcatctgcctcaattgaatgacatctgtaatatataaaactgattattgaccaggcacattggctcatgactataattccatcacttgggaggctgaggcaggtagattgcacaagtccaggagcttgagatcagatatagggagacctggtctctacaaaaaaaaaaatttaattagctgggtgtgttggtgcatgcctatagtcccagctactcatgaggccgaggcaggaggatcacttgagccaccgcactctcacctgggcaacagagtgagaccctgcttcaaaaaaaataataattataaaactgagcattgtttaatttggcatagcataaatatacagtatatggtgatttgaaaaaaaagtaaggggatctatttatttggaatatttgagaatgaaagagcatggaattctaacccatatattacagtggttgagagcacttcaggtcccagttctgccattaattagctgtatgactggtcagtttaccaaactttttatgctataatttcttcaccagtaatctggagttaattaataattacacctgccatatagagttgttatgaataaggaacttagaaccatcttctggatcctcaggacagagaattcctttgagcttagtggtttagaccaagggatttgcaaactatttctgtaaaaggccagatagtgaatattttaggctttgtgggctgtgtggtctttgtcatagctacctaaatctgctgtcatagcatgaaagcagccatggataatacataaacgaaacagtatggctgtgtttcagtaaaactttatttatttatttattttattttatttctttttttttttttttttttttttttttttttgagactgagtctcactctgtcgcccgagctggaatgcagtggcgcaatctcggctcactgcaagctctgcctcccgggttcaagcgattctcctgcctcagcctcccgagtagctgggactacaggtgtgtgccaccacgcctggctaattttttgtatttttagtggagacggggttttaccatgttagccaggatggtctcgatctcctgacctcgtaatccacccacctcggcctcccaaagtgttgggattacgggcgtgagccactgcgcccggccctatttatttatttattttcttgagacggagtcttactctgtcacccaggctggagtgcagtggcacaatctcggctcactgcaacctctgcttcctgggttcaagcaattctcctgcctcagcctcctgagaagctgggactacaggtgcccgccaccacgtcaagctaatttttgtatttttagtagagacggggtttccccatgttggccaggctggtctcgaactcctgacctcatgatctgcctgcctcagcctcccaaagtgctgggatttatggcctttcagtaaaactttatttacaaaaataggcagtgggtggactgtgggtggctgtagtttactgactctgggtcttaggcaataagaaagagtttgggagttgggggagcatgtcaccatatggacagttctcttctttactatctcttacagtaaactagatttctgtaaaaaataatctctttgttattaatgtcttcagatggaccagtggccatggttgggtcagccgcaatgggtggcattctcctagctttaattgaaggagctggtatcttgttgacaagatttgcctctgcacagtttcccaatggtgagtctttttgcttaaaactatagctcaaacattttggaatggttttctgatgttaagaaagaacatactttgtgtgataaaatgtgtggtatgtattaatatgctgtggttcatgaggactgtgataataggtaaaaaatgaacatgttatatttagccacaaaaacaaaaattttttgtataaatttgctgttgatctttctttatagtacttagggtttatcagtgctcatgtcttgcaagaaatgtctgatcattttaaagggacttgaagaatggttctgcagatgtataacaatcatgatggtcaattgacaatttagtattgtacatctacatgccagacactgttttaggtagtgaacaggacagttcctgccctcaaggacttacattctggtagggggagacagactaacacattaacagataaattagcttattttagatagtgttgcttgttttgaagaagagaatagtggaaagtgactcatatttgggaaggtcactttagggttcacagtagaagtatcttagaaaatgtgttagcccggctaatttttatattggtttaatttgttgcctgttgttcctcctatatgatgcatagggtaataattaaattgtgggctgaatgatcattacatggttatagaatgtgctctcagctgattagccaggcataatggctcacacctatagtcctagctactcaggaggcacgagaatcagttgaacctgggaggtggaggttgcagtgagccgagatcacaccactgcactctaggctggtcgatggagcgagactctgtctcaaaatgaaacaaacagaaaacttctatcaagatggtgcattcctgtagttccagctactcaggaggccactcacttgaccccaggagttcaaggccagcctgggcaacagagcaagaccccatctcttaaaaaaaaatttcagtgtctaaatgaaaatatcccttgacaatggaaggatgcaaaaagatattgtgaggtggccgggcacggtggctcacacctgtaatcccagcattttgggagactgaggcaggtggatcacttgaggtcaggagttttgagagcagcctggccaacgtggtgaaaccccgtctctactaaaaatacaaattagcagggcatggtggcacacgcctgtaatcgcagctccttgggaggctgaggtacaagaatcacttgaacctgggaggcagagattgcagtgagctgagatcacaccattgcactccagcctgggcaacagagcaagactccatctcaaaaaatatatatatatataacatatatatgttatatatatgctatatatgttatatattatatatgttatataatatgtatgttatatgttgtatatatgttatgtattatatatgttatatattatatatgttgtatattatatatgttgtgtgtgtgtgtgtgtgtgtgtgtatatatatatagtgaggatagtagtagtgaaaatttgacctggcatttgggaaggaaaaaaatacgtagaatagtgagacatgttgaaaattatttttggagcttggaaaagattcagcataaagttaggaatagatcatacatcccaatttgctttgatttccctgaggcacctagcaagagattcagtatctttttggcacaattttcaagtgcactgctcgttaaatggcagtgagtaatctagatgaccctgcagaccctctcaccttctgtttgtttttcattccttacttctgagttaacactctgtagtgatggtcactttccaattttgttttgactgcttcagtgtgaaagactttacataaaacatcaaaacagttccatattcacagaaattcagaaatggatatagttaacttaaatagttacattgtctcatagaaattagccttgagtactttgttttaggcttttttcctcagagggaatctcctttttatttatttattttatttatttatttatttattttaattttttttgaaacagaatctctgtgaccccggctggagtgcagtggtgcaatctcggctcactgcagccttgacctcctgggctcaggcgatcctcccacctcagcctcttgagcagctgggactataggtgtgcaccgctatgcccggctaatttttatattttttgtagagatgaggtctctgcccaggctgatcctaaactcctgggctcaagcgatcctccctgcctcggcctcccaaagtgctgggattacaggggtgagccaccgtgcccagctggaatctcctttttagtaattaaaactcagcatttatatagaagcagcctaaaagaggtgtatttatttttagacaagagatgtgtttctgaaaagctgtgtaggggggaaatctttgaaaacttaatcatatttttccagtgaacttacatgaaaaagtttgtcttgttttgtttttgagacagagtctcggtctgtcgcccaggctggattgcagtggtgcaatctcagcttactgcaccctccgcctccggggtgcaagcgattcttctgtctcagcctcctgagtagctgggactacaggtgcgcaacatcacacctggctcattttttttttgtattttttagtagagatgcagtttcaccatattggtcaggctggtctcgaactcctgacctcgtgatccgcccgccttgacctcccaaagtgctgggaatgtgagccatcgcgcccagcaaaaaagtttttaaaacagtgaaaaaaggttagacagaactgtatgtaaatggcaacagtggttttcatcggcttatctttttttggggtttttttgtttttgtttgtttttttttttttagacagacttgctctgtctcgcaggctggagtgcaatggcgcgatctcttctcactgcaacctccacctcccaggttcaagtgattctcctgcctcagctcctgagtagttgggattacagacaccctccaccatgcccagctaattttcatattttcagtagagacggggtttcgccatgttgtcctgacctcaggtgatctgcccgcctcaacctcccaaagtgctgagattacaggcgagagccaccgcacccggccccagcttatcttttttacccagtatcttctcaagttttctgtaattaacagatagttgcatttatagtgaagtaaaaatatatgagtgaaacactttgaaaacttcagagaattctgccactgccctctttctctcttccttccagatattttttagtctacttcagtttttcttaaaggagaaaagattgattcatcccctaaaagtcttttttttttttttaagccactttgttttacttagttcacaggctctcctatcctttgaaaatgaaaactgcaagactttgttctacagtaagctagggggtgtcttcccatttcagagctcattccctacttaattggttatataaattggattaccaagttctcttaaaacatgactaggatacttatactttgtgaaaataattttaaatagctactgaaaaatatgacaagaagtgggagaaactcttctaatcttgatatatggcagcttgttacagcaattgctttaaaaacttgaagtttgcttcttgctataattaatccgtctgactttcctagcatagtgtttgaaaactgttcattctggagcatagcaagccagtctgtcatatgttataccaaatttgaaggttctccagtactcttatgggaattaggcagatctataaagaaatttagggttatagctttaatttagcacatttttttgttgttgattgatttactctctatagagatttgttctttttaataatataatattcaggtgatttttaaatcctttttatttctcacttgcaggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttccaagtcctctgcataaacgatgtattttggggtctggttgggcctggaaaatggatgagcacttcagaacaggtcattttcctgatattggaagtgacatgtggccctataggaggcatgatgttagttaattacacatttgcctacatctgtgggaaatggagaacaaagccatgtgggtactgtaaacacacgtttatcttttggcccaatgccatacatatggtaggcatttaattactgattgtgtttggataatttgggaattttcgactgtggtaaaatatacataaaataatacttattaaccatttgtaagtgtataattcagtggcattgaaatacagtcataatgttgtataacagccaccattatgtatacccaaaatgttctcattatcatcaacataaactccgttttgtttttagagacagtgtcttactctgtcacccaggctggaatgcagtggcacagtcatagcttactgcagcctcgaactcctggcttcgagccatccttctgcctcagcctcccacaccccatgctgggattacaggcatgagccaccatgtccagccttcacaaacataaactctgtacctgttaaataataacttcccattctttcctcgccacaaccactagtaaccacaattctgctttctgtctgtgaatttgccttttctgggtaccttatataagtggaatcataaaatatttgtttttgtgtgtccgtcttaatgcacttagcgtgttttaaggtccatgtagtagcatgtagcaaaatttatttttagggctgaataatattccatagtgtgcatatactacattttatttgatgatcagttaggttgtttctaccttttggctattgtgaattatgctgctatgaacattggtgtacaactatctgtttcaactcctatttttggttcttttggatatatacataagagtgagattaccgagtcatatggtagttctaggtttaacttttttttttttaaagacacaagagtctggccgggtgcagtggctcacgtctgtaatcccagcactttgggaggccaaagcgggcaggtcacaagctcaggagttcgagaccatcctggctaacacagtgaaatcccgtctctactaaaaatacaaaaaattagctgggcgtggtggtgggcgcctgtggtcccagctactttggaggctgaggcaggagaatggcgtgaatccgggaggtggagcttgcagtgagccgagatcttgccactactccagcctgggcgacagagcgagactccgtctcaaaaatataaaagaaagtgctgggcgcggtggcacacgcctgtaatcccagcactttgggaggctgaggagggtgaatcacgaggtcaggagttcgagaccagcctggccaacatggtgaaacccggtgggtactaaaaatacaaaaaattagctggtaatggtgccgggcacctataatcccagctatttgggaggctgaggcaggagaatcacttgaacctgggagggaagaggttgtagtgagccaaaatcacaccactacactccagcctgggcaacagtgcaagactgtctcaaaacaaaaaagtaatccactattgcatgccaatttggcacaagatgtcagatacaaagcaaaacagatggggtatttctgatgggcatttcaaccttaaaagtgagaaactaacttcactattccagtaaagacctagggaaaacctccttcctaatctgcttgtttctccagttatttatttcagttattaaaacaatttagtttttttactttttatcttgagctctactctagtataccaaatttagttttagaatatttattaaacagttcagctggggatggtggctcatacccataatcccagcattttgggaggctgaagcaggaaggtcgcttgaggtcaggagttggagactagcctgggctagtgagacgctagccacaaaatgtaaatttagccagagatagggtgcacacctgtagtaccggctgcttgggaggctgaggcgggaggatcccttgagtctaggtggtcaagcctgtagtgacctatgattatgccactgcacttcagcctgggcaacagaacaagactcttttgtttgtttgtttgtttgtttgtttgtttgagatggagtgctaggattacaggcatgagccactgcacctggccagcactttctttaaatagagacagagttttgccacattgtcaaggctgatcttgaactcctggactcaatcctcccacctcggcctcccaaagtgctgggattacaggcgtgagccactgtgcctggccgaaatagtggatttctgaatcagggtttggaagacatgggtacagctgcacctgctattgaaagtgcatctgtttttcacataggaaatgtctgcaaattatgaaagcatggtcatagctccaccctgtggcatgttacttatagttaaaattaattgtccaaattctattcaggctgggcccagtggctcatgcctgtaatgccagcactttgggaggctgaggcgggtggatcacttggggtcgagacttgaggtttcaccttgttggtcaggctgatctcgaactcccaacctcaggtgatctgcccgcctccgcctcccaaagtgctgggattacaggcatgaaccaccgcatctggcctcaaataataataataataaattctattcagtctgttagatcatggatgagaccttgtctctactaaaattcaaaaaatttagctgggcatggtggcatatgtttgtagccccagctactcaagggggctgaggcaggaggattccttgatcctgggaaatggagggagcagtaagctgagatcgcaccactgcactccggcctgggcaacagagcaagaccctgtctcaaaaacaagaaaattgagggccgggtgcagtggctcatgcctgtaatcccagcactttgggaggccgaggcgggtggatcacaaggtcaggagattgagatcatcctggctaacatagtgaaaccccatctctactaaaaatacaaaaaattagccgggcgtggtggcgggcgcctgtagtcccagctacttgggaggctgaggcaggagaatggcgtgaacctgggaggcggagcttgcagtgagctgagatcgcgccactgcactccagcttgggtgacagagcgagagactctgtctcaaaaacagaaacaaaacaagaaaattgacaatggctaacatctttagctaataagacaaataattattggatattttccctccttttccctatgtttgacatattctagtccttttcagtgcataaagctaggaaatatgtagtatataatccatgcacataaacttctgtttatttctgtatctgtccttgtgttataaaacaaaaactaagtccctccaacttcaatctggcaccacaggattcattctagctgtctctcttagttgtaacagcaagaaacctggcttctcattataataatttgctcatttgttcaatcctggttacatatattttggacttagtaaatcatagctctgagaaatggatttgccagctagaacagtgtttgtacacagttgttttcagtcttcagtatctattcaaaacatgttccaaagctatttaattatactcctttctcccccactctcttcagtgtggttatgcaattcatttgcaatgtgattgtattcatttccccagacttcattccatctttctctccacatcttggtggatttttaaattacattcagtaaaattcactatggggtacagttcagttaattttgataaatgcttagagatggctacccaccaccacagtttcacacagataatcttaaactacaatcacatcactcccaaaatgtcttcatgctgcctttttcttttcttttcttttctttctgagacagggtcttgctctgttgcccaagctggcatgcagtggtgtgatcagggctcactgcagccttgacatcccagatttgagcaatcctcctgcctcagccctttgagtagctgggactacaagcatgtgccaccatgcccagctaattttttttttttaattttagtagagaccaggtctcactatattgcccagactggtctcgaactcctgagctcaagcaatcctcctaccttgggctcccaaagggctggtattactggtgtgagccactgttcccggcccatgctgcctttttatagccaacccctctccctactccttccaacccgtggcaactactggtgtgttttttgtctgtagttttatcttttcagtagataaatggaatcttacgacatgtagtatttggatctagtttctgtcatttagcaaagtgcatttaattcattcatgatggtatgtgaatcaatcatttattcctttttattccattgtgcagatgtactcttgtttattcatctcttcaccagttgaaggacattggagttatttccaatttttcatgattattcataaagttgctataaacctttacttactggtttttgtgtgaacatgttttcatttatcttggataaaataaataggatcactaggttgtaaggcaagtatatgtttaattttataagaaaatgccaaattgtttcccaaattgtatcattttacgctctcaccagcaacctatgagggttctggctgctgtgtatccttggcacttggtagtgccatttttttttttatgttagcaattccgataggtgctagtggttttaattttcctttctctaatgactaatgatgtccatcctttcatctgtttgccatctgtgtgtcttttttagtgatgtgtctgttcaaatctttcatgcttttgtttttgttttgttttgttttgagacagggtctggctctatcacccatgctggagcattggtgcagtggtataatcttggctcccgcctgcaacttccacctcctgggctcaagcaatccttcccgctcagcctcctgagtagctgggactacagacacatgccaccaagcttggctaatttttgtacttttttgtagagacaggttttcaccatgttgcctaggctggtcttgaactcctaaactcaagccatctgcccgcctcggcctcccaaaatgctgggatcacaggccgggcatggtggctcacgcctttaatcctagcactttgggaggtcgagatgggcggatcacttgaggtcaggagtttgaaaccagcctggccaacatggtgaaacactgtctctactaaaaatacaaaaaaaattagccaggcgtggtggtgggcacctgtaatcctagctacttgggaggctgaggcaggagaattgcttgaacccgggaggcggaggttgcagtgagccgagatggcaccaccgcactccagcctgggtgatagagtgaaaccccgtctcaaaaaaaaaaaaaaaaagtgctgggattacaggcatgagccaccacacccagccacatttttaaattgtttttcttactgtttagttctgagagttctttatatattgtgatataagtccattgtaagacatgtgacccgcaattattttttgtacatttgtcaaaagtctgtttcttgaatctctattctgtcccattgatgtatgtgtctacctttcatcagggtcacaccattgctttatagtaagttttgaaatgagtatgagtcttccaattttgtttattttttcaacatcattttggctattctagtttctttgcctgtccctataaattttataattagattgttgttatctacgaaaaatcctgctggggtttttattgggattgagttttatctgtgttttgcaattttagcatatagtcctgcatataatttgttatatttaaacctcaatatttcattttaggaaatgctttgtaaatagtattgggttttttggtggttttttgttgttgttgttgtttttgtgggggtttttttgtttttatttttttagacctagtctcgctcttcgctcagactggggtgtgcagtggtgtgatcttggctcactgcaacctccacctcctgtgttcaagcgattctcctgcctcagcctcatgaatagctgagattacaggcacctgccactgcacctgggtaatttttgtatttttagtaaagatgggggttcaccatgttggccaggctggtctcaaactcctgacctcaggtgatccacccgcctcggcctcccaaagtgctgggattataggcatgaaccactgtgcccagcctggtatcggtttttaaatttcaaatttcattgttcattactagtaaatagaaatacaggctgggtgcagtggctcacgcctgtaatcctagcactttaggaggctgagatgggtggatcacttgaggccaggagttagaaaggcacccagcctggccaacatggtgaaaccccgtctttactaaaaaatacaaaaattagccaggcatggtggcacatgcctgtagtcccagctactctgaaggctgaggcacaggaattgcttgaaccctggaggtgtagattgcagtgagccgagatcatgcccctgcactccagcctggacaacagagcaagaccctgtctcaaaaaaaaaaaaaaaaaaaaaggccaggtgcagtgattcacacctgtaatcccagcactttgggaggcagaggaaggtggatcacctgaggtcaggagttcgagaccagcctggccaacatggcgaaaccccatctctactaaaaatacaaaaattagctgggcgtggtggcacgcacctgtaatcccagctacttgggaggctgaggcaggagaatggcttgaagcaggagaatggcttgaacctgggaggtagaggttgcagtgagccaagattgtgccactgcactccatcttgggtgacagagcaagattccatctctaaaaaaaaaaaaaaaaaaaaaaagtattccctgatctgttaattactttaattactgggagaggcatgtaacgtttcttactctgttggtgaatttgtccattttcccttgtgttctgttaatttttttattttttgatacagggtcttgctctgttgcccaggctggagtgcagtggcatgatctcggctcactgcagccttgatctcctgggctcaagtgatcctcctacctcagcctcccaagtaactgggaccacatgtatgcaccaccatgcccagctaatttttgtatttttcttagagacaggggttcaccacgttggccaggctggtctcaaaatcctgagtttaagcaatccacctgcctcggcctctcaaagtgctgggattataggcatcagccattgcgctcagccaatttttattttatttgttttgagactgtattattagacagataatactccaacatgtgagctagaacattaacaagcaatttatacctaggtatttgtgaactatacctaggtatttgtgaattatacctaggtatttgtgaactacttaccatcccaggtttctgcctcctcgatttgaagtaataatatcctgtcttactctttcttttcctttttttttttttcagacaaagtctcactctgttgcccaggctggagtgcagtggcacaatctcagctcactgcaacctccgcctcccgggttcatgtgattctcctgcctcagcctcctgagtagctgggattaccgccaccacaccgggctaatttttatatttttagtaaagatggggtttcaccatgttggccaggctggtctcaaactcctgatctcaggtgatctgcccacatcagcttcccaaagtgctgggattacaggtgtgagccactgtgcccggccaagttttttgctttttttttttaaactacatatttccccatttattggcttatgagttatatactgtcttcaatttatattacttaagtggtttcctttaaaactttaatacagatacttaagatctcacatttatccctactctccatctgataatacaaggagcttagaatgctttaacttcctgcagccaattaagccgactgagttcctttcctcatgggggcccagtgtgcaatggctgtaaatagcagcttccttggtagtgtatgcagcctgtttgttgtatgggttgctctaagggaccttggagacagtcctttcagatggatgttcatgtttctgaccttacactaccccaatgtaggctccaaactggcatgcgaggtgcctttggaaagccccagggcactgtggccagggttcacattggccaagttatgtccatccacaccaagctgcagaacaaggagcatgtgattgaggccctgcgcagggccaagttcaagttttctggccgccagaagatccacatctcaaagaaatggggcttcaccaagttcaatgccaattaatttgaagacatggtggctgagaagcggctcatcccagatgggtcaagtacattcccaatcatggccctctggacaagtggcgggtcctgcactcatgagggcttccactgtgctgccccctcttaatactcaccaataaattctactttctgtccacctaaaaaaaaaaatgctttaacttcagttacccctctctcttatgtacttttagtctgttattttagttttatcctgattccctcacataaacattattagtatattattagtgttgttttatacagttgtttaaatttatctactttttttgctcactgttcctttttgcatctcattctttccttcagtgattcctttccttcttgaaataattcctggcctggcacagtggctcacgcctgtaatcccagcactttgggaggccgaggcaggcggatcacctgaggtcaggaattcgagaccagcctggccaacatggtgaaaccccgtctctacttaaaatacaaaaattagccaggcatggtggcaggcgcctgtaatcccagctactcaggaggctggggcaggagaattgcttgaacccgggaggcgggggttgcagtgagctgagatcgcaccattgcactccagcctgggggacaagagcgagacttcatctcaaaaaaaaaaaaaaaaagaattcctttagaatttcttcgttaggagtctatggatggtaaatactctcaatttttatctaaaaatctgttttcccttactttttaacagtagttcatttttaattttatttatttttataaagacagggtctccctgtgttgcccaggctggtctggaactccttggctaaagagatcttcctgcctcagcctcctaaagtgctgggattataggcttgagccactgcacatgaccaaataatagtttagttgggtatacaattccaatttgacagttggcttttttttctcagtattttgaagataatgtctccagcttgtatgttgctaatgagaggtctgcccttggtccaatttcttattttgagacggagttttgctcttgttgccgaagctggagtgcaatggcgtgatctcggctcaccacaacctccgcctcccaggttcaagtgattctcctgcctcagcttccggagtacctgggattaaaggcatgcgccaccatgcctggctaattttgtattttcagtagagacagggtttctccatgttggtcaggctggtctcgaactcccaacctcaggtgatccgcccgccttggcctcccaaagtgctgggattataggtgtgagccaacatacctggcaccttggtccaatttctaattgccattcttttgtagataatctgtctcttttcttccactgctgtaagatctttatgtcttggttttcttcaatttaactaaaacatgtctataggtagctttatttttatttttgctaataatttattgtaactttttactgttttttttttttttttttgagacagggtctcactctgtcatgcaggctggagtgcagtggcgcaatgttggctcactccaacctctgcctcctaggctcaagcaattctcctgcctcagcctcccgagtagctgagattacaggtgtgtgccactactgcccggctaattttttgtatttttagtagagatggtgtttcataatgttggccaggctgatcttgaactcctgagttcaaatgattcaccagcctcagcctcccaaagtgctgggattacaggcataagccactgcactcggccctgtaacttttaaatctatagaatcaggaatggaaaatttgtggccattattttgaaatgtccaacatatgttgcattctaagcattcacaaataaataataaataatgaaaatgaactgggggagaggtgggctgtgcccacagtgtcccctttctacaatcctgaattctctgaattcctgaatctctccactgtaagttattacaggccatctacaggccagttctgaggcaaactagacagtgtgggagccatgcagggaggcggaagtggaaatgaggttcctggtattcccaggaagaagtaaggctataaggggaaataatataattcctaaaatcttttttttttttttttttgagacagggtctttctctgttgccccagctggagtgcagtggtatgatcatggttcactgcagccttgacctcctgggcccaagcaatacccctacctcatcctctgagtagccaggaccacaggtgtgcatcaccacacccagctaattttttaaaatgtttttgtagagagggggtctccctctgttgcgtagcctcatcttgaactcctgggctcaagcgatcctcctgcctcagcttcccaaagtgttgggattacaggcgtgagccaccacacccagcctaaaatcttttaccctttagctaaggatgacatcctcttcctctgtcaatatttaactagaaggatcaggctaggcatctcttcgttgtgctccccagcatccttttcttcccgtatcaagcgcagcacgtggaagtgtcgtgacctgttttcttgtgcgtctgctaaaatgtgagttaggctatgaacaccataggaagaggaattgtgccggacttattcaaactgtaccccaggcacttagcttaacaactggtgtctagcagatactcagcaaaagtgcattgcatcgaagactgaataatttcaagataggagtattcaacgtctaatatgtaccaagcgctgttctcaatgctacagaaaagcaggtttctaaggtttctggagttaaacaaaaaaccctgacattgaacttacatggaatattaaagtcattatctaccataagcattatttcatgaaataaaataatttcaactctacaaaactaggaagcacagaacggaatactatttcccttaatgaaaaactccctacattgttctttttaaaaatctcatttcctagctgaacggtaaaaacatcatcattgattagctcctattcatagaaggcccattgcaacccactggtacagaagagaaacaaagtattcagcggagaataccctagctcaataagcggtacaatacagtaagggaaatagaagtgacatgcgatggacagccaggccttaaattgcgcggtgctgattcctgtcccttaacccaacaatagaaagataggcgtgcctggagttgctgggggacgaggctcgatccagtgtgaattccgtgaagttgtgcagggtttcactgtttgctgagtgtgttagacaggttacctggtagagttctcacattacttcgtgagatacacagatattatgactctattatactggtgcagaaaaaggctcgggaagattcatgtttcttgtgcgacttgcccaaggtgacacacagttctaacaactggcctatcgcagggtgtgagatctggaactcagaccttcccagccagggctcagtccacgccactgcctagatgaggcagcaggaagggtcagcagagaagggtgccccaccgggacgactggaacacctcagtaggatatgggtgggcaaacgtgggccacacgatcccaccggcctcttttgtcctaagtcccgaggcacgggtgcagctagaagagtgggcggtaaagcgcagggaggggatgcggtcgggagcagatttcgggggcggggcccgcgcggcgggggcgggcccgcggcgctcggggcggggctcccctcgggttcgcggcccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtgagtgcgccccagactgcgcccgccgctgcctgcctgcccttccggcccccagccgccctgcaccctcacctaccccacccgggaggagggacagggaggacccttccagagcgtccctagaggggcctactccccgcgcgccgcctctaggcctcctccccttgcttcctcttttcctcccgggctgcctggtttccttctggacttcctccagccactgggcggtgcatccttcaccctttccgtccttccgcgtctcctccctggccctggaggcttgtccagattgcgccgcattcccgctcatcgcacactgccgtttctaacattttccgtggctttctagatgacctgttgttcatgcacttcacttagtgccctcttggacttttgggccgaggtacctgattatcagccaccttatctctgctttatggtggctctagaattagccagatgttgatctagctctttgttctgtgttgccttctagttccacggttaaagctcttatctttgtttttgtttcctcctgtgaagtcctggatttgattaacgaaagaatttgagtaaaagtgagaactggaattagggtgctataagcattataataatttggccttctcactgttggttaactctttaattttttttcgggacggggcaaatattggaaataagaggatggagttatgtggcttatgtctgtaagagtcagaaaatccttcctggagagtccttaggctgtggctgccagttatctctcaggtagagttggttgcaagtttcatagtaaactgcttgcttacagtttaatcttttatttatttatttgaggcagagtctcactctcgtccaggctggagtgcagtggcaagatctcggctcactgcaacctctgcgtcgtgggttcgagcgattctcgtacctcaccctccctagtagctgggactacaggcgtgcgccaccacacccggctaatttttgtattgtttagtagagacaaaatttcaccattttggtcaggctggtctcgaactcctgacctcgtgatccgcctgcctcggcggcctcccaaagtgctgggattacaggcgtgagccactgcgcccggcccacagcttggttttatacattagggagacatgatacatcagtcagtatatgtaagaagtacattggttgggtctgaaaaggtgggacaacttgcagcaaaggcaggaagacttgaagcggcttccggatcacagataggtgatacacaaatggttacattcttttgagtttctgatgagcctttccaaaggaagcaaatcagatatgcatccatctcagtgagcagagtagtggctttgaatagaatgggaggcaggtgtgccctaagcggttcccaggttgagttttctttagtgattttgggggcccaagagattttcctttcacagcctgataacaccactgcactccagcctgagcaacagagtgcgaccctgttttaacaacaacaacaaaaaagcaaagatgatgagtaagcaattttggtggaggggggatgatggctaatatttaataagatgagccaggcactagtctaagtgcttgacataggttaaatgagttgtctttccataagtggttaatatggtgcgtggtacatggtaagtaagctgtgttagctcttactgctaacttttgtatttctttcttttttttttttttttttttttttttttttttttttgagaagggatcaaaaagctccctacattgttctttttaaaaatctcgtttccaggctgggtgtggtggctcacatctgtaatcccagcactttgggaggccagggctggcagatcacctgaggtcaggagtttgagaccagcctggccaacatggtgaaaccctacctccactaaaaatacaaaaattagctggttgtggtggctcacacctgtaaacccagctacctgggagcctgaggcaggaggatcgcttgaatctgggacacagaggttgcagtgagctgagatcatgccattgcattccagcctgggtgacacagcgaggctccatctaaaaaaaaaaaaaaaaaatactcatttcctagctgatcagtaaaaacatcactgactgatggcattcaatgatcagtcaattgatcaattcttattgactggtatagtggcaccatctcagctcactgcagccttgacctccctggctcaagtgatcctcccaccttagcctcctgagtagctggggtagctgggaccaaccacagacctgccacctccacacttggctaatttttgttattttttgtagagatggggttttgccatgttgcccacgctggtcttgaactcctgggttcaagccatctgcccgctttggcatcccaaagtgctgggactacaagcatgagccaacatgcctggcttaattgagcagccagttcagagagttcccatatacagttcagtacctcctacatacacatatacacacagattcccctcttgctaccattttgcattagtatgacacatttgttacaattaaacaatgctgatatattattaaccaagattgaatcattttacattagtataataatatatttgttataattaataaaccagtaccgatactggagtccatagttttttcagattcccttagtttttacttaatgtctttttctgttccaggaagccatccagaattccacattatatttagctgtcatgtatcctcttgggactgtgacagtttctcaaactttccttgtttttgatataactttgacagtttgtttgttttttgagacagggtcttgctctgtcatccaggccgtagtgcagtgagtggcacaatcatggctcactgcagccttgatccccctggttcaagtgatcctcctgcctcagcccaagtagctgggactacaggcgcatacaactgcgcccagctaattttttgaatttattatttgtagagatgaggtctcactgtgttatccaggcttgtctcaaacgcttgggctcaaacaaacaattctcccatcttggcctcccaaagaaagtgctagaattacaggcatgagccactgctcccagccagttttttgttttttatttttttatttttattttttctgtagagacagggtccccctatgttgcccaggctggtctcaaactcctggcctcaagcgatcctcctgccttgacctcccgaagtgctggcattacaggtgtgagccactgagcccagccaaccttgacagttttgaggagtgttggccaggtatagcgtaggatgaccctgtattggaatttatctgatgttttctcatgattagattgggattatgggttttgaggggcaattcacagaggtaaagtgccattttctttcttttttttttttttttttcttgaaatggagtttcactcttgttacccaggctggactgcagtggtgtgatctcggctcactgcaacctccgcctccctggttcaagcgattctcctccctcagcctccgaagtagctgggactataggcatatgccaccaccctggttaatttttgtatttttagtagacacagggtttcactgtgttggccaggctggtcttgaactcccgacctcaggtgatccaccagcctcggcctcccaaagtgctgggattacaggtgtgagccactgcgcccagccaaagtgccattttcatcaggtattgagggcgcatagtatccacatgatttatgactgtcagcgttaacctcggtcccctggctgaagcagtgattatcagctttctccactgtgaagttattctctcatccctttctatactgcactgtacctgttataaggagactaattaaatttttcacacacaaaaactcaaacccagcatcccaacgtagcttccttatgcctcttaaaataggtctcagacactgctgtgttcagaacccttcattagacttgcccaggcctgcctccccaactctgcatctggagcctgcatctgtttatgcctctcctcatgttgctgctcgtctccttgtgaatgtctcctcccttcctttccagccatctcaatcctgcgtgtctttgaaggtccagccagaaagttttcttcccctatgaaatcatcctggagtaatcgaatccatttctaaattctaaatgctatttgttactgacctatgctccatcctgcccctcttccaggtaaatgaatggctgtttgctataggcaaaaactgggttttgtgataaatcattcagattttactttttttttttttttttttttttttttgaggcagagtctcgctctgtcacccaggctggagtgcagtggcatgatctcagctcactgcaacatctgcctcctgggttcaagcaattctcctgcctcagcctcctgagtagctagaattacaggtgcatgccatcacacccggctaatttttgtatttttagtagcaacagggttttaccatgttatccaggcaggtcacgaacgcctgacctcaagtgatccacctgcgtcggactcccaaagtgctgggattacaggcgtgagccactgcacccaacccagatttgccctttgtttaagagctaacagaacacagataaagaatcatataaccagtgcctattatataaaatacctttcttctgaaaaggtaaattttaggaacagaaaacacatattaggccaggtgcagtggctcatgcctgtaatcccagcactttgggaagctgaggcgggcagatcacctgaggtcaggagttcaagaccagcctgaccaacatgatgaaaccccgtctctactaaaaatacaaaattagtcggatgtggtggtgcatgcctataatcccagctacttgggaggctgaggcaggagactcgcttgaacccaggaggcggagactgcagtgagctgagatcacaccattgcactccagcctgggcgacaagagtgaaactctatctcgaaaaaaaaaaaagaaaagaaaagagaatgtatattaggctgagcatgatggcttatgcctgtattcccagcactttgggagactgaggtgggcgggttgcttgaggccaggagttggagaccagcctggccaacatggtgaaaccctatctttacaatacaaaaattagctggacttggtggtgcacgcgcctgtggtcccagctacttgggaggctgaggcatgagaattgcttgaacctgggaggtcgaggttgcagtgagccgagattgcaccactgtactccagcctgggcgacagagcgatactctgtctcaaaaaaaaaaaaaaaaaaaaaaaaaacatattaatcactgactcccagttgagttctgcttttctgtgtcttatcacaagtccaaatgcagttgcttcagtagttttttgtttgatgagaaactactacagtgaaaaggacacagatagggtacagatgacaagatcagaggctcggtccaaggtctctgagatgacccatgggatgcagtgaggaatggaccctttctggtggctctgccctgtgaagtggatgtcatactttggcatggattccaggatgaactaaatacacagaggagagagctttctagttcaaaccagactggctggcggaaaggttttaaggattacctaaaattctctcattccagccagctcacttctctggccagactgagctcgtgtgggagatgtcagttctgaaatgttcttcttttcgcttaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtaaggagactaaggttaggtgcacctgcccttgggatgaagaaatgatttcagatctatcaatcaggtcacgtttcagtggtaaattattatatccattcagtggtacttctgaaaaattgcttacttttaaattcttccacctactgaagttgtatgtagccttcctctaaatcccatcagttgagcacagatttagtttcttgaaacctttgtgttctccaagatagactccaggccattatcatcacacacaggtggccggtcatgctcttattcaaactaatcaaaaggaaactctctccaggtaaaatctcctaagctttctctgttgtcaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggtaggagacaaagaccccacaggcaaggttggattggcctcagaggtgaggaggactctgaccagtggacctgctgggggggttcttgggcagtcttggatcctctgtctgagtccagagcctttctgcagctcatgcagcatgagcacagctggaggaagtgctctttttctccctgcctttctcactccctctctccagttctaatcctgctgcctggaatgagatcatcatccctgctagcagtagcgctgtcctgggctgccttacagagggatgttggaatttaggctgcagttttgggaaatggatttttttttttttttgagatggagtcttgctgtgttgcccaggctggactggagtgcaatggtgcgatcttggctcactgcaacctctgcctcctgggttcaagcgattctcctgccccagcctcccaagtaactgggactgcaggcatgccccaccacgctcggctaatttttgtatttttcgtagagacggggtttcaccatgttggccaggctgctcttgaactcctgacctcaggtgattcacccgccttggcctcccaaagtgctgggattacaggcatgagccatcatgcccggcctgggaaatggatctttattaatatctttaagttctaaatgcccttctagcagctatatccactttcctatctttgtaccaaatcttccccattttcttttgcacgtagttcctggaaataacaactttggtatcatttccctcgaagagggaagtggactctccttcctatctgcagcagatgcatgagtctaagcctacggtgagagcaatgcctccgtgaagttacatggatcttgtgaagataaaaagggattttgtaaggtttcctgataaaagaggtttgaccaggagtataggtttttcctggctctcatattacctccaccatagcttagtcccaatgtgggagcatcacaggctggacggtgaagccgtgaccttttcctggcactgttgctgttctttatctctggccctgctcccagttcctagaggcagtggtgtccttgacaacattagttacgagcctcagacttcataactgggctcagtggcactgctggtatcatgagtcttagtttctggttatcagttggaataataaatgggattccattggcatctgctcccagcgcacacattcaaaacaataccagtctggaaagacaaagtgccctcctcttacgaagggctgtcttcctaataggcagggcgggaaataaccaaaaggatgtcatctttgcaatagacaagcaagtagataagtaaaggaacgtcgtttccaagaatacccttactaaggttctacttgtaagagtatgaactattaatgggaaatgagagaacaatagattctaaagatactgagtgataatgatttctttttatactgcctgtaataaaatgacaacatggtatatcgaactaggtgacagaatccacttaactggtggtaatgccttattccttccgtgattaaatggacagttcttgcctcctgggtcacatcgtagggtcttgtggggggttatttatttattatttttgagatggcgtcttgctctgttgcccaggctggagtgcagtggcgcgatcttggctcaccacaacctccgcctcctgggttcaagtgattctcctgcctcagcctcccaagtagctgggactacaggtgtgtgccaccatttctggctaattttcatatttttaatagagacagggtttcactatgttggccaggctagtcttgaactcctgacctcgtgatccatccacctcggcctcccaaagtgctcgattacaggcatgagccaccacgccgggccgtgggggtttattaaatcggagggtcttctggcaaggtatgccacctatcccagtccctgttactgcaagaggaaaatcctgggcagaggggaattatgggtatatcccagtaggcccttttatgtataatctcttctaatccttacacagactccatgaggatgatactttctacattttaaaaataagcaaaccaaggctgtggtgagtggcttgtgcaggaccactagttggcaaaactggaattaaaattcaggtatttccattgcaaatccagtgctctttgcaatatactacaggtagtgagattgcagcttgactgagagcatcctgatttattttgacagaaatgtgtgtcctggtggaggtatcttggatgactgtcttaaaccttctagttgtaacaagctgaagtccactgggctgaaggactgtggtaattttgacatccaaggtggtggtagaacaattcacaaagtaattccttgaagatactgactgccgtcccatgatctttttctgtctggtttcctgtcacatcatctttggcgacttttctctcctaacacccagggttgagggtggctgcagggtttcttgtgcctttctccctccctccctccctccctctttctttcttttcttgcctcgctctcttgcccaggctggaatgcagtggcacaataacagcccattgaacctcaagctaccaggctcaagcagtcctcccacttcagtctccagagtagctgggaccacagctactctgtcaccatgcccagttaattttatttattttctgcaggagcaaggtcttgctatgttgtccaggctgatcttgaactcctgggctcaagagatcctcccacctcggcctcccaaagtgttgggattgcaggcatgagccacaacaccaaccttcagggtttcttgacctctactcagggagccttctccactctgtcagccacccatattcacacccatgctctggagtctagagcctagacatcgtcattgtcatgaactgtaccatatctgaacttttaaggcccttgagccccttgtcctcattcatcctgactctgctaaccttccagctctctgacggcctctctcccactatattccaccatgtctcctccttgagctcatggcagcctcccttccggcaagccactcatttctcctgggcagtcaagaccctcctgactgggcttccctccctggcccaagtgtgtggttggttacctcttaccaacaccccaaagccccttgcccacttcccgctgctataatgtcccagtcccttgttatacaattccttttctctacttctataagtgggtatttgggagatgtagaaaatagtgaaactacacagtaataaccactacacctttctcaattcttcgtgaaaagttggaattaaaggaaagttgaaatagacatgtgtggggttttccagaaaaatgtaacagatgtacagtcttcaactgcaggtgtgctttcaaggttgttcaacagtcctcttatttacctttccatctcactccctttaagctgttctaagactttactcttctctttaagtttgctatccaatcccatcccctcatttaagcagaaggtcttgtctcctgttttattgagaatattaaattcatcagatatgattatgtcagtttcctgtcctccacttaaaaagttatcttcatctgcttttatccttccggactgcaacaaaggtccttccttctgtttaaagccaaatctcttcccttacatgtcctctgggactttgcctcatcatttacatctctctcttcaaatctgcagcctccccctctagacaagcaccagtttctctaagatctatagcaaagcaaaaaacaaactcaaggctgggtgtggtggctcacgcttgtaatcccagcactttgggaggccaaggtgggaggatcaccagaggtcaggagtttgagactagcctggccaacgtggtgaaaccccatctctcctaaaaacacaaaaatcagccggacatggtggtgcacacctataatcccagctactcaggaggctgaggcaggagaatcacttgaacgtgggaggtggaggttgcagtgagccgagattgcactactgcactccagcctgggtgacaaagtgagactccacctcaaaaaaaagccaaaacaaaaaaaaaaaacaaactcggccaggtgcagtggctcacgcctgtagtcccagctacttgggaggctgaggcaggagaatggtgtgaacccgggaggtggagcttgcagtgagccgagatcgcgccactgcactccagcctgggcaacagagcaagactccgtctcaacaaacaaacaaacaactcaaaaaacccttaactccatattctcttctggcacgacacactgtccttccctctgtagccaggtgacttcagtggcatgtatacgcactggctgcacttcttgaaacccccccaccccacaatcatttattgctacaacccattggaatccagccccccacccttgccatgccgttgaaactagtaagagaggccattcgcctcaatacggataacatatgtgatgctttttagcccttgccttcatgttctgctgtttttcttctgcccccattgaccctcctctggcttctgtgacaccacccatgctggtcatcaggcctcctggttagtccttttctcatctccttccctgactcctctgcccagctccttgtgtgtcgatgttgcccaaggctctgtctttgacctgttcttttcttctacatgctttccttggagagctcacccattcttgtagtttaacatattttctgtgttctgcagccaggatgatatcttaaaactaaatctgataatgtcacttgttggcttaaaatgctcccatggctctgaaggtccggttctgtaacagtgcacctgaggctcttcatgacccgaccctcttgggcatctcatgtcccacctcctgccactgcctccctcattgcaatctgatcctgtcctcaagtaatcccagactctcggtgcttcctcacatgcatatgcagtgttccatggctacgtctttgcttttgatatttgggaagtacctgatactggtttccctgtatcttttcttcctgttagaatagttcctatgcttcagcaaacgcagaggaagttttccctcatccgggcctggacccatcccactttgccatcagtctcttttttttttttttttgaaacagagtcttactctgtcacccaggctggagtgcgatggtgcaatcttggctccccgcaacctctgccacccaggttcaagcgattctcctgcctcagcctctcaggtagctgggattacaggcatacactaccatgtcctgctaattttttttttttttttttttttttttagtagaaacagcctttcaccatgttggtcaggctggtctggtactcttgacctcaggtgaaccacccacttcggcctaccgaagtactgggattacagacatgagccaccaggcccagccagtctcattcatatgtctgtgtggaaaagcagttctaagcgcagccaggggctcttggtcaagcagagcctttggctgcaggatccctgagtccattgcatctttccattagactggatcttcttgttttgtttttgtttttgtttttgtttcctccaagccacctttgtttccctatctttttattaagaaaatttcaaatatttagaaaattgaaaggatgatgcattgaacacctatagaaccatctactttgtcatattagttttatgagtggatttgtttttatttttgctagaccatttaaaagcaagtaaatctgtgtgcctctctgaagaatagaggcattctcccttataaccacaatcccattattgtacctaaggcagttaacaaatttctattaacattagtaggtttgggtcggacacagtggctcatgcctataatcccagcactttgagaggctgaggcaggtgaatcacttgagcccaggagttcaagaccagccagggcaacatagcgaaaccctacctctacaaaaataaaaaaattagccaggcatgatgatgtgcaactgtagtcctagctactggggttggggagctgagatggaaggatcacttgagccccaggaggtggaggttggatcacaccactgtactctagcctgggcaacagagcaagaacctgtcttaaaaaaaaaataaaaaaggtttgtctcttaaggttttattcaattccagattctactattagaacgctttcttatctctcctctaagtagggagaagaaaactaacatttactgtataaatgtttgaagggcttttgtgtgttgtcttatttaatcttcactcattttacagatgaggaaactgaggctcacagaggttaaatcacttttgcaagatcgcattcagtagtgaagccataactgcgtagcacggttccacctccatgaggctgtcttgggttcttgtttctcaggtgtggtgagcggtctcttggatctgtgtggtgatccgatcttgcactccgtcactgtggctgactgcattgtcacattcacttggcggaggccaatttcctacaggtgctttcaggatcaggtcactgcgatggtctctaaacaccattctgctttctctgctctcttgtctttaggagccgggtgtgggctgagccctgcctgattgatgctgccaaggaggagtacaacggggtgatagaagaatttttggcaacaggagagaagctttttggaccttatgtttggggaaggtgtggtatcacattgactctagtgtctcctgttaaactgagtcactggcttccattcttcctcttcgtgtggcttttccacctcctgcctcccagagcaaagtttccctgatcccagaagtgaaggagaggaggaagagaggagggtatgagccaggcttctcactgttgctgaggagagggcctaggagatgaggttctttgtgtgtgtgtgtgtgtgtgtgtgtgtgtgtgtgtgtgtgtgttttgagatggagtctcgctctgtcacccaggctggagggcagtggcgtgatctcagctcactgcaacctccacctcccaggttcaagcgattctcctgcctcagcctccagagtagctgggattacagacgccctccaccacactcagctaatttttgtatttttagtagagacagggtttcaccatgttggccaggctggtctcgaactcctgacctcaggtgatctgtccaccttggtcccaaagtgctgggattacaggtgtgagccaccaggcccggcagagaagaggttcttgaggtgttcaaaatgtgacctgcagttgccaagtttgagatggggcagcaccgtcaaggtcctttgttgacctgtgttttcccattgctggaagtttccccacactctgtttttaactttgacatcttcagactttaggctccttagataaaaggctccaggttggtctttatgaccccaagttggcctccagggaactccatgtgatggagctgataatacatttatcacctccacccctgcttggaaggagagagggaaacaaatgcctggagagtgagctccaggagagcagacaccacctcgatgagggaagtcccagcaaggcaggggagccacgtgggagaagcattgaggagcctgggctttattttccgcactgggcccgaagtcgtactctgcctgtttagtgactgcatctgttagggcttggaaataggctggaaagggaggcgaggtagggtctgctccgggaagccagggcctcttggtgacctccccgcttctcggcaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggtaaagtgcccacccctctcctaaggagtctgcctcccattcttaacctgtggggccagtgtgatctccttatggggtttcagaatacaagtgggtgtgaagagacgaggcagtagtgtgtatccaacatttttctgtatgtatgaattgtcaaaccacacatggtttgacaactgacttttttttaaaaaaacatttccccaggtcattagttttttttttttttgagacagagttttgctcttgttgcccaggctggagtgcaatggcacgatctcggctcactgcaacctccacctcccggcttcaagcgattctcctgcctcagcctcccgagtagctgggattacaggcatgcgccaccacacctggctaattttgtatttttagaagagacgaggtttctccatgttggtcaggctggtctcgaactcatgacctcaggtgatccaacctcctcggcctctcaaagtgccaggattacaggcgtgagccaccatgcccagcccattagattttcttctatagctgcatatatggatgttttttaatttactggttgtttccaattttccattgaaatatgttgacaaatttccttacacataaatgtctattcatatcagatgatttcaacaatgataaattcttagaaacataatttctgggtctgaactttttttttttttttttttttgagacagagtcttgttctgttgccaggctggagtgcagcgttgcaatctcggctcattgcaacctccacctccgtagttcaagcaattctcctgcctcagctcccccacatcccactccctgtagctgggattacaggcatgcaccaccatgcccagctagtttttatgtttttagtagagacaggatttcggcatattggccagactggtcttgaactcctggcctcaagtgacctgcctgtctaagcctcccaaagtgctgagacaacagctgtgagccactgcgcccggccctgaacgttttaaattacatagtctttttagtacatattgtccattatcttccagaaagtttgtacaaattctgtactttcattcagaatatatatagcaagagcctgtttgtgaatatcttaatcagccattaggaatcctgcaagcaaatatttttatcccattgtacagttgaagaaactgaggctgagagaggctaagccacttactcagagtcaaaacatctaggaaagggcagagctggctggttccaaaaccctgtgccccacccctccactgttccctcagtcattgtttttaatgcagaaggagacttagagatccttaaaaatttggggttgataatttcttttgtctgacagaaacagttagatgaaaataattctaagttttcacagaagatcaagtcattgccaggcatggtggctcacgcctgaggcaggtggatcacctgaggtcaggagtttgagaccagcctgaccaaaatggtgaaacccccgtctctactaaaaatacaaaaattagccaggcatcatggtgtgtgcctgtagtcccagctacttggtaagctgagataggagaattgcttgaatccaggaggtggaggatgcagtgagccgagatcgtgccactgcactccagcctgggcaacagagcgagactctgtctcaaaaaaaaaaaaaaaatcaaatcattttctaaaaataaggccgggggctgggcgtggtggttcacgcttgtaatcccagcactttgggaggccaaggcgggcatatcacctgagatcaggagtttgagcttggccaacgtggtaaagccccctctctactaaaaatacaaaaattagctgggcgtggtggtgcacacctgtaatcccggctactcaggaggctgatgcagaagaatcgcttgaacccaggaggagacggaggttgcagtgagccaagatcacgccattgcactccagcctgggtgacagagtgaggctttgtctcaaaaaataaaataataaaataaatgaaataagataaaataaaaatacagtactttgataaggaaaggtaactgtcagaaaggtgcgattcccccagtcctcacttaggagagagaccaacagcctgagttaaccaagtcctttgtagcccacagcaacagggagctagggactgagtcaggctctctgtaactgtccctatttgccctgggtccccaggagggtaatgttattaagcttcaggtatctgtcgctgttcttcttgaggccacaaggaggcagcacagtgtctctgtcaggaaaatacacttggatgtggtgacagacgttttcccgaggcttacgtttgattctgcaccaggcgctgcgtacacctgcttggaggctgcaacggggcgggctctgctgcgtcagcacatggacatcactggagaggaaaacccactcaacaagctccgcgtgaagattgaaccaggtccaggaggctcctctgtctgacacccactcccctcaattgagcttggagccccaagttaatgcgaacttcatgttgatcagtgcacgcttagaatactttatttggagggaggggcactccagagctctttgtagccaattctctggcccctgggctgactgaacccaagccattgcagccagataggagttctgtccagtctgtgcggttcgtgatgacttcaccattgctttgcatttgcacaagtccatatcgttttaccaggctctttcgcattccttcatgatcatcagggcagatctgtggattctgtagaataaaagcattagccttattttacagaggatgggactgagtgccagacaagttaagtgtcttgtccaggtcatgtacctaatcagtgcatgactgcaactgagatccgggtcctctctccaaattcagatctttttacttcctaacattttccttcattccatgtgtgactaatctgaaacctttttatgcaattgaagctcatgttccttgatgccgttaagtttgcagatgaatttcttagagacgggtaattagttttagcctggaacagctgtaaaaacaacacattggctgggcatggtggttcacgcctgtaatcccaggtcaaagcgggtggatcatgaggtcaagagttcgagaccagcctagccaatatggagaaccctgtctctactaaaaatacaaaaattagctgggtgtggtgatgcacacctgtaatcccagctactggggaggctgaggcaggagaatcgctcgaccccaggaggcagaggttgcagtgagctgagatcgtgccactgcactccagcctgggtgatagagcaagactccgtcttaaaaaaaaaaaaaaaaaaacattgatctgggagggtaggttgagtatttaggtggtgaccaatagggatggaaaagacacagcttggtgctcagtgggaaatgctgatggaacctacccacacaaagtgtatcctgggactaaggaaatgtgtccgctcctctggaaggctggtttctctgtcttcatattagatccacagtgaatggccctctgagatcttggaagtaccttgagagaggccaatatctggagagagatcttggccttgagatagagatcttaagagagagagtcttggccttgagagagtccaagatctggagagaggccaggatctggacaccttcttggccttgctgtccctggggaagctgaattctgatctcttccatcgctagtctttgactgtggagctagagaagaacgttacgggtgacaggctacaaaagctcaaatcttgtctgctttctcctctgccaggcgttgacccggacgacacctataatgagaccccctacgagaaaggtttctgctttgtttcatacctggcccacttggtgggtgatcaggatcagtttgacagttttctcaaggtatagtcacatgaggggagaaggaagaggagcggataaagccactgggcctgatcaagggtagaggcagggggcgaaagatgtaaggggttggaggaggacccaggacacagagggacaccactccccacggggccagagagggtctaaagagctttccctcctcacaggcctatgtgcatgaattcaaattccgaagcatcttagccgatgactttctggacttctacttggaatatttccctgagcttaagaaaaagagagtggatatcattccaggtaagcagaggaactggcccacaggcttctaaaaaatagtagagaatgagatctcattgacactcggaaagatggtggtggatgggaaaacactgggtcagagtcagctaggtaggggcgttttgggaagcaaacccagaatcctgggatttattccacaagaatgacttcttttcactcctctctgcctcattttctcccagtctgtttccttactctctcctctcacctggacacacagtcagacccttaacttgcctggagagctgccactgctgccgcaccactgccccaagctaaaactcacagggcaggagcggaggcagcacccctcctacagccttctgagtgaaggcaaccccagtggccctccttatttctttctttcttttcttttctttttttttttttttgagatggagtttcgctcttgttgcccaggctggagtgcaatggcacgatctcggctcaccgcaacctccgcctgccgggttcaagcgattctcctgcctcagcctcccgagtagctgggattacaggcacgcgccaccacgcccggctattttgtatttttagtagagacggggtttctccatgttggtcaggctggtctcgaactcctgacctcaggtgatccacctgcctcggcctcccaaagtgctgggattacaggcgtgagccgctgtgcccagccgccagtttctgcctgggaggtaccacttccaaagaaaaaacgaaaaatgtcctgtcatggaagacacaatccattagacatacccccacttcttgctgtgacctgaaccttgagtcactctattgttggtttgatgaagtccgcgtcctctgacagtaggattggtcaggactttagcagcacctactgttcggttggaggcttgcattttaatgcggggactccggagctaatggtagttaataattccagagtacttactatgcatcaggcgatacgctaagcttttaatgtttatttgctcatgtaatcctcataaccatcacggaggcagggcctatcacccccactttatagataaaactgaggtgcagagaggtgaagtaacatgcccgtggcctcccagctggttaatgacagagcaggggtaggaacccaggcagcctggtcctagagcctgggtgcttaagtacagtgtggttgtgatcggtaggagaatgtgcacgtgaatagagcatccaccaacttggctctgacaacacagtgctaatttggagcgaaaagcactttcacggtcgaaacggcacagtctctagatgtcgttataactaggaccctgctggagcgaatagttacatgggaaagtaatgttaaatgctggggaaagagtttgggatggagagaggagaaacttgaggtctctgggagttgcttaaaccagttgaccgtaacctggccagagaattctgatagtgtcttctctcctcccaaacaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctggtaagaaaaaatggtgaaccagggctccttgtgtgcacagctttatgtcaggggctagagggaggctcacaaaaagtagtgatgcttgcccctagggaactgccacgtacactagggaggctggcactccacaaggaatgtgccaccgggaggttatgggttaggggactgccacgtacactagggaggctggcactccacaaggaatgtgccatcgggaggttatgggttctacttacaagcacctcaaggacaaagtcacaaagcctggcattgctcaagtccgaagctcctgcaggcgactcttgtaaggcttttgtgtctattaagtcatttaattcccacaactcctctgggaagtaggcggtgtgatgttaatacccaggtgacagaatgaacttgaggtacaaacagttcgcacagaacccagtcatccagagctctcaacctctaatgctttgtggctgctcagtcaacataatattcaccaaggggttaaaaaaaagttagagccaagatgacttttagcagatgagtggtaggagaaaaaatgggacagatattgggggaatatgtctgctttaatcttgctctgtcgaccaggctggagtgccgtggtgctattggctcacagcaacctccaccttctgagttcaagtgattcttgattctagcacctcagcctccaagtagctgggattacaggcgtgcgccaccacacccggccagttttgtttggtatttttagtagagatggggtttcgccatattggccaggctggtctcacattcctgacctcaagtgatccgcccacctcagcctcccaaaattctagtattacaggtgtgacccaccgtgaccagccacaaaccatttctttctcttctccagggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggtgggtgacccctgcctcgctgttcccgaaagcacactgggacccactcggccatatgtgaagtaatcatgtgggcagggctcatctaggactcatctgaggcacagagggaggggcaaatgacctgaggaccctaccactcagcctctttactagtgtggctttgaaggcattgccctagggacaagaggaggcctgcaggcttgcagtgctttctgcaattcagctggtgagaccccagggaaaaaagctggccagagccaacgcagaggcgggaaagagggtgacagtgtcatgtgggaaacacaagagggaaaggggccagaggcggagcaagaggaacaaaggcttggaggataggtccctgctgccctgtgacttgggcatgatcgggacagcagccagaccctctgtcactatgtgaaagttgccctgttggggaaaggccccgggctctcaggatgaactgaatgtcatcagattccggagcagggaggggctggaccggagacgaagcattgctctgcataaagtcagggctgcctgcctgttcggggatattctgagccctttgatggcttcctcaaggctctggattttaggaacttgtgatgtcgctggcttatatttgtgtgaatttgacctgtgggttgacctgtgggttttcctttgcttgactgcagctggaccgtatgcggctgtgagctttatgtgccgcagctgctgatatctgctattcacgtggtggctcaccacctacacctttccagaagtctggaatcccattgtgtccacccaactcattcattttgttgactgtagacgtccccatgttagtatggattgggacgcgtattgagatccatctccatggatctctggcgcccaagaagatgcctgaattagagcacttctgatgagaagctcctcattccagctgtgatgcccacatcccttttagcacctagccatggctgctgttagactggcactgggggcagcagggctggacagatccaccaggcaagcttcttaggcatgtgtatgtgtgtttcttgcaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagttacggattgagtgactattaaatttcttccaccagaggtcctcactgtgtttgttcaggaaaggtcactgggggaggcccagagaatgacagtattttcctgtcctcagggaacagccagggtgaaggaggtgggtgtcctacacatgcatatgaaaaaaaatatggcaaaatggcacagctggtgcaggaaaatgaaaaaggaatagcattccagttctccgtgaagcagctgaattctctatctgcagcagcattcccattatcttttccatcactaagaaaaaaaaatgggctgggcacggtggctcatgcctgtaatcccagcactttgggaggctgaggcgagaggatcgcttgagcccaggagtttgagaccaccctggccaacatagcaggacttcatctctaccaaaaaaaaaaaaaaaaaaaaaaaaaagccaggcgtggtggctcacgcctgtaatctcaacactttgggaggctgaggcaggcaaatcacttgaggtcagaagtttgagaccagcatggccaacatggtgaaaccccatctctactgaaaaaaaagatagatgcaaaaattagccaggcatggtggctcacacctgtagttccagttacttgggaggctgaagcaggagaaacacttgaacctgggaggtggaggttgcagtaaactgagatcatgccactgcactccagcctgggtgacagagtaagacttctcaaaaaaaaaaaaaaaaagctgggcgtggtggtgcattcctgtggtttcagctactcaggaggctgaggcaggaggatcacttgagcccaagaggtcaaggccacagtgagtcttgattgtgccactgaactccagcctgagtgacagagtgagaccctgtctcaaaaataaaaataaagtgtcttatgactttttatctacccttctgcccatgcccaaggcttcactgggcctcacctgtctttgatcctagataactatttgaatggtaatcagtaaagtctttagaacttagcactaaattctgatttcctggcctcaacatggggacctaaacagttagcaatctgggtttgggagtgggatgaggggagggttggaagaaatatttagtgtgtttcatttgcctttcttaaatacagggcacccctgaaacaggctttgttcgcagctctgctctgtcctcggatttaggttatcgaacaggcttcctccctcccctgcacaagggttgggaatgagtcgatttgctttcactcagcaagagcaagggactagtggtgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttctcacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggccccctgaagggctggggaaaatcctactgagccccaggctctcctgcctgcactggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatcccagcactttgggaggctgaggcaggcagatcatgaggtcaggagatcgagtccatcctggctaacatggtgaaaccccgtctctactaaaaatacagaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggtctcatccaagatcacacagttgcagatgctggctacaagtctcctgcctcaaccacctgtattaccccattcagggtctcaagaagggtctataagacactatccattgtgtttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagacggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacaggtgggtctcagcggggtgggatggggcacggagtgggagacagatccatctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcctgcccctactcttgggatggctccaagggctgaggtgtgaatccccagtgtgctccaggaatggggctgtgtgggctgggagtggtggctcacgcctgtaatcccagcactttgggaggctgagctgagcggatcacctgaggtcaagagttcgagaccagcctagccaacatggtgaaaccccgtctctactaaaaatacaaaaaaaaatttatcccagcgtggtggtgggcacctataatcccagctactggggaggctgacgcaggagtatcgcttgaacctgggaggtggaggttgctgtgagccgagattgtgccattgcaccccagcctaggtgacaggagtgagactccatctcaaaaaaaaaaaaaaaaatggggctgtaaggtctgctgggtggcctgagctgagcctgtttccctgcctggcccttgcagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagctgagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctcccctggcagctctgacgtctccaccgcaggtgagagctctctctgggccacaacctcccttccccgaagtgtcccttgttccctctggctcccagcaccataactcaggccttctggcaggaacaggaacaggctgggaagtgtgtcctgagagccagcagcgtggttgagcagagggtgggccggcaggggacttactctgaccccgccccccagggactggtgcttctcggagctcccactcctcagactccggtggaagtgacgtggacctggatcccactgatggcaagctcttccccagcggtgagtcgagggaggtccccaagagggcgtcccatttagcaatgcacagggggcccggctcttcctgcagccttttcctgtagaggggctactctccctaactcccctcttgcccctccttgaccttccaccaccgtccccacagatggttttcgtgactgcaagaagggggatcccaagcacgggaagcggaaacgaggccggccccgaaagctgagcaaagagtactgggactgtctcgagggcaagaagagcaagcacggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaattgcagagcctggcttggtggtcctggagaggaggaggaaataaggctcccagtgggaggctcatggtaccagagtcctgtccactgactccagtgtcctgtccactgactccagttctctctgcacttggccactgtcctgccctctgggacaccctcaatgtgaggaggcagctggtgggtcttaggtgggctgaggagaaaagcagtcactgcagtacccgcacagagggcactgcggggtctctggagaggcttgctgcatgctgtggccaagtcagcagtgcactggggcgggcagggctggctggccttgggtgagaggggacacctggatggcaaactgatggaggctggccttgcagcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtgagctggcggccaggaccctcacgatacagccggacatggggacaggcgctcacactcccaccgccctctttctggctgccacttggcttcttgcaacagggctgagtccttagagtgaggacaacatctgggttggtctacttcatggattaaatgacaacatggagaaagtattagcctggcagacagcagacacagtgcacttgagctagcagcaacatttcttgtatcgcctgtgaggcttgtcctcaggaaggcacctggagagtgggaaagggggcaggagccgtgcccacccagggcctggctttctcctcgttgaagcacttaggttgtttttctctgggcctcagtttcctcctgtgtccaggagtacactagatcatcttaagatcccgtccagccctaaaatcatgtacttactttttttttctttttcttttttaaatagaggcaagggtctctacgttggccaggccggtctcaaactcctggcctcaaatgactctcctgcctcggcctctcaaagtgctgggattacaggtgtgagccagtatgcttggccttttcttttttcttcttcttctttttatttttcgagacagggtctcgctctgtcacccaggctagagtgcagtggcacaatcttggctcgctacaacctctgcctgccgggttcaagtgattcttgtgcctcagcctccaagtagctgggattacaggcacctgccaccatgcccagctaatttttgtatttttagtagagacgggggtttcaccatgttggctaggctggtctcgaactcctgacctcaagtgatccgcccgcctcagcctcccaaagtgctggaattacaggtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaa

SEQ ID NO: 35894 - DNA, 37934 bp, Homo sapiens
cttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatggtgagaagcagccccaggccgtagaggaggaaactggctcgtgcagcttttccttggcgggttgtgtcagtgagggggcttcccatcagacggaagctgccaagcggcagcacaacacttgggtttagggagactcatttctggctgccagtggagggcatagagtagctcgatgacaggttactggcattctttgacagtttgcttttggtttcagaaaaatcctttgcttttcttctcagtgacacagcatttatccctagtgttgtagatgggagtggggcatttgcaaatgtgatgattgtatttaataagtgaaggaagctaaattcgattaacaattggtacatcgtgatacgaactgtttctgtgatttccaaagcctacaacctaatcgctaagagccttttaataatgagccactcccccttttggagtgtgtttttgctgggggtaagtgggcaactacagtgacggttagttgacaaaagcaaaacaaaaacaaaaacgattagatggctttctacatagaaaaagaaagactacacaggttctaaagagtgaaatggtgttcagtggcatttgttttacagcctctgaactgtaagcagaactgtcaagctcccaaggctcgtcctctctcagcaaccccgaagcccccttggctgcaagcactcagcgcccgtaacctctcctgccatgccccagccccaaggtgtccttttgcactccggaccccttggcctttgtcagaaaacgctctgcactgcactgtcccctcttgctgcacaagagtagcggccacagcaatgctcaccaggcttggttgcacacagccccctgccccaggtccaggcctacacacacatacaaaaaaaaaaaaaaaaaaaatgggagtgacttcttaaactttttgattggaagcatcttaaattcagtttttccatttcacctggaaatgtacatgaccaagcctaatatgcatgatacagtttctctgatgtgaggccaagcattggattatttagtgaactgctttgtatggttttggtgaactgactgttaaatccttttggtatctgacagctgtgcagagaattagtctggctgcatttgacaatactgggattgggtgtggtggattttctctgggtctggagttgttcaatggtagtaccagagtaagtcgaggtcagagaaacgtttggtcaaatatctcccagttttatacataagtatatacagttggtcaagtaacttctaattgtatccaagtgtatacacttaaatatgtatgcaagtcatttccatattatactattcaggttgaattttttttttttttttgagatggagtctcactttgttgcccaggctggagtgcagtggtgcgatctcagctcaccaccacctccgcctcctgggttcaagcagttctgcctcagcctccggaatagctgggactacaggcgcgcgccaccatgccccgctaatttttgtatttttagtagagacggggtttcactgtgttggccaggctggtcttgaactcctgacctcaggtgatctgcccatcttggcctcccaaagtgctgggattacaggcgtgagccaccgcgcccgggcgaagatatttttactaggatgtcaaattagctttaaaggaagttttggtgtaggaatgaacaaactagtatctgcagtgtgtgaggcattgtgctaggccatgagaaagccatatgatctttcctatgggagagtgaagcattacctattttctaaaaggtttatgactggatagtagaagaacttatggactgtgttagaactaggatttgtaagctttatagtgggctctccagcattgtcactttgggaaagtcattttgtctccttgaccttagcgtcatccctgtagaataagaggattaaaatattagatctcttctgtttctttcagtactaaaaattgatgattctcattatgatcatttataatagctcactgctgctattaaaagtagttatcaagaggattatttgaattaattatcacttgtcttacatcaattttggatgtctgaaattctccagtcattttctatttcgtttgttaatttagttttaatcatggaagaatagtaggtaaaataaaagatccaaaaagttctcagttctgtaaacattaaaaataaagatagtttctatacatgaaactaaatttttttttttttttttttttgagacagcgtctaaccctgtcacccaggctggagtgcagtggcacgatcttggctcactgcaacctctgcctcctgagttcaagcagttctcctgcctcagcctcctgagtagctgggattacaggcatgcgccaccatgcctggctaatttttgtatttttagtagagacaaggttttgcctggttggccaggctggtctcaaacccctgacctcaggtgatccacccacctcggcctcccaaagtgctaggaattacaggcacgagccacctcaccggctgaaactagattttaacatttcattgtggtttcagccaccccacctcatcccaggggatctgtaccattggtatttgataaaacctagccatctccttttcacattttagatgtcctaattcctcttttccacgttgtctggatcaacactgatgattttttaatttcatgatatttcagagttttttagttttacaaataactttttttttttgatacggagtctcactctgtcacccaggctggagtgcaatggcgaggtctcggctcactgcaacctctgcctcctgggctcaagagattgtcctgcctcagcctcccaagtagctgggattacaggcacgcaccaccacgcctggctaatttttgtatttttagtagagacagggtttcaccatgttcgccaggctggtctcaaactcctgacctcgtgattcacccgccttggcctcccaaagtgctgggattacaggcatgagccactgcccctgaccacaaataactttttattcacctgactgctgttaaaaattagaatttaagattggactctttgtgtaacttaaactgctttaaaatgatttatttttggccccaaataaaataaggcaaaacatttgcacttaccattgtccatcttgtggaatatgtaggcctacacctgtaatctttgaattactagattgttctttggtaaagcaacaataggaaggtctttgtgatttttttaaactggaaatttatatcttaactgttggtgaccagtaaatattgaaagactacttttgtcttcttttaatagtctggtccttagagttattattagactatctaaatgtaattaattgatcagtaattgtaatttcttatctgtggttggataaactgctgtacatttgaatagcacctctaaattggcatcctcggtggatttcgcaaccagaagcatttgctttcactgatggaaacctggcagaatcctgatgccctaactgtcctttctccacctgagcaatagctacagtttttaaaggaatgaataaatagacaaatattgtctgtttagggtttgatatcagaaaatagaatggaaaatctgtatttttgtcttttggcttatgtttaccttaatgtaaaatgatctgatagaattactggacttctgtctattgggttggagattttcctttacaattagtgtgcacaattaccttttttctgggatagcaaaaacttgtaaaggaagtgcaaaggatattcatagttgttttaattaatgggaatattggggtatcactgaagaaaagcatttagtcacagttgatagtgtctaagactgaggtgcttaaagtattagatcatattccattttgaactattataaaatctaccatgatgtgccattttgcttcagtaatttttttaaacttgaagaattaaaaaaaaattttaaattgcaaggctttttagaagatcatattatccatagtgcttctcaatctgtgggcttgagtcatcacgagggaccaccacacatatattccaagcatggtatcctggctgtaccaatgtcccagatacttctttttcaaacatcctgtgattttctagaaaaatgcacttatttaaaagcattattgacttcattgtaacttttttgtccaattgttatttaatctgatgataaaaaatgcatcattcttgtgttcatatttagcattaaatatgtttagcccatgaaatgagtttagcccacatgaaatggttaggaaccaataatctaagccagcctactacagtaggaaagggaagatgtacctacacattttagtaaagggtcgaggactgcataaactgttgttattggtcatcttgtttgaaatgaagtcattctctcccccaaatgatctgttttgagtcatttttaaaaaatcaatcagggacaccaatgacattccctctaagcttagttaacacttttcaatcttaatccttggcagtatttcatattgtgctctaaatgtcataacttttcctgctgcttctgaggtactccattttcctgatttaaaaaaaaaaaaaaaaaaacctgataccagcctcatggattcttagtctccttatcacaatacagaggtcatttcatcttttctgaaacttctctctacctaagcacaccactatgtgattttataacaccctggacttttccattttatagcacttaccacgtggtactagaattgcttattgctgtttcctgctatgctcttgaatctgtgaaggctgagactggctctatcttgttcaccattgtattgccagaacctaatacaggtgcatagcaagtgttgaatgaatgaagtttcattttttgactaataattaagggttcctttgacatccctaagtttatattttatatatgtgtgtgtgtatgtatatataaatttcacaagtggtatatttttcaaattttccagctcttcatttttgttctaccagttaatgctggattccgtggaaatcttttttcctttctctttttttttttttttttgagttggagtcgcgctctgtcacccaggctggagtgcagtggtgcaatctctgctcaccgcaacatccgcctcctgggttcaagtgattctcctccctcagcctcctgagtagctcgccaccatgcctggtgaattttttgtttgtttgttttgggtttttttgtttgttttttgagatggagtctcactctgttgcccaggctggagtgtagtggcgcaatctcggcttactgcaacctctgcctcccgggttcaaccgattctcctgcctcagcctcccgagtagctgggattacaggcgagtgccaccacaccctgctaattttttgtatttttagtagagacagagtttcaccatgttagccaggatggtctcaatctcctgacctcatgctctgcctgcctcggcctcccaaagtgctaggattacaggcgtgagccaccgcgcctggccgtaaatcttaaacctcatttgggcatactttttgtaaatcagttgattatgcatgacctacaatcataatcctgcagaagcagtcattataaaagtatattcttcctaggtaaagagttattatgatttagtaggtggggttggttgtcatttttaaaatttccagacgtgaaatgggaaaggacttttttattatcttaggttttattccttattaggtttgaatccttattatcttaggtattattatcctaggtttgattcatatgaaagtaacaattggttggccaggtacagtggctcacacctgtaatcccagcgctttgggaagctgaggcaggtggatcacctgagggcaggagttcaagactggcctggccaacatggtgaaaccccatctctacaaaaatacaaaaattagccgggcatgatggtgggtttctgtaatcccagctactcaggagactgaggggagaggatcacttgaacccgggaggtggaggttgcaatgagctgagatcctgccattgcactccagcctgggtgacagagcaaaactctgtctcaaaaaaagaaagaaagtaagtaagtaacaattggtcaataagtattgaaacattgtttctcatacagtaagtgttccagagttatttaggttgcagtgagtggacatcgtgcccccctgggcgacagagcaaaactctatctcaaaaaaaaaaaaagaaaaagtaacagttggtcaataagtattgaaacattgtttctcatacagtaagtgttccagagttatttgctacttctataaagctgtgattcaagtataatatatgctttttgagtttgagaaatttaaaacaataaaaccattttaagagaaacatcaaaccatctcaggtatattttaactgggtataagtgtgtcatcatggtgacaaattaatacccattttattttctcacacgcagattaatgtacctaattctagctcattttcttttacagtgactatacgtgatcatcaggttaatattttataaatgctgagaatttataatagttttcttattgccagatgtatatcattgacagctttttgcaatgtagtcatgtaatcgtgttgcaggacttgtttttagaggctggtgcatttctgatctcctgaggttctatatgtgggctaatccttttagggttatttttccttcctggagtactttcctgtcttttgttagtcatttttatttcagagcggattctcatgagtagccttcactgactatcctaagcaaaacctgattttcttactttgtattccactagatttacctggattgtaccttaatattgtagctttcatttcaaaatgtaacctgttttctagagtagatttcatgtcattaagagctgaggggtatgttcctaggttctgcctcgtttgacaagtctcagtacactgaagagagaaaagatatatttattattttttatttcaatatcttttgtggtacaagtggtttttggtcacatggatgaattgtatagtggtaaagtctgagattttagtgcactcatcacccaagtgtacattgtacccaatatgtagtttttttttaatcacttacatgctctgccacccccctcctctgagtctccatagtccgttatgtcactctgtatgcttttgtgtacctgcagtttagctcccacttataagtgagaacatatggtatttggtttcccatttctgagttacttcacttaggatattggcctccaaatccatctaagttgctgcaagacattatttcatgtttgttttttaatggccgagtagtattccatgggtatatatactacacttttatcagtgggcacttaggttggttccctatctttttttttttttttttgagacagagtttcactcttgttgcccaggctggagtgcaatggcacaatctcggcttactgcagcctctgctgcccgggttcaagcgattctcctgcctcagcctcccgactagctgggattacaagcatgcgccaccatgcccagctaattttgtgtttttagtagagatggggtttctccatgttggccaggctggtcttgaactcctgacctcaggtgacccacccacctctgcctcccaaagtgctgggattacaggcatgagccaccgtgcctggccagttccatatctttgcaatggtgaattgtgctgcaataaacatacacatgcaggtgtctttttgatataatgacttcttttcctttgggtagatacccagtagtagaattgctgaatcaaatggtagacctactctagttctttttatgtctattctagttctttaagaaatctccaggctgggcacagtaacttatgcctgtaatcccaacactttgggaggctgaggtgtgtggatcacctgagatcaggagttcaagacaagcctggccaacattgtgaaaccctatgtctctactaaaaatacaaaaattagcttggcatggtggcgtgcacttgtaatcccagctactcaggaggctgaggcagaagaatcacttgaacccagaagacaggttgcagtgagccgaggtcacaccactgcactccagcctgggtgacagagcaagactctgtctcaaaaaagaaaagaaagaaatcttccatactgtttgaaaagatatgtttcccaatgttttctttggtgtattacctgaagtatttactttagatcatgtgtctcacttgaataatattggatttatgtgtgtgtgtatatgcagttgctactctttggactaataattttctgcttgttggctcaaaaatttaccaaccacctaatatatagtcatgcatcacttaacagtagagatgcgttccaataagtgcatcattagtggatttcatcaagtatactgacacaaacctagatagtacagtctcctacgcacctatgctatatggcataacctattgatcctaggctacaaacctgtactgcattttattgtgctgaatactgtgggcaactgtaacacagtggtaaatatttgggtacctaaacatagaaaagatccagtaaaaatacagtataaaagataaaaaatggtacacctgtttagagcacttaacatggagcttgtcagactggaagctgctctgggtcagtgggtgagtgaaagtaaaggcctaggacattactgaatgctactgtagtatactgtttaaacactataccccttaggctacactaaatttataacatacttttcttcgataattaaccttagcttactgtatgtaactttttaactttatgaacttttaaatttttttaactttttttagtaacatttagcttaacgtacagctacttggaaggctaaggtgggaggattgcttaatctcaggaattcgataccagcctggacaaatagggagactttgtctcttaaaaaataagtaacacttagcttaaaacacaagcacattgtacagcttcacaaaaatattttctttatatccctactctataagctttgtcttattaaaaaaatttttttttttaaacttttaaacttctttgttaaaaactaagacacagatacattagcctaggcctacacaaggtcagaatcatcagtatccctgtcctcctctacatcttgtcccactggaagatcttcaagggcattaacatgcatggatctgtcatctcttatgataagaagccttcttctagagtagctcttgccttcaagacctgccttgaggctattttatagttaactttaaaaaaaagtaggagtatactaacataacaaaaagtatagtatatgtatagtaaacacataaaccagtaacacagttgtttattgtcattctcaagtatatgtactatacattattgtatttgctatacttttttttttgagacggagtcttactctgttgcccaggatggagtgcagcggtgccatctcggctcactgcaagcgccgcctcccaggttcacaccattctcctgcctcagcctcctgagtagctgggactacaggcgcccaccaccacacctggctaattttttttgtatttttagtagagacggggtttcaccgtgttagccaggatggtcttgatctcctgacctcatgatccacccgcctcagcctcccaaagtgctggaattacaagcgtgagccgccgcactcagcctgttttttgtttttgtttttgtttcttttgggatgcagtctccctctgtttcccaggctggagtgcagtggcgcaatcttggctcactacaacctctgcctcccaggttcgcgtgattctcctgactcagccttctgagtagctgggattacaggcgctcgccaccacacctggctaattgttttgtatttttagtggacatggggtttcaccgtgttggtcaggctggtttcaaactcctgatctcaaatgatctactgccttggcctcccaaagtgctgggattacaggcatgagccactgcacccggccccaatatatgctatacttttatacatctaacagcatagtaggtttgtttataccggcagcaccacagatacatgagtagtgcattacaatggctgtgacatcactaggcaataggaatttttcagctccatgataatcttatgggaccaccattgtatattcagtctgttattgactaaaacattgttatgtggtgtataactgtacattttcataatgggattttagtgtttctatcagtaatagttcttttgcgagattgacggttgtttgtttcctacactagtctacagtatggtccttcaggataaagactacactgttggttattgtatagtagaatcatatcaactaaaataaattcaattatacttgcttggcaaaaagaaaaagatgtaattatcctgatgattctgtttgtctttaactttaatgaccttttgtcttggagccagtggtgcatgagacaatgatacttgagtttgtttcctttgtttctttttttttagatggagtcacactctgtctcccaggctggagtgcagtggtgtgatctcggctcactgcaacctccgcctcctgagttcaggtgattcttctgccttagcctcctgagtagctgggactacaggtgcctgccaccatcctggctaatttttctatttttgtagagacagggtttcaccacgttggccaggctggtctcgaactcctgacctgaggtaatccacccgcctcagcctcccaaagtgctgggattacaggcgtgagccactgcacccagccaattgagtttattttaaacctttattagataaatgaagattcatgattattgtgccttttttacagattgaaccttttatcagtaaaactatctggacatcatgtgatgcttttgaatggtattttgtctatattaccttaatttttattttttagtattcaccttccacaactttttacattccttttttaaaaaaaaattgtttggccttagtatgtcatttggttttacatcatgccttataggcagcaggtagttagttttggttttaaacaatttgaaagtctttcaatgcagggctctaaactactcacatttatttttactatttacatgtttagcaattactgccatatttactctgcttttttgtttcttatttttccttcctttctgctttttgttgtattggtcatttccctatttgggggtttatttttagtggtaaggaagctgtacatttctatttctgttcttgtgttcaacctcaaatgctagtttagctaggtataagactttagttacaaaataatcttgctttagaactttgaaattgttacttaattggtttttagtaccaaatgttggtgacagtctggcactggattgtttttctttttaaatactttcaggatttttgttgtgaaatttcaccatgatgtgtctaaaaatgcatgtcatttttcttcaactccgagaatttctccaattccttagattttttttttctatgcctttccttttagaactccacataggcaaatgatggaacttctggatttatacttcatgtcatttaatttctccaaacttcccacctccctgtcctctgtttccatggcattctgtcaggtttcccccattctctacttgttaatttgctcctcagctcgcttctttaatatacagccaatctgctgaattaattgtaataatcttttttcatttttaagatttctaattagtgctctttaaaagcaacctcttttaatgatgggaagatagcctctcatttttttgaaactaaattttttgtttgcttggtatatcctgctttctcagatactacttttatatttgagttgggggcctctttttttatgggttgtttttcccttttgttagcaattctcgattgtgtggtctcttaaaaaacagaggcaaggtatggtatgccctgtcactgtcatttgtctcttttaagagagtctggtctcaatgtctcaatatgttgtccaggctaatctcaaactcctgggctcaagcagttctgcctcagcatcccaagtatctgaaacgataggtgtgtgccatggtacctggccacttgtctctcatatagaagatcctcactcctgaatgacacagccctactctaatgtgatttctgcttcctccagtggagtgggaggattgttgaggttgtctcaaatgcaagttttctagcaatcaccctgacgattgccccccagagcccacaactacataagggattcctagttttgctttattgtgggtgttttgtgggtgtttctctgtcagtcctgtagcagtctctgttagtcctggcacatattcatagtcctgaaacatatgtatccttgaaattaaatttatgtctcaaagcttttggaacataattaagtctactgacaaatggaagattttaagttcatctattaatttatatgtgcttgtcttggttcctttcatcctcccacatcagttttaaaatatacattctggttgacactagctagcttaaagtagctatataatattctgatcttagatacttagagcttcctagaaatcctttgcgcactttaaatcctttaaaaactttaaagtactgcagcctttttgaaaaagtctgagtgtttttgaaattaaaaacatataagactccagcctgggcaacatggcaaaaccccatctctactaaaaattaaaaaattagccagatgtggtagtgcacgctggtagccctagctactcgggaggctgaggcaggagaatcacttgaacctaggaggtggaggttgcagcaagccaagattgtgccactgcactccagcctgggcgacagaccctgtctcaagaaaaaaaaaaaaagtatatacgtgtgtgtgtgtgtgtgtgtgtgtgtgtgtgtgtgtctgtgtctgtgtctgtgtcttttagctggacgtggtggtgtgcacctgtaatcccatctgcctagaacatggaggtagggggattgcttgagcttgagagtagcctgggcagcatagcaagacacctctcatgcttttttgggggggcaggcggagacagagtcccaatctctcaccaaggctggagtacagtgctatgatctcggctcactgtagcctccacctcctagattcaagcaattctcatgcctcagccacccgggtagtcgggactgcaggcgtgtgccaccatacccagctattttttgtatttttaatagagacggggttccgacacgttgcccaggctggtctcaaactcctggcctcaagtgatccacccgcctcagcctcccaaagtgttgagattataggcatgagctgccatgcctggccaagatatgctttttgactcaacaatcctactagttagaatctattccatgaagatatttgtatgaagcaacttacattgtaaacagccattctgtcttcctgtttttatcaatttattgtttaattactgtggtctgagtctgtgaatgttgattagtgtttgataattgtttcctctcatttcagaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttggtatgtactctaggttgtttcttctgttccttttctttctctttatttgcttaaagtttcagttaaagctactcaaataaacctaatacattttttgaagttgtttcaaaattatgggatgttgttcttatttccattaattgcaaaactttttaaagaacaaattctatagttttgctgactacagatatactccaaagttaagtatatttcacattttataaaattagatagtatagaaagtttctggtgaccctattctcctcaacagtttgaggctatttctttaactttttgatatttatatgagcttttgtaatatattgcagatattaactctttgtattaggaatacttttttattctaggacttttaatactcaacctatcaagtttaaactgatttctattgaacagtactttctttagtgtgactttttttaaatactttcaattacagcaaaaatggaaagaagtggcacaagactgtacaaaagctgttgaacttaatcccaaatatgtgaaagctctctttagacgtgcaaaagcccatgagaagctagacaataagaaggaatgtttagaaggtgagggtaattttgtgtttacatatgaaaattacttaatattttgtagtcattggtaaatgtatatgaaactgccttgtgagtgcaagaatcagttgtttttaaaagttggattcctttgcacttaagattgtgtcttctagtttaaagtaagattgctgatacttaagtattgtctctgttctcaactatggaattaaatgactattaagattaggagtttatgtactacacattttaaacttagcagctaatgagcattagtataattctctgaataaggaaatcagaaaagaagttttagcaagtgatagtgtttctaaggttctacatatttcatttaatatgtataaatatagctttgagagctgtgtttataatatgtataaacatagctttgagatgaatcattaaagaaaacattgttttgtgcccttggtattttcaaacattattttatacccaattggaaattattgttttatacctaatttacacctaattggaaatgatgtaattggtacaaagcatcaaagtgaatttgtcattctcattaaatgccataaatattctgtggtctctgattggccatttctctgcttccaaagctgcaattaacagtatacatccagcctttaaagtacattcttctaggtgacatgaagcaaaaccaaagtataattttctacaatctaaaagttctttccacttaatatatttgtctgctttaaaagcatcagtaaaaggaaaaggcccctttctgaaaagaaaagtgtagattaccaaatgagggtattttagagaacattttagcaaaatttgaggttttgtggtggcacatactttggtagtgtgtgaaaagactgttgttttagaaaagggaatcctgagttttgaaccagaccttgaagttactaacacaataactggcagagaggaggttgatcgaagtgtcacgtagaagaaacaggatgggaaaaaagacattgacattggcgctagccgtggttatcaggggaatatatcagcagattgacttgattggtggagcaaggatgtggaattgcaagaaatttaattcgggaagagacgagacgtccattgtttgagtgctttgaacgaaaggctgagaggttaaggaaccacttactttttaatttcaaaccactgcatgcatcttgagctgtgacataaccagatgaaaatggtattgaggcagatttatttgagagctctgtggcaagatggctttggagacagggaataactctgaggcctataaacaaacaccagacatgagagagccacactatgtttatatgccttagagttgctagccagaagagaatgttagagtggtgagaaacatcagaaatcatgcagcatagcccctttcatttcacagttaaggaaagcaaaccccagagaagtggagtgactttctgagctttcagtttggtcatagagaatataaaattaggtattaagaatcagttaattggaaatgaaacagtcccatttggccatgaatttagtttggctttctgtagttacattgtacccatttgatgctgctgaccatctttgcaataattttatatttacccttgtgtttttcatcatttctagatgtcactgctgtgtgtatattagaagggttccaaaatcaacaaagcatgctgttagccgataaagttcttaaactccttggaaaagagaaagccaaagaaaaatataaggtaaattgatctgatttggggaatgggggagtactgtgtacattgtgaagggtattttctaatttatgctgcttaagcttaggcatagtggtaatggcaacaactgcaattagaactgggttatatttcttcttcctgttatctttggcttttatggcttgtccttcttcagtaagaatatatgctctgtccattactctacctggagaatattggaattcatctgtgttagggattgccacactgtggcccataggccaaatccagtctgctacctgtttttataaataatgttcagtcacatgttgttttcagctgcctttgagatacaacagcggagttgagtggttgtgacaaactgtatagactccaaagcctaaaatatttactatctggcctttcacagaaaaatatttttctatattattaaagtttttaaaggtatactgagtaagttggcattagttttaggctattattaacaggtagtttaattcaacaatcatttattaaacaaagctacatgtttggcattttggagggatgggttcaaagacatggcccttacccttatagaattaaaatttagtgagagagactgactgttactgtgtataaaaggcatgcagtagttaagtgcccaaggtgagatgtaagtaaagagagtaccataggcatcactaaacatcactggagattcactgttaaatcccagtaatagcgagataattgttcctttttcctttaataataacttgcttttttcttgaattgattttagtaatctgtatttttaattttatatctctggatattagctgagtgaaacagttacaacaagtttcttcactgctggactttaataatctactaaggtgtgttgtgaatctctaagaggggtatagctgtagtggctgtagtggttcccagtctctctctctgttttttttttttttgtttgtttttttctttctttgtcacccaggctggactgcagttgctatcttggctcactgcaacctctgcctcccaggttcaagcaattctcgttcctcagtctcccaagtagctgggactacaggcatgcaccactatgcctggctaatttttttgtactttagtagaggcagggtttcaccatgttacccaggctggtctcgaactcctgagctcaagccgtccaacttcctcagcctcccaaagtgctagaattacaggcatgagccactgtgcctggccccattctctttaaaccatggatttttttttctctcgagcatctcgtaagactagtgtttctcaaaatcactttgtaaaacaccatggtagagtccataaattgaacctcaaaggaacctagtttccttgtacatagtgtggagtaattagactggttggattgcaagatggtaagaaaatataaaataatgtatatttacataggttacagatcagtttccacattttctaatctgtttgtcactttgtaaatcacaaaataccttccatattattattttgatttttttataacaactgtataagataaataaggcaaatatttctattgccattttagagatgagaacactgatactagacgtttaatgacatgcataatatcacatagctaataagtggcagaactagaatttgtatcctgttcctttgatacttaaatccctttcttgtaaccgtttattttcactttaaatttataaccctgtatggaaggcagggaggtgatagcttcatttctaagctgaaacaggaaactaaaaaacattaatgatttatctagcttcaggtaagtggtatttaaatttctatttaagcttttcccctaaaatggtaaatgattgccactatgtatttattctcagtgtctttagtaaagtactaaagttaggcatatttatcacttgataggtgaccatttgacttaaaatatttgttatcctaaattaaaacgaattgaatctctccccagagagtgcccacagatcaatatgggttttctcttaggtttcctttttagttctctttctatcccacttttatctatcctagattaaataatttacttataaagccaattcctttttttattccttcaaatatgaagacattaccaaaataacagtaatgatatttgttatacataaaatgaaaaatcgcatgtttccattaaactctttgggctgaattttatagataaagcattcaaaatacattatgagagccttttgggtgtgttatttccactttatttaaaacttatttatttaaaacggtaattgtgtttcgggaggaacaaaatactcccataattgtgaattgggtggctatgcctcaaataaataatcaaaacaggaaatgtgatttcagtatggttttcagtggcacttacctgtaataaagatcttcagatgaaagcccaaggtaaatggacttaacattttcagcacctgtgtaagatgtggtcttacatctttgtagagggaaaaggctctcatttaaaaccagctttaaacagctgggactggcagcttcaccttttccactgtcttttgttctgtggcttggagcttaattttagttatttgaaaatgagaatccaatttttatgacagttattcttagcgttctacaatgtacctgcttctttggttggtatttcccatcctgatgtctttaaacatgactaaatttcagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaagtaagtatgtcaagcatagtgtctacttagtggtgttttgggtgctttgaactttccttagggcccatatgggttctgagccatctcacaacagcagctatctatctacagatagagatagacagaaatataattaaaaattatataatattattattataaaaacacttttctttctagcatgtatctgttacttctctggtaactcagggttttactgccaggagtctaccctgcttttactcaaggtcctatatgatcttctcaaaaggactccgattgaatccagtggctgaccgtgtttgaatagaggcaataacttgaaaattattgtgtagctcaacatgcagatgttctagtgcagggaagtttttaatttataaacagatacttttaggggtgcccaaagagtgaattttttcaaggatttttctgcttgtctaggaagatgcccatttggagggcttcttgttggagcctgtagagagctgaaaccaaagtacaggatactgtgtttctagctggagacctaatgatataatgtcgtataaaccatctagcctgctttattccattcgtatttatcaatacttgtatttttctgtcaagggtagccctctctgagagaaggtacaatattattatcaacatgatttttttaacgagttaggaagaaaaggaaatactgttctagtagctgtgcataactgggttttgcatcttcagcatattggagggtttgaagaaacaaatggcttttgatttttatcttccaatttttctaccattgctattgaccttttaagagaagatactgtgcataattatactgcagtgtacaaattttagttcattgatacacaatctttgagaagattgtagttgggaattaaatgtttaagatgtcgtattagctcttgtgacagttatgcaaatactttcttcttctggttaagaaatagtccttgtcccagaaaaactataatgaatttaataccattattctaaaagctttactgagagatggtaggacgtagctagctatcatcagcacactaactggaattggacccaagttttaaattccattttactctgagccttagctttatcatcctttaaatggagctagtaatatttaccttacaaggttattgtgaggtgtagaaatcatgcttataaataactagcacttatgttcttcagtaagtgggattacttctaatctgatttaatcattgtttgtgttttcgttttctcttttttttttgataatgaggtatctttcgcctaggctagagtgcagtggtggtgcagtcttggctcactgcaacctctgcctactgggatcaagcaattctcccacctcagcttccctagtagctgggattacaggctcatgccacgacgccagctaatttttgtattttgagtagagacggagtttcaccatgttggccaggctggtctcgaactcccgacctcaggtgatccacccacctcggccttccaaagtgttggaattacaggtgtgagccactgcacctggcctgtttgtgttttcttagcctggtgacctgagaaacaaaactagaatgtaggcaacattggaatgtcattacaggagaggttagcatagagcttataagatttttggctgacataactttttaaatttttttaagagacagggtcaggtcagacatggtggctcatgcctgtaatcccaacactttgagaggctgaggtgggcagattgcttgagcccaggagtttgagactagcctgggcaacatggagaaaccctgtctctacagaagaataacaaaaattagcttggcatggtggtgtccacctgtagtctcagcaactggggaggctgaggtgggaggattgcttgagtcccagaggcagaggttgaagtgagccaagatcatgccactgcactccagcctggggaacagagcaagactctgtctcaaaaaacaaaagggagagagagggggtcactcaggctggagtagagtgttgcgatcatagctcactacagcctccaactcctggaatcaagctatcctctcgcctcaatgtcttgcgtagctgggactctaagtgcacaccaccatgcctggctaattttttttgtttttaattatggagacagggtcttgccatgtttccccggctggtcttgaactcctgggcccaggtgatcctcccacgttagccttccatactactgggattacaggcatgagccaccatgtctggcctgacgtaacttttaagtcatttgccagttttctttatacagatataacaactgaaataagaaaatgtactttaatttacaatgccttatgtttggaagatacctcatgtacctcatgacacctaatacaaatttcagttaaaaaaaattacttctacaagcatctccataaaagtcatcatcttagaagaataataagagatactgtgctcactgctttttaaaacatacagaagggtgttttttaaagtattaattgatggaagagtcttcctttaaatttgcttctttagtaagttcagttatttatttatttatttatttatttatttatttgagacggagtctcgctctgtcgcccaagctggagtgtagtggcgcgatctcagctcactgcaagctccgcctcccgggttcatgccattctcctgcctcagcctcccgagtagctgggactataggcacccgccaccacgcctgactaatttttttgtatttttattagagatggggtttcaccatgtttgccaggatggtctcgatctcctgacctcgtgatccgcccacctctgcctcccaaagtgctgggattacaggcgtgagccaccgcatccagccaataagttcagttattaattctaggtctgctcacaccccttgccttagcttctgtgactctaaagtcacttatttcctatttccctgttccttcttttagccattaaacaactgttgagtaccattgatgtgcctcagatatgaaggtgaataagacaggatccttacctatgttgcagatcagtctctctttcgttagctcatcttttcagtatctaaatgtctaagctgaggtattacccaggactctgctgcttcctttttaaaactcctcctccaaggtttcaagaaaatccccgtctacatcaaaaatcctaatctgtttaaccgcaccgcccctccccaccccaaccccatgccacactggctgattatcttgttaagtggaaatagacaattgcttaattaactcaggtgtgccaaatgtggcatgttttaacattgaattctttcttttcttttctttctttctttttttttttgagatggagtcttgctctgtctcccaggctggaatgcagtggcaccatctcggctcactgcaacctccacctcccgggttcaagcgattctcctgcctcagcctcctaagtatctgggatacaggcatgcgcctccacgcccggctaatttttgtatttttagtagagacgggtttcaccatgttggccaggctggtctcgaatgcctgacctcgtgatccgcccacctcggcctcccaaagtgctgggattacaggcgtgagccaccacacccagccacatttaattttttcttagtaaataatttcctatgtttgtttttattttcagttctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaaggtacattaaaaaatgtgtgtgaagaaattattaaatagaaggcgatgcctttcattatgttttgccagattttttaaagcatttcaactgccattcttcaaagggctgtttttgtttttgaagaaactactcttaataataatgtagttggtgcagtgaatctgaaaacataaatatcaatgatatttatctttatttaggaaaggaaatttttttttcctatagcatccggtagtttcatcgtctccctgtagccactgcctaccatattggactgtatttgggcagtggtaaaggtgatatgcaattctgtagataatgctgtcagtaacgtgtaatatgtagcaccaggttataaaacacttaataaaaacacattaatatattcagaaaggttctaaaaatagaatgtataaatatgccaaaagtcttgcagttgtacagttggaacagcctttcattttctaagtattcttaatgtgctatgtattacacatttcataattaagattcaggggcatctgttgaattgttacattctattcagtgtaacaaaacaatttaaccaccaattaactatattacttattagtttgttaacatctctgtgacctgtttcctcattgcattaaatgaactctgtagcctctctcctctcctatatttgggggggatataaaagttgttttaagacctaaatattgttaaaagtttctttcaaaatgagattttcaaattgaagataccctcataatattatctttaatattattttctgctgattttcctgatgattacaactgatatatgttatatgtttttgttataattgtggaggatgttattatttgttctatatgtatgtagtattgctttgaacaaaattttaaagaaacgcattgttttcatgatcacatgacttttagtggcaagtagtaatgatgcctaccatatgccatgcacaaaaattaactcaaaatggattagagccctaaatgtaagagctaaaactataaaactgttaggataaaatagaggactaaatgtttgttaccttagataagcagcagtttcttagatatggcaccaaaagcacaagcaaccaaaaaaaaaaaatagattggacgtgatcagacttctgtgcttggctggggtggtggctcatgcctgaaaattagccgggcatgatggcatgtgcatgtagtcatagctactcaggaggctgagatgggaggatcacctgtacctgggaggtcaagtctgcggtgagccgtgacttgtgccactgtactccagcctgggtgacagagatcctgtctcaaaaaaaaaaaaaaacttctgtgtgaaaagacaccatcaagaaggagaaaacacatcacacaacatgggaaaaatattcacaaatcatatatctgattaggagcttgtatccagaataaagaactcttagagctcaacaataaaaagacaacctaagttaaaaatgggcaaaggatctgaatacacatttctccaaagaatatacaaatgaccaataataaatgacaagattgttggcatcattagccattagggaaatgcaaaccaaaaccaccatgagatgccacttcacacctactaggatggctataatcaaaaagacaataaggctctaataaaaaacattggacaataataagtgtttttgaagatgtggaaaattggaaccctcatacattgctggtggaaatatattaatacaatggtgaagcccttttggaaattagtttggcaattcctcagaaacttaccatatgatctagtaattccactcctaggtatatacccaagagaatttaatacgttcgttaacacaaaaacttgtacatgagagctgggtgtggaggctcacacctgtaatcccagcactttggaaacccaggagttctagactaccctgggtaacgtagcaaaatctcatctctatttttaaaaagcttttttaaaaaccttgtatgtgaatgttcatagcagcattatttatggtagccaaaaagtggaagcagctcaaatgtccatcagttgatgaatggataaataaaatgtgatatctgtacaatggaatatttttcaggcataacaaaagaatgaaaaactgatacatgctacaatatggatgaaccttgaaaacattatgctaaatcaaagaagccagacacaaaaggctatatataatgtatgattccacttacatgaaacatccagaatatacaaatccatagaaatagaaaataggttggtgttttctaggggctgaagagtaggaggtgagggggatggagagtgactgcttatttgtatgtggtttcttttaagggtgatgaaaatgttctggaattagatagtggtaatcaacacacaacttagtgaatacactaaaaacaggtgacatgcatactttaaaagggtgacctttgtgatatgtggattatagaaaaaagctgttatttaaagaaactagattggagggaaaaaaaagtaatgatgaacctttcctcacttggggtatatagcttcgagcaaatgctctcatcaaaagaggcagcatgtacatgcaacagcagcagcctttgctgtccactcaagattttaacatggctgctgacatcgatcctcagaatgcagatgtttatcaccaccgaggacaggtaagtctgttttcttacctagaggtctgacttgtggattgagctttgataccatttttgagaatttcttatgtaattttcttgagttttcttatataatttctgatagctgtgaacaaagtatcacagtggtttacagtttgaattggcctttgtttagtctgtcttgaatatttgtctttaattttggtatttacttatgaaaaaagagtaaaggaaggcaaaaactgttggcttaccagttcaagtttgtttttctggtgtttctggttcataggtttcaatgagtaaaacattaataacatttagtaagcaatgtgagttaattctagaatcaacaggatgatttttgtgagcttcttgctataaggaaatagtctggactgtccaaatagtaaaaataaatatatttatcttttgaagttttataacaggcatattagttttttagtagaaatatatagtgaagaaacagtttccaattactgcctcaagtggggaaaacatggctttataatcagcttaacatggcttcttggaatgcattatggtataaagtgtgagctatgcattaataataacagaagagccgaagttctttctaatggagaattttacctaatagggtcatgtgtcctgccagggaagtgcattattaggcgattttgttgtgtggacatcatagagtgtacttctacagacctagatggtatagcctactacacacctaagctgtatgttgtagcctgttgctcctaagctacaaacgtgtatagcatgttactataccaaatattataggcagttataacacaatggtaagtatctgtgtgtctaaaacatatctaaacatagaaaaggtacagtaaaaatgcagtattacaatcttttgggaccactgttgtatatgtggtctgttgattgaaatgtaaatatgcatgactgtatttctttcagaagggtgttaagtgttgagataacctcttaaaattcttgacattttgatctttactggtagtgtctgaagattaatttgaaaggtaattatctgatgtctaacctgctttgatattagaatgtacaggatgtttagttttctagaagaaggggtttcttgcttaatagtgatcagaattgcagggcagaaatggttggcttgtagtcctttctataagttggataccatttttatgttttggaatcttgccttttaaatttcaagatttttaaatcactgtttctagaaagtaattatatattgaattactactacatgctcagcattatgctgaggtgtaataatagagatgagacactgaacatacttaactggactagttgaattacatttatttacgtatttttttcttagctgaaaatactccttgatcaagttgaagaagcagtggcagattttgatgaatgtattaggttaagacctgagtctgctctggcacaagcacagaaatgttttgcattggtaggtactactttcttttgtattttcctaaacatcacttttattttccagcgtcaacaaaaatgagtatctcattgtctacaaagtcgtctttttctttctttcccaaaggataactactgaggaaaaaaggtgctgattgatacctagctcttgtatttctctggacatttgtttgggttcatcttgatagatgtttgtccctgattttatacttccctaaacagaactggtctccctgcttcatcataaatcaatataaagagcaaaaacattttgaggaaacactctgtaaacatgacaccatgtaacttgctctctcacccctgcttcatagaactgtttcttaatattcagaaacacaaagctcaaaaggttgttttttttttttttttaagtaaaaatttttctagtaaaataagatacttccagttagctgtatggctggagtcgtaaaagaattttcagtttaaaggaagaaattatgtcacaaatatatattataaatgaaaatgacaaaaattttactagatttaaaattcatttattgcaaagttcacttcttacaaattagtatgccctcttctacagtattgaacatcttgaaattgtatagtggccatggagtcctagttgtacataacctttggctctctgctgctgagatacctacttggaacccttttggatgctgcagattatgttagcaaatcacctgtttttttggaaatatttatgtaattttgtgtgtttatgttaacattccatgagtttttgagttcttgatttgacaggcctgttttgattttttatagtaccgccaggcatatacgggaaacaactcttcacaaatccaagcagctatgaaaggttttgaagaggtcataaagaaatttccaaggtgtgccgaaggctatgcactatacgcccaggtaaatgttttttcaggttttttaaaaataactgcatacatatgccaaatctcagtatggaaatcagaaaacagtgctatcatggttgcagcttctttggaagcaggtggctttgttcctgattgattctcatggcccctggttggtcccgaatcacctcagaagaggctcctttgttacacaatttggaaatcatggccctaaactcaatatggggaagcttaaggcgagaatttccctcctgtcttcatttggattggttttgcaaaaagtaattaccttaggaaaatttaccgtatgcaattggtggagaaaatatccacggaaaggcttttctttctatctggtcactgcctttttatatggctaggttgttgtaacggtttattttaatttatctttgctttatctaaaattcctgaaactctcttggtttaggattgaagctatggaaagcaggatttaaatctgaatttttttattgtagtctgaaattcttgaaaacttcttagttttaaatcatccatttaaatgaaaatgattagcttcttgtagtgacggtcatacattttcccctcaaataaaagatctctgaatgactcagttttctttcttaaagctgaaaattggttttggtgtctacataaactagccatctcaatactctatatcaggggtacagctgctttgtggcctcttaggaatggggctgcacagcaggtgagccttgggcaagcatcaccacctgagctccacctcctgtcactgtcaaatctgcagcagcattagattctcatgcctgatgatctgaggtggaacagtttcatcccaaaaccatccctcctcctcctacccccatccatgcaaaaattgtcttccacaaaaccaatccgtggtgccaaaagtgctgggaaggtgttggggactgctgctctatgtaatttatttttctttttttttctctttttaattacaaaagacatgttgggtttttccccacagcacagaaataggaaacgataacaaattactatcccctggctgggtgtggtggctcctgcctgcaatcccagcactttgggaggctgaggcaggcggatcacttgagccaggagttttgagactagcctggccagcatggagaaaccccatctctactaaaaatacaaaaattagctgggtgtggtttggcgcacacctgttatcccagcaactcgggaggctgaggtaggagaatcgcttgaacccaggaggcggaggttgcagtgagctgagatcacactaccacactccagcctgggcaagagtgagactccatttccaaaaaaaaaaaaaaaaaaaaaaaataccatcgctggttgacccctctccttaaaccattcttaaggatgcttattttgtttttaatttccttcatggtatctgtaggcaggttataagaacaatttcacaaggattttaagggtttattgagggtggaactatgagaaaattgatttgtgttggatctgttctttagaggtaggtcttatatataactacattaaagtgtacattttaatcctatgaatgggtacacttgagtttatgccttataattagtaacaaaccaggaaatgacagcaacatcctcatcattgtcatggaattcagaagggcttttttggtgcagatttctctaagcatctagaagagcaaaggccaccgaataggaaccactactggggaacaactcctctgcagaactttcccaatagcatatttccctattaccattctgccttcaagataggtttggtttgtatgagctgtcttctcatcagcattagcattattacagtcagtttgcactcaaatttcttttctttggtctgttttctaattttagcttcactatatagtatatgtaactttatatatgcatacagtacgtgtgtgtgtatgtgtatgtgtatatatatatacttagtgtaacttttttggccctcaaagctttggcgtagatgctggccaactcgcaaagttacagcttgagcatagtctgatatccacagaactgtgccttccatttcagccgtgggatttgtcttaaaaagttgattatagctgctgcttttgttttcaaaataagtatttattacattattgttaactatgacaaacaattggggaaaatcctaaatgttaacagaaaattgaattatgtttgcagaattgtggtacactcacttaatggtatattatgcagccattaaaagttacaaatacattaaagttacaaagcaagatacagcactgcctattattaaagggagaattgcatacaaaatgaactcaaccatgtgaaagaaaacaaatagggaagtaaatagagatagaaaaatatatcaggaaggcatccatgctcacaatgatggaagctataaaaatatttctactttctatatctttctgatttttattataaagaagatgtgctggctacatttctttgatatttttaagagcgatttttaaaatatttaagttggcttattttagatatgaaaagactaagagccatacagctaaatataatgactcacatacttcttaaaagtcatcttataaataaccggggttaactgaatatgggctaggtattatagataatattagggaattatttttggagatatattagttgaagcagttatagctgctttttaaaaaatcaataattttaaacaaatagctctgaagacatttaacacatacatcttaacttatacttccaaatgaatattgcccttaagataattccctggccaggtgcggtggctcactcctgtaatcctagaactttgggaggccgaggtgggtggatcacctgaggtcaggagttcgagaccaacctggccaacatggtgaaaccccatctctactaaaaatacaaaaattagccaggcaaggtgttgggcgcctgtagtcccagctactcaggaggctgaggcagggggatcacttgaacccaagaggcggaggttgcagaaaacagagattgcgccactacaccccagcctgggtgacaagaatgaaactctatctcaaaaaaaaaaaaaaaaaaattcccttgggctgtattatgataaattatgaataagtgatgtgactgtacctatgagaatgtgatattagagctgtgactaagaatgggattatctgtattgaacagtttaccagagattatctgctgtggcatataactaaccacttgctgaagaaagaggatagttaagatttcatatttatagcagtgccacctaaaaactccgataattaagatgtaaaatgtaaatcagtctgtatccccaaaacgtgataattttgtaataatgaatgaagtaaatttttataatgaataataagtatacttttaactgcttaggttgacggttaccttaatataactgaagtatctcctcacataggcattaacagatcaacaacagtttggtaaagctgatgaaatgtatgataaatgtattgatttggaaccagataatgctacaacatatgttcataaagggtatgtatttttgtgattgttccaatgagataataaatttcttgcatagtaataaaatgtatttattttggccactgaggaaggggactgtggtagagaagttaattgacaaacttcttaatgctcctagatgtcttttcattcttacagaaattagttaaggaggccaggcgcagtggcttacacgtaatcctagtactttgggaggccgaggcaggcagatcatctgaggttgggagttcgaaaccctcctgaccaacatggtgaaacccggtgtctactaaaactacaaaaaattagccaggtgtggtggcacatgcccgattcccagctactcagcaggctaaggagtgagaatcacttgaacctgggaggcagaggttgcagtgagccaagattgcaccactgctctccagcctgggcggcagagtgaggctctgtcccaaaaaaaacaaaaagaaagaaattaatgtactattcttgctctgtgttaagggttttaatttcaaactgaacatcctgtcagctgttggcttatatccaaatacgaagcatacacaagtgttcgtgtccttgcgtacttgaattatcctaagaaacttcacttaaatttatataaagtgaaaaataagggatgcaagattggtaatagagcctagaccattgaacactttttgtaataaggaacttagactagcaaaccaatataagctgagaaaaaaaacacaatttgatgctgattatatattgccttataagttataagttaacttataagttcattgaaggcagaaattgagtcatattaatgtgtgtgtattcctactgatactgggccatggtcacatctgacatttttttgcatttgcagtttacttcaacttcagtggaagcaagatctggatagaggtttggaacttatcagcaaggctattgaaattgacaataaatgtgattttgcctatgaaaccatgggaactattgaagtacaaaggtaacttctggagtctgttaggaaatatatggtagctccatagatatttagctttttgttcttattacgtacatgttaaagtctgttatgttctttcctcttttcacctgtattattcacgttggaaaaaaaaatgtgctaaggcagtgacataaggattggtagccaagttgccagaaaatctggaccctcctccaaagaagcatccagccaaatggctgggcaagttgcaacatcaactcagagcccctgaattttctttaaaatcagagttggataagaacattttttgcagctctgtccttaacctcttattttgtgtaagtgtttatccagagttgctcttaagatccaccattaaaaggtgacagctgttttatatatgggatttattgtataccatcttaatactggtattgccattcatttgagtttcctactttaggccaagtattaaactttagatgtttcctaagtactatttcaattaatcttcatccccatctttataaaggtggagattatatgatccctaatttaactgatgcccagagggcttaggtttacaaggttgcacagtaagccaatagagaagacagggtttgagctcatatatcactgataccacagtcactgatcttggcattatcacttgtcaggaagcagcatgagttttcttaattccctatcattcagcccctcctgtagtcctctccctgctctacagtaggcagaatatatataggctggtaaaaaaaaaattgtgtttcttttaaccattctgtacccacagtggcatgtaaatattaagtttttttttcttctttttatgagacagagtctccagcccaggctggagtacagtggcacaatcttgactctgcaacctctgcctcccaggttcaagtgattcttgtacctcagccacccaagtagctgggactacaggcatgcaccaccatgcccagctaactttttgtatttgtagcagagatgggcttttgccatgttggccaggatggtctcaaactctcggcctcaagtgatttgcccatctcagcctcctgaagtgctgggattacaggtgtgagccactgcacccagcctaaattatttcttaattgctaatttgttaatgtgaataaaatattcttgtactagaataggatagggtggtagttcttaatcttttttgagcgaagctgtggattcttcttagaataatgcacacaaaaacactttgcttttaattcaaggctttcatagatcctgggttaactaaagacctctgatagggtttgatggaattttgttcacgttaattgaactttgaaaaaatccattctgaaccttacaattaaataagtgaatttgaataaatgaaattgcagattatcctaggattttgcagatctgctagctgttggcctaatgccagaacatgaactcttgaaaaaagttttttttaaaaataagcctatcacgttgccatatattataatgggggattaaatatagtcaccctagtggtacctcttactggcatataaagtctaactggcacatatgccaataaaatgtaccttactaacatgtatgccagttagactctgtatatgcaggtatatatatatatagtagggacttaatattctttgtaggattgcatatatatgtagctaatactagttacttaaaacagttggttcttagatagctgtggatttgaccagaatcaggcagaggcaataaatctgagtatttattgagtaggtgtgaggaactcacatagactgcctgaagagtagagatgcatggggttggggatgtgctggtaagagatgaaacagaaagaggtgggcccacatcagtctgtgaaggtaaggcccttgcatgtcattagtgtcccggtattatgtcactgctttctaaaggagtctcatgttaacagtagaaacatgtaaaatttaggaaccagacggaattgtgattttaaataagccaatcaatttccctagtctgactgttcttatcagtaaacacagaatacaagggatataatgtaagcacatagtatttgtaatagtagttgacattcattgagtgctttcaatgtggtaggtactcttgtttattttaaaagaagcattttactagaatcatagtagaaacttagtggtcagacttcatgtagcatcacttacaaccttcattgaatattgtgaagaaacttagtggtcagacttcatgtaccatcacttacaaccttcattgaatattgtgaagtgcttgttgaatctgagacttaaaaattttgttcttttagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 35895 - DNA, 5433 bp, Homo sapiens
ggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcaggtaccgccgctgcccgcaggcgcctgccccctaggctcagcccgggccgcctgctgcccgcctcacgggcctctccacgccgggacccaagcgggctggacctcgtcctgccctggccccctcgccacccctcacaccgcctccctgggctggggctgggactgcgggctggcctcttgggtgggggagtcggagtctgcgccccgctccacgtgtcagccctcaggacacgtcagagcccgaggagaccccgggtcccaccccggcctccacccggcggcccgcctgccgttcctcgccacgtgtcaccatcgctcctcatccctgggacccctaggcgggatggggagaccctcctcacccagggcggcttggggtacgttttccccaccccagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtaccccagtgtcccctggaacagtgccggacgaggggcggccccaggtgtgctccgggctcttcccagatgctgcctgcatggttgtcagagaaagtgctagcgaggccaggggcgtcccgcggaggggtgggggccgacactgacgcggcctcggaatcctagggcagccctggaaggaacttccaggaaaggggacaccggcacgaaagcgtttccgagggtagaaaaagatgaggcccgtgggtccgaggggtcagggggtctgcttcaggggcctgggggctcccagtcctgccagggcccctgccttgactgccccctcctcccaggtgctgatcatcgggggcggagatggaggtgtcctgcgggaggtggtgaagcacccctccgtggagtccgtggtccagtgtgagatcgacgaggtgagtgccggcgtagagccaggtttgagtcctggttctcccagcggccagctgtgccctgaaatggctgcacacccccgagcaaggcaggtagggcctgtttctccatctggaaaacacctggtcggggagggttcagtaggaaaaccagatggcagagggcctggcaggtggtgagggcacctgcgtggcgagctcttactaaaactgagctgattttttttttttttttttttttgagacagagtttcgctcttgttgcccaggctggagtgtgatggtgcgatctcggctcactgcaacctccacctcctgggctcaagtagttcttctgcctcagcctccggagtagctgggattacagacatgcgctaccatgcccggctaattttgtatttttagtagagacagggtttctccatgttggtcaggctggtctcggacctggcgaccacaggtgatccgccagcctcgtcctcccaaagtactgggattacaggcgtgagccaccacgcccagccgactaagctgatttttaatctgagccccaggcagggccccaagacagctcaactatttgtacgttaccccttacactcagtagctgctcactaaaatcatgctacgtgccaggtgttgcccgggtatggggacagtggtagacgacagatcagtccctgccctctaggagctgatgtcctagttaaaggagacatcagatggccagacgtggtggctcacacctgtaatcccagcactttgggacgccaaggcgggcagatcacctgaggtcaggagttcaagagcagcctggccaacctggtgaaaccccatttctactaaaaatacaaaaattagccgggcatggtagtgcatgtctgtaaacccagctactagggaggctgaggtggaagaattacttgagcccgggaggcggaagttgcaatgaaccgagatctcgccactgcactccagcctgggtgacagaggaagaatctgtctcaaaaaaaacaaacaacaaaaatagagacatcaaaggatggtctgatgaaggcaagacaggggctgggggacaggagaaggcagggttcctgtgaatgcatggggggtggtcagggcaggcctccaggaggtggcgtttgagctgagacctcagtgaaaagcaggtggccgtgtgcagggagggggaggttctcctggccagaggttggaattgcatccttctaaaataggaaacaggccaagcgctggtggctcacacctgtaatctcagcactctgggaggctgaggcgggcagatcacaaggtctctactaaaaataaaaaaaaaaaaaaaaaaatggcccagcttggtggcgtgcgcctgtaatcccaactactcgggaggctgaggcaggagggtgcagtgagctgagatcgtgccactgcactccagcctgggcagcagagcaagactgtctcgaaaaataaataaaataggaagcgacaagaaagccactcagatggggcgatttggtctggaaggagggggtagggatgggagagaggagcccaagccgccggcaggagccagctctcaaggagaaatggaggtaccagagttctccccgctttacacattataaactgaggttcccaaaaggggccaggtgtggtggctcacagctgtaatcctagcacttttggaggccgaggtgggaggatcgaggagttcgaggcaacatagggagactctatctctaccaaaaatttaaaaagtagccaagtatgattgaacacacttgtcccagctactcaggaggctgatgggggaggatcacctgagccccggaggccgagggtgtagtgagccatgatcgatgccactgcactccagcctgggccacaaagtgagaccctgtctcaaaaaaaaataataaaaaaaagggaaggggttggccaaggcggcttgcctgtgaggcacttggagagtcccacgtggctgtgctggctccaggtcccccagccccttggcccagactggtccctcccatcccctccaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggtaagcagtggatgggccccagggttttctggcagctgcaggtctggaggtcagcctcccccaggccttcagagtaaaggatagagcggcctcccaccccccgaactagagctgtacttttcccttctcatttgttacctgccctctgaaacatggctcaggacagtaggcaggagccaggcgactgcccagattcacaagctggtgaccaaggagagtggggatctggcattgggacactgaggaccctgtgtcctcttcagcctcccctctgctctgaagtggtcagcactggagtgggggcaggttctagtcttgaacgaaggcctaggttagaggttcctctgctgtggtgccaatgagactcccccaagaatgggattcaggtgtggatcccccacagacctgggttcagatcctggctctggccacctggtagctgtgtgggtgacagtggccctggaggtcacagccagactgttcagtgtgtctccctctgtcttccccaggccccgccgaaagtctcttcaaggagtcctattaccagctcatgaagacagccctcaaggaagatggtgtcctctgctgccagggtgagccacaggcctggagcactggggcggggcggggtggggcagggcaggccctgccggatgctgatgcttaggggcccccaggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggtgagatgggggtgtctgggggtgggggttggggggaaggtgggcataaatagagatccctgcccctgccgggcgcggtggctcacacctgtaatcccagcactttgggaggctgaggcgggcagatcacaaggtcaggagatcgagaccatcttggctaacacggtgaaaccccgtctctactaaaaatacaaaaaaattagccaggcatggcagcgcgcgcctgtagtcccagctgctggggaggctgaggcaggagaatggcgtgaacccgggaggcggagcttgcagtgagccgagattgcgccactacattccagcctgggtaacagaggaagattccgactcaaaaaaaaaaaaaaaccctccccaggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaagtgccccccctgatgtgcccctggcccggtccccagagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagc

SEQ ID NO: 35896 - DNA, 20505 bp, Homo sapiens
caccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctactctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggtaggtttcgtgaggctgctgacgcccccacctcgcatcttcttgctttccgccggctggttgtgaagttgcgaggcccgagcccgccggagggttgggagtttccgtgcagcccgagcgctaggcctgggcggccctcggcgcctctcggtcggccgctgctgggaaggtgcgcgcacacagttgcgtgggctggcttgtagggaaggagcctgtccccatcgcgccgttccctctcctgtccccagggaaagacgagctgtcccggtttactgaaggtcacctctgcaactccactcatacagaaggtctttaaggactgtgtgtcgcctcgtctgggaaagcagtttggagatttagctgttggggggagggggtgaatgggagggagcgttgagggttgaggacacaacttggggtcccaggaatgaatttgcaatgttttcctttccattttttctttatttttttagaaaagtcggtgtgtagttagattgcaaatattttgtgctttgtagatgaacctttctcttcttggtacgtggcatctgggaagtgtctgcacactttttaactacccagcccctgattccttaggtcatatttatcttaattcaatttgtgcttctcctttaacttagggagactgggaggctaatcagcatggctgctgtctgccagtggctgagctaattgatttgaatcctggcccaatactttacgctgcctttttctgtaaaagcttgtgatgcttatggaattatggaaaaatggggaaagttgtctacaaaaaccacaacaaaaccatctccagtaaacctttgtgagctagcttctctctttttttttctatgaaattgactgcggtgatatctgtagagcatctactatgtgttagacactgcttacatttattccttaaaactaaacattaagcctttttttttttttttttttggagaccgagtctcgctctgtcgcccaggctggagtgcagtggaatgatctcggctcactgcaagctccgccttccgggttcacgccattctcctgcttcagcctcccgagtagctgggactacaggcgcccgccactgcgcccagctaattttttgtatttttagtagagacggggtttcaccgtggtctcgatctcctgacctcgtgatccgcccgcctctgcctcccaaagtgctgggattacaggcgtgagccaccgcgcccggcctaacattaagccttaatgaaaattatagatagggctgggcgcggcactttgggaggctgcggcgggtggatcacctgaggtcaggagttcgatagcaggctaaccaacatggtgaaactccgtgtctactaaaaaaatgcaaaaaaattagccgggcggggtggcgggcgcctgtaatcccagctacccgggaggctgaggcaggagaatcctttgaacccggggaggttgcagtgagccgagattgtgccattatactctagtctgggcgacaagagcgaaactccgtctcaagaaaaaagaaaagaaaagaaaatgacagatagtagaaagatatctctgtccttagtccggtagagtgcaagtctttttttttttttttttttgagacggagtcttgctctgttgcccatgctggagtgaaatgccgagatctcagctcactgaaacctctacctcccgggttcaggcgattatcctgcctcagcctcccgagtagctgggattacgggcacacgccaccacacccggctcattttttgtatttttagtagagatggggttttgccatgttggccaggctggtcttgaactcctgacctcgtgattcgcccacctcggcctcccaaggtgctgggattacaggcgtgagccaccgcacctggcccagtagagtgcaagtcttaaagcctgagttgtcttcttaggttatggttgtagtgcttcgtggattcttactaaattccagttttacttaatccgataaaagagactttacaagtctgtagcctcacactgctgccgttgtctttaagatctttcccttaatcacttggtctggcataccagctgacagaggaatattcccaaggcgtcctgctgtcttgttgatttacccagtcctcagtgtcttgtattaacttatctttgcctaccaagtgaaggacacacattgagctccacactcaaggccctctgctctatggtaccaacctcttttgccaggtcaccttctttggctcctaatttaaacagttggaattaattgctgttattcaaatgggcatttggtcgtactgcttctttctctcgccttcaaactggaataccctatcttttatatcctcataaaaattctatccttccttcaaggcccatctcatgtcacatcctgattcatctgttagtgctctgatttgaattcctgtagtattttgtatcttaattatagcactcagtatctcatcttgtatgcttatcgtattctagatagctatttcagatgagggcggcaaacactgtgtgtaggggcaatcaaatatttgtcaaattgtcaggacctttcttgtgttgccttaactacactattgttagctataatttggggttgatgaattttaaaacaaaccctgaatgaaatttgtgtcctgccaaacctttaggatatacctgcttatggcttttggatgtacaatttaagccaaaacaggatgggttacattggtgaagtttactttttgcttctgaaataacatctagaatgttagtttgtagaataaacattttctaagaatttttttacattttttacctgtaaatgcaactctttttacaattcttcatttcctttggaaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcaggtatattttatgtatgttttatttatttattttttttccttatattgtttctcacaagcaggtatgtatgttttaagtatgtaattttgtctgagtaaaaggtagtgctacaaatccatgtcagactacgctgtcaccttcctttttgatggttgggaactgtctcattctggttggttgcatataccaaatgataccatgtgtgctgtttgcggtatgtaacgaattgaaagactttgggccaggggcagtggctcaggcctgtaatcagcagtttgggaggccaaggtggaaggatggcttgaggccagtagttccataccacactgggcaacactgtgagactgtctcaatttacatatgtataaagactttgaatgcaacaaaagtattttaacgttaagactgcatagtatgggccaggcgcagtggctcacgcctgtaatcccagcactttgggaggccgaggcgggcggatcacaagctcaggagatcgagaccatcctggctaacatagtgaaaccccgtctctactaaaaatacaaaaattacccaggcttgtagtcccagctacttgggaggctgaggcaggagaatggtgtgaatccgggaggtggagcttgcagtgagccgagatggtgccactgcattccagcctgggcgacagagtgagactctgtctcaaaaaaaaaaaaaaatccatcatactatgtaggtttttttttttttgagacggagtctcgctctgtcgccaggctggagtgcagtggcatgatctcagctcactgcaagctccgcctcccgggttcacaccattctcctgcctcagcctccctagtagcgactgccaccacacccagttaattttttgtatttttagtagagctggggtttcaccgtgttagccaggatgatctcaatctcctgaccttgtgatctgcctgcctcggcttcccacagtgctgggattacaggcgtgagccaccgtgcccggctggtatgatggaatactacgtagccataacaaagagtgagattatgtgctttgcagcaatgtgggtggtgctggagaccattatcctaagcaaactaacatggaacattaaacttaatactgtatgttttcacttacaagtgggagctaaacaatgagaacacatggacacaaagaggggaacaagaagacaccagggccaacttgagggttggggagaagattaaaaaatacctatcgggtccaagtgcggtggctcacgcctgtaatcccagcactttgggaggccgaggcgggcggatcacgaggtcaggagatcgagaccatcctggctaacatgttgaaaccccatctctcctaaaaatacaaaaaaaattagccgggcgtggtggcacgctcccgtagtcccagctacctgggaggctgaggcaggagaatcgcttgaatctgggaggcggaggttgcagtgagctgagttcacaccactgtactccagccgtggtgacagagagagactctgtctcaaaaagaaaaataaaacctattgggtactgtgcttgctacctgggtaactaaattatctgtataccgaactcccataacacatggtttacctatgtagcagtcctatacatgtactaaataaaagttgaaaaacaaaattacatggtttgaaattatttttctctgtggtattaatatatacatatcaaaaagtcaagcctgtcagtggaaatatggaattaagggtgactctttatgtaatacagacatttacaatagaaggtcacttagtatcaaggaataaagttcccttaataacatgtttggagggtttacatatctgtgggatttttttttttagtttctgtatctgactatgatttatttttattaatttttttgagatggagtcttgctctgtcacccaggctggagtgcagtagcgcaatctcggctcattgcaacctccacctcccgggttcaagggattctcctgcctcagcctcctgagttggtgggacagcaggcacctatcaccatgcccggctaatttttgtatttttagtagagacagggttttgccgtgttggccaggttggtctcaaactcctgacctcaggtgatccaccaccttggcctcccaaagggctgggattacaggcatgaaccaccatgcctggctatttcattaatttttttagctgctccttgtggagcaggagtaaatcctaggcagtatgcccagagtgagcctggtcaaacttttttttaaagccacttggccacttacatcttggactactcccattataaaaagtatgcagtatgaaaaggggaaaaaggctgggtgtggtggctgatgcctgtaatcccagcactttgggagactaaggtgggaggattacttaagcccaagagttcaagaccagcctgtgcaacaaaatgagaccgcctctctacaaaaacaaaaagttaaactatggtaataaaattactcatacaggaaatattttagagacctatggagatgattttaaaggaagacacttatgtataaatttaactatattgtatttccttaagtgattgtagaaacattgcaatagaaataatgaattttgtgttgggcctatcctgatttgctatttaatgatcaggaaggagatcataagcttctgtgctaaggtttgcttatcttttctacttggaaggttttagagactaaatccttattggtgtttggatgacttcagtgatggggatttgtgtaaggaatatgacacttgtttcctgctttgttgttggaaaactgcattcttgtgacttacataattgagctaaaagtttgatttctgttttcaattgattttgctcatacacttttagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaaggtatgtgaagtcagattatggctttttgggatcattgcattaggttttatacttttcaaggtagtttttatttgatccttaataatgaagtatttagattgtatgaatgcattcttttataggatgtgaaaataaaacataaagagataaagtttcttttttttgtgggggggatggaatctcactctgtcacccaggctggagtgcagtggtgcgatttcagctcactgcaacctctgcctcctgggttcaagcaattctcctgtctcagcctcccaagtagctgggactacaggcacatgccatgatacccagctaatttttgtatttttattagagatggggttttaccatattggtcaggctggtctcaaactcctgacctcaggtaatccacccgccttggcctcccaaagttctgggattataggcgtgagccagtgtgcctggccaatgaagtatcttacaagctgtgagaaataaagaagttatgcccgcatggtaaatatgcaataaatgtcatttgttattttctctagagaagcgcataaagattaaaatagttattgaattctcagataacccagcaagttgtaatgattttttttaatgggtttgttcctttgttatgtaaatttttcatccctgttgggttttttcttcgtagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttatatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataattaacagcaaaaaaaaaaaaaaaaactggtggggagaattgtatgttttgggtgggcttcttggaccttacctattctggaaatacaagtatgtaggtgttgactgacttttgactgcataataattttcttcctgtcaagcatgtattcagttttgggactggcaaaacagaataaaaattttattagtatgtgaatgatggtgttaattctaaggataaaaaagcctgctagtagcattaaaatctcttggtgtcctaggactgaatatagttgacattacttttgtgatggactatagagggaggcgaaaaacaggggaagcctatgtgcaatttgaagaaccagaaatggccaaccaagccctgttgaaacacagggaagaaattggtaatcggtgagtaaagcagatactaatgatgcagaagtgttacacattaagtcattttgatgaatgtgctgtaatatgactgaaaagttatccaaacatagaaaagtagagagagtagtgtagtgagccatcaaatgcccataatttagattaacaattttttttcgactgctccttttttttttttttgagacagagtttcactctttttgcctaggctagagtgcaatggcacgatcttggctcactgcaacctctgcctccctggtttaagcgattctcctgcctcagcctcccaagtagctgggattacaggcgcctgccaccatgcccggctttttttgtatttttagtagagacggggtttcaccatgttggccagggtggtctcgatctctcgaccttgtgatccgcccgcctcggcctcccaaagtgctgggattacaggcgtgagccaccgcatccggcttgactgctccttgtggggcagggactaacccatagacagagtacctagagcagctagattaacacatttatatataaaatgtaacatctgttatatttgcttcatctgggttttttttagtatgcatcttttaaaaaaatttttttacataatttcaatgttatatctaacactgttagcaatagtatattatctaataacagttcataatagcattttcccaattataccaaaaatagcctttttttttttggcaacggagtttcactctgccgcctaggctggagtgcggtggtgtgatcttggctcactgcatcctctctctgcctcccagtttcatgtgatcctcctgcctcagcctcctgagtagctggaactagaggcatgcgccaccatgcccagctaagttttgtatttttagtagagacaaggttttaccatgttggccaggctggtctagaactcccggactcaagtcattcacccacctcggcctccaaaagtgctgggattacaggtgtgagccagcacaccggacaaaaatacagaatccagataaggtctacacactgcatttgattgttatgtccataattctctgtgtgtgtgtgtgttttttttttttttttaagacacagggtcttattctgtcacccaggctggagtgcagtggcatgatgatagctcactacagccttgaattcctgggctcaagcaatcgtctcgcctcatcctcccaactagctagaacaataggcatgtgccgccacacctggctgtgtgtatgtgtgtgtgcgtgcgtgcgtgtgtgtttgtaggtggggtcttgctgtgttgccctggctggcctcaaactcatgggctcaagtgatcgcccgctttggcttcccaaaacgctaggattacaggtgtgagccactgcacctgaccactgattctcttgaactagagcaaatcccccttacttattcttcccccctttttaaaagcaattgacttttgaagaaattagatcagttgtcttgtacagtatctcatgttgacatcacctcaggatgcacatgatgataagtgggttcatttgtgttttaactttaactttggaggtacagtttaaaatgtcaaatgttaaatcactgtttcgttaatttttttttttactgttttctggccttttaaatcagctcctttgaagtaaacaaaacagccattccaaagccagtgtttcaggatctactgatagaagtggttcaaaggttttttggttttttgagacaggatcttgctctgtcacccaggctgaagtgcagtgccacaaacactgctcatttcagccttgaccttctgggctcaagcagtcctgccatctcagctttccttgtagctggtaccacaggcatgcatcaccatgcctggctaattttagacagagtcttattctgttaccctcgctggagtgcagttgtgtgatacagctcactgcagttgtggcctcctgggctcaagcaatcctcccacttcagcctcccaagtagctgggactacagatacatgccaccacacccagctaatttttgtatttttgtagagacggggttttgcatgttgcccaagctggtctcacactcctgagctcaagtgatccacctgcctcagcctcccaaagtactgggattataggtgtgagccactgtacctggtctcctggctaattaaaaaaaaaaacaaaaaaaaacttttgtagagatggtgtctcactttgttgtccaggctcaaaggttttttttttaaagaagtagtgctcatctaatctttatagatttgtaaacacaagctagttttataactcttagtttagaaggccatgttaagaaaaaggaaactgtgctgggcgcggtggcccatgcctataatcccagcactttgggaggccgaagtgggaggatcacttgagcccaggagttcaagagcaacttgggcaacatggcaagaacccatgtctacaaaaataaaaaataaaaaaattagcagtgtgtgggctgggcatggtggctcatgcctataatcccagcactttgggaggctgaggcaggtgaatcacctgaggtctggagtttgagaccagcctggccaacatagtgaaaccctgtctctactaaaaatacaaaaaatcagctgggcgtggtggcgggcgcctgtaattccagctactcaggaggctgaggcaggagaactgcttgaacccaggaggcagaggttgcagtgagccaagatcgtgccattgcactccagcctgggcaacaaaagcaaaactctgcttcaaaaaaaaaaaaaaaaaattagcagtgtgtggtggcaggtggcagtagtccccagctactcaggaggctgaggcaggaggatcacttgagcctaggaggttgaggctgcagtgagccatgttcacaccactgcacaccatcttgggtgacagcaagaaacccaagtttcaaaaaaaaaaattgttccagaagcttgggtttaatagatagtcccctcctgtgatagcaagtcataattgatacttagttcttgaattctcagccttttagtgaagttctggggaagttagctcttcttttactgtgacttttaatatcttatacagatatgattaatttgcacagaattgaatttcagagcttcaagagattgttaaccagcaatttaaaaaacccttatgagattaattttttctgtatacacaattaacttaagcatagttgttctcatgaagcaaaacagagtagaaaatattattaaaatgtatgtgaagaaaaagtgttaccttgatgcaaaaacttaaatcagtgacctactctgttgtatattttcatgggctactatctgtatgcattattagttttccctacctgttatcttttgacacctgtgtttcataagctgttggaaatataatgtatacatgtttattttaaatgagttcagtataaagttactttgcaccatttgtgcctgtttacttttgctttgacatagatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaataggtaaggtcctgcctcttcttgagactcattgggtctatcttgaatgttttgggttttgtgatttttttttttttgagatgaagtctcgctctgttgccaggctggagtgcagtggtgcgatctcggctgactgcagcctctacctcctgggttcaagtgattctcctgcctcagcctctttgagtagctgggactacaggcgcatgccgccacgcgcagccaatttttatatttttagtagagatagggtttcgccacgttggccaggctggtctggaactcttgacctcaagtgagccgcagcctcctaaagtgctgggattacaggtgtgagccaacacacccggcctaaagatttaataggactttacatactttgagtatatgcagaaaggcttaattattttgctaggtttttaatttaatcatttttattaactatatcaaaagctgggtagtaaaaatgtgataaaaggaagtaagatgtcaacatttaaattaagatgggggaagatttggataatgagcaggaatattgactgaagtaaggatttttttttttttgagacagagtttcactctgttgcccaggctggagtgcagtggcgcactctcggctcactgcaggttccgcctcccaggttcacgccatcatcctgcctcagcctcccgagtagctgggactacaggcgcctgccaccgtgcccggctaatttttatatttttagtagagacggggtttccccgtgttggccaggctggcgttgaactactgacctcaggtgatctgccggcctctgcttcccaaagtgctgggattacaggcatgagccactgtgcccgcctgaagtaaggatttttgtttgcttctggatttaattatttctttgattcctaacccagggcaacatttggaatcttttaagtttcataaatactttttaaactggtaccctgggattatcttgtcactatatatatgtgtatatatatttttgttttttgagacaaagtcttgttctgtggcccattctggagtgcagtggcacaatcatggctcactgcaaccttgaactcctgggctcaggcagttcttccaccccagcctcctgagtagctggaactataggcatgcatcaccatgcccagctaacttatttttatttttattttttgtagagacagtgtctggctgtgttgcccaggctggtctcgaactcctgggctcaagtgattctcctgcttcagccttccaaagtgttgggattacaagtgtgagctaccacgcccagcctttgttcttttttttttttttcagtgcctataatctagaaagtctcttttagggtttaattcataatcattttacctgctctctgatgttacaaaaagggctaagttcttaaactggtaatggtctgaggcattcagtgcttatgggtgttcaggtgatatttgttgagtggcagaaatttcagatcattttggcttttaatgctcttaagaggaattgaggatttggacataaaagtcatacctaattagaatctgttaataacccttgaagctgttatgttttaacagtgctttctgttccacctctcagaattgcctaaggaggtgccagaaaagcttccagaggctgctgattttggaactacgtcttctctgcattttgtccacatgagaggattacctttccaagccaatgcccaagacattataaacgtgtgtggcagtaagatatccaatctcaatagatttgaacaaaagttctaaaattgaacttgtattaatttggggaaggtagagaagaaaatatagtgtttctgcgttggatagtaagatggcatcttcctggttgcaaagcttgcttctttttctgtagctgaaaagtgtggcttggtattacttttttttgtgacagagtctcgctctgtcgcccaggctggagtgcagtggagtgaacttggctcactgcaacctctgcctcccgggttcaagcatttcttccgccttggtctaccgagtagctgggattacaggcaggcgccaccatgcccggctaattttagtattttcagtagagatggggtttcaccatgttggccaggctggttttgatctcctgacctcaagcgatccactgtcctcggcctcccaaagtgttgagattacaggtgtgagccaccatgctcgctgagagcagatatttgaaatgtcactttgagttctgagaaaaagtaaaaagccagaagacatactagatatataaatatattactgcttaaaaagatttcctaaaaagaaatgtatcaagtgtatgaatcaaagtctgaaagaaagatgaagagccaccagacttctaggtaggtttacatccatcatgttcctcttgactgcctttgtttgtcgtttagttttttgctccactcaagcctgttagaatcaccatggaatacagctccagtgggaaggccactggagaagctgatgtgcactttgagacccatgaggatgctgttgcagcgatgctcaaggatcggtcccacgttcgtaagtcctgcctttggcttttgttgtcatttttgatgcttgtctttgcttacaaatatctttttctgttttgggattgtagaatttttccttgagaaatttgtattcttttagtactagtaaattaaacgtaacagataaaacactatattataatttaaaaaattttgtctgctaattatcctgcaaatctctttctttcttttttttttgtcacccacgctggagtgcagcggtgccatctcggctcaccgcagtctcagcctcctgtgttcaagcaattctcctgcctcagccacctgagtagctgggattacaggtgcctggcaccgtgcctgactaatttttctatttttagtagacacaggtttcgccatgttggccaggctggtctcgaactcctgggttcaaatggtccacctgcctcgacctcccaaagtgccgggattacaggcatgagccaccgcatccagcctgtttgtccattttacattttgtttgtttgtggttgtttgagacggagtcttgtctgtcgcccagtctgtagtgcagtggtatgatctcagctcactgcaacctccgcctcctgggttcaagtgattgtcctgccacagcctcccgagtagctgggactataggcacccaccaccacactggctaatttttgtatttttagtagagatggggtttcgctacattggccaggctggcttgaactccttacctcaggtgatcctcccacttcggcttcccaaagtactgggattacaataggcgtgagccaccgtgtctggcctaaattttgtttttaattagggaaaggaaagggcaaagggtttgagttgctgtctgaactgtgagaaaaatggctgtaatatttttctaccttttcaactttttaaaactaatctttctcattatcctcagatcataggtatattgaactgttcctgaattcatgtccaaaaggaaaataagactctaggggctccagataataaggtaaatttaagaggtaatactgtgggctgggtgcagtggctcacacctgtaatcccagtactttgggaggccaaggtgggcggaccacctgaggtcaggagttcaagccagcctggccaacatggtgaaaccctgtctctactaaaaatacaaaaattaaccgagcatgatggtgggtgcctgtaattccagctactcaggaggctgaagcgggagaatcacttgaacccgggaggcagcggttgcagtgagctgagattgtgccactgcactccagcctgggcaacagagcgagactcaaaaaaaaaaaaaaaaaagagagagatacaactgtggaaattatttgctattgataaactaataatcattcactcactaatttgtaatatggtagaaaccattctctttttatttttcaaatttttttagggactaggtcttgctctgttgcccaggctagcagtggtgcgatcatagctcactgcagcttcaaccttctgggctcaggtgattctctcacttcagcctcccaagtagctgggactacaggtgtgtactaccatgcctacctaattttttaattttttgtagagatggggtctcactatgttgcccaggctggccttgaacttctggccttaagtgatcctgctgcctttgcctcccaaagtgttggaattacaagagtgagccaccccgcctggcaccattcctttttaataaagatcaaactaatgataattgaagtgtcaatataaggaatgaaaattctcgctctggcttctcagatgtggggggcaaaaaaaaaaaaagaaaattctgctgggaaatagaattaattatgatattttttcattttttttaaattttattttatttatttatttattttttgtgagatggagtttcactcttgttgcccaggctggagtgcaatggctcgatctccactcactgcaacttccacctcccgggttcaagagattctcctgcctcagcctcccaagtagctgggattacaggcatgcaccaccacgcccagctaatttttgtatttttagtagagacggggtttctccatgttggtcatggctggtcttgaactcctgacctcaggtgatccgcctgcctcggcctcccaaagtgctgggattacaggcgtgagccactgtgtccggcctactttttattttttttgagacagagtcttgctttgttgagcagactagattgcagtgatgcagtctgggctcactgcaaactccgcctcctgggttcaagtgattctcctgcctcagtctcccgagtagctgggactgcaggtgcccgccacaatgcctggctaatttttttgtatttttagtagagatgaggtttcaccatgttggccaggctcatcttgaactaactcctggcctcaagtgatttacctgccttggcttcccaaagtgctgggattacaggagtgagccactgctcccagccataattccttatgatttatatggtagctttgagcattatctccatatagaatttttatgcataatttccaacatcatgctgtttgccaaaaaatagccacctttagtagctataaatcgtaatagactggatatgtgacttgcattagctttttttccccacttaaatttaaacacgttttccattttctcaggttacttttgttttttttttttttttttttttgatatgaaatctcactctttttgcccagggtgaagtgcagtggcacaatctcagctcactgcaacccctgcctcccgggttcaagtgattcttctgcctcagcctcccaagtagctaggattacaggcattctctaccacatccagctaatttttgtatatttagtagagacggggtttcaccatgttggccaggctggtctcaaactcccgacatccagtgatccgctagcctcagcctcccaaagtgctgggattacaggtgtgagccaccacgcccagccattttctgttttaaggtatttttaaaaggataccatgtgaaaccagagtgtatcatccataaacacagttaatgtgccactgtttccttttcctaaaatggcattttttttttgccttaggaagtacataattttatagtgttaacctacccgtgagatttgcttaatacatcttgatgttccttgcctcgattaaatatatggtgtcttttttttttcccataaggtattgtaagtattactgttgtattgcagtcacttttctacaggtaatggctcattcttttgagacacttacctgtaatgatttcttgaaaacacatggggccaggcatggtgggttactccagtaatcccattacttcaggaggctgaggcaggcagatcacctgaggtcaggagtttgagaccagcctggccaaaatggcgaaaccctgtctctcctaaaaatacaaaaattagctgggtgtggtggtgcatgtctgtagttccagctactgggaaggctgaggcaggagaatcacatgaatctgggaggcggaggttgcagtgactgagatggtgccactgcactccaccagcctggatgacagaacgaaactctgtctcaaaaaaaaaaaaaaaaaaggaacaaaaaaacacggacattcattctattactatatcctattctattgctttttttttttttttgggagacggagtctctctctgtcgcccaggctggagtgcagtggtgtgatctccgcttactgcaacctccgccccccgggttcaagcgattctcctgcctcagtctatgaagtagctggggctacaggcgtatgccaccatgcccggctaagttttgtattttatttttatttatttattttttgagacggagtttctctcgttgcccaggttggagtgcaatggcacagtctcagctcactgcaacctctgcctcctgggttcaagtgattctcctgcctcagcctccccagtagctgggattacaggcatgcgccaccacacccggctaattttttatttttgtggagacggggtttctttatgttggccgggttggtctcgaactcctgacctcagctgatctgcccgcctcaacctcccaaagtgctgggattacaggcgtgagccaccgtgcctggcctcttctgttgctatttttggatatgaagtcccacaattctttggtgttaaatatttataatagctaaaatctatttaaaatatattctgaaactcagttttttgtaccagcctgtaaacactaatgcctgactagttttcctcactttaactcggtttatcagatagcttgcactaaattagaaaggagaaaaatttgaatttgcaattttaaatggtatgggaatgtgtgccatcctttttcatcttgagtaaatgtacaatattttttgttttatttttagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatca

SEQ ID NO: 35897 - DNA, 7122 bp, Homo sapiens
cgcattgtggtccgcttctctgcactatgtcgggtggcctcctgaaggcgctgcgcagcgactcctacgtggagctgagccagtaccgggaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagaggtttgagcggtggtggtggtggcggctcccgtttccacggttgtgcctccgcagacgactacgtagcaagggggaggggtgcccttctctctcccagagtaggcagaggcgccttcctgatgcagatgcggggctttttgctttgttttttaaatcggcgaagcagtgcccttcggcgattcgggccccttctctgggaggatggtgttacggaagctgtacgcggtgcgtgggagacacaagtggagtcctcactccgccctcggggaagcttcggagtggggaggtggacccgccaagctcggcactttgagggtgttcggatgtaaagatcggagaattgctggatttcagaagagggaaatttttagtccggactatatcacagtatattttgtggaaaaaggggaggcagcagatattcaaagtagacttttcagtatcagcggaggtagggatggaatacggttgggggttggcggggcgggactcattaacccaattatttagtaaacgtttatcgagtgctgtcgccaaatccttgtgctaaaccctagagggagagggaagacagtttctgcgctctgcgagctcataatcccctgtagtgaggattcagaaaagggaaaaatccccttgtgactgggaaaggaaggggcgcatatagcagagggtaagtgtggagaatgtgtgaaatgtgttactagagtagggaaagggaaattttgtttgacgctaaattagggaagctcttagatttatttagtcaaggctgggaacggtggctcacgcctgtaatcccagcactttgggaggctgaggcgggtggatcacgaggttaggagttcaagactagcctggccaagatggtgaaaccccgtcttactaaaaatacaaaaattaggcgggcgtggtggcaggcgcttgtaatcccagctattcgggaggctgaggcaggagaatcgcttgaaccggggaggtggaggttgctgtgagatcgcgccactgcactccagcctgggcaacagagcgatattccttctcaaaaaaaaaaaatttattcagttaatgtattttattttttgagacagagtctcgctttattgcctaggctgaagtgcagtggcgcaatcacggctcacgcagcctcaacctcctgagcctaagtgatcctacccacctcagcctcctgagaagctgggaccacaggctcgcgccaccacatccagctaattttttgtagagacagggtctccctgtgttgctcaggccagtctcgaactctgggactcaagcgatccacctgcctggggcttcccaaagtgctgggatgcctaagtgccaggcatgatttgcacttctaccacttttagttactactttagacagttccacatcctgaccattttgaacttaaagcatcctgtgagatgaaaactggaaccttctgactttgtctattattcatctcctcagtctaaacctgtagctttttttagatgctaatgccatactgtcatgtggaatttctagcattctgtgaatggaatccatattaatatactttaagcacttacaccacagttatcttaaactgtaggctatttatttggatcttacttacatgtgtgagaaaagtagaaaaagaagatgcctcctttccatgttcacaaatcagtaacagcagtaaaatgaaaggaatttactttctctaatgtctcactccaaagttccgaaaacctctttttaacatacaatgactattgtcctgtggactttttttttttgagatagagtttcactcttgttgtccaggctcaagtgcagtggtgcaatctcagctccctgcaacctccacctcccaggttcaagcgattctcctgcttcagcctcccgagtagctgggattacaggcgcccgctgctaccatgcccagctaatttttgtatttttagtagagacagggtttcattcactatgttagccaggctggtctcaaactcttgacctcaggcgatccactcgcctcagcctcccaaagtgctgggattacaggcatgagccaccgcgcctgaccccgatgagccattttggacccagggctttgtctgtcaggtgtgttggatgaagcccagttatatgcttaagtctctggcttcatcctgtcatcccaatttggaagcccattaagaaagtgagctctgttttgtttttagtgatcactacattttcccctaaactcagagaaagatctatgagcacgtaaagcatcaaggttgtggctttcaacagtctctagggggttattaaagaggaactctctctctctctgaaaacccacttatttttcactacgaaggataaaagggccctttgtcatatattgggtcaaggtccagagtctacacttgggtttaaaggatgcactgctgaggatatggtgtgtgcagggaaaagggaagccgcttgcgtggcagtcgggcgtagaagtgactttgttgtatgtggtataacttttgagccctgtctctactaagagtctggacttcgcataagtgcttcacagaaggtcgacatccccctttttgggcaagggatttctggtaggctgggatgagagaagttgatttccaaaccagaattaatgaatgtctctaccgtacttagaaatactatttaagcaaggctctgaagttgcttaacttttgtctctatttgaaattctagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggagtatccttcccatggatctaatgtagctgctgaaccagggtagagctgagagtggtagctcataagcgtccctgcactcgtccctacgttttccttcatctccctcctactttccacccagtgtgtctctgcccttatactgtaaagctgatactatttatattctcttctgaaatccatgctttatggttctttaacaaaaagtttttcaagaatgtttgcccttcacgtaaaaaaaaaaaaattccaaagaatgtagtgaaaatataaaaatctcgtactgttctaaacccctaatgccctttgccagaggcagtcagttaccagtttcttgggcgtctttcaagaagtaaccctgtgggtgtgcggtagtgtatttcatgtgctgtttttaaaatcatttttttattttttattgttccatttcagcatatgtaggtctttttttaaaatagctgtacagctgggcatggtggctggtgtttgtagtgccagctgctcaggaagctgaggcaggaggatcagttgagcccaagatttcaaggctgcactgagttgtgactgtgttccagcgggggtgacgggttaagaccccatctttaaagaaaaaaacttttaagtaaatagctgtatagtatttcattatatagatgtatataacctgactgtataggtacaaaccaaaactatttactttgatcatttaattcccttactcagactcttttaagtattggacctcttggatttatcctatgttctttttactgtatgttttggtcattcaatttaatattctgagaaattttgcaggcccaatttaatatatcttttgaattttttcctgtgccctgaattatgtttgtttcggttgaaatttttccttaagtgtctggtgatccctggatttctgctcataattaaggaaaagaatgctgactcactggacccaggcagggcttctctcccagattgcaggcttgcctcggggatacacaggtttcccaaatgctagaatgaaaagagattttattttggcttgctaacatcaaagatactagtttctccagatggtttattcagaacactgttgtcttatttttatttgtctgagattaaatgtcttcccctttaattaaagggaggtctctgatgaagtaggtttgggaactgctaccttggtgacagcttgagtctttcctttagtgaagtgcagcacaattccacgtgcacggtgaccttctcttgattagggtgccttggaatgtacagaacctaacttgaatatacagcactggtttcttggataagaagtgtacagtgatctaaacttgcaaaccaaaatacagagatgatgggaccaaaaattatcaacaggaatgtccaagaaatatgatcagtgtagccatggatacgtgtcatatttgactctatgtgcttccaaaccaatcgcaaacaggcctgggcaagctgaattactgtctttgaactccatctggttggattagctcttgtactttttaacaactcagcttcatttacatgttgttcccctatttccagaaatgtttggaaaaatgctagtgttccttaatacttaagatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggtatgcaagaagggtctctgggctcagccattgcctgggattccagtcacaatgacaggtgttttggcaatttgtatttactcttttgtaaataactttgtgtctataaccttggcttgaagtggatctgaaaaccacccaacggtttgggtgaattttttttttaaaccgtgaaatggtatgttctgtacgtttctaacaagcaaccattcttgaacttctgctagggctaggtatcttccacctgcaggaacatctaaaatgaaagcaaaacgcactgaagtgagctgaagtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaactt
